United States Patent 8,067,671 (METHODS FOR GENETIC CONTROL OF PLANT PEST INFESTATION AND COMPOSITIONS THEREOF) - sequence listing, part 35

SEQ ID NO: 63096 - DNA, 2479 bp, Heterodera glycines
  Genomic contig location: Contig_ID=SeqID_6848; Location=1838..4316; Strand=+
  SCN-specific regions: Sequence locations=1-26,49-237,270-556,585-2479
atggcttatttcgaatttcccgaggtaaataattcatttatttaaaatccagaaacaatttgagattaaatgatcccctttcaggctgattttgacagtttggaagcactcgttgagtttgcgtacaccgcccgacttcgaattggaagtcgccgggtaaaggagctttaccgggtaaggagtgtttttgttgtgcttttttgttttccgtttgattcaccattttgattgacgtcctcaatcaatcaataatcaatcaatcgatcgattggtcagactgcctttgctctccaagtgtcctcggtggctcaggcgtgtgcccattggctagccgaacacctcaccgtcagcaactgcatcggtcttagcaaaaaagcaaatctctttcttaaacggttcaattcacatatgcacaggggccacttttccgttcccctccatttctcataaaggggggggagtatagaaagggttgaagaacacaaaattttgtcactgtttttgcaaatttttttccttgtgcatgtgtgatttaagttcttccagtgtttctgacaaatccaaaatttccaaaaattattctgcaaatctgtttcccgattttttttcataagaaagtacaattgaaacaccggttcattcctctttcttgggaccttaaaattcttatctcatcagtttttactggatcaagttgataattttttgctccataatgcaattaaattttattacctacagtatagtttttctgtcttgcactgttctttggtcttttgtcccttttttaattccattattttgtgggtcctttggtgactcattctctccattatcaatttatcactgattcgtttgttttttgttatctgatcatttaaggtattcatcgtcaagccaacctcaacaaagacgcttttctgttgagccgagtgaacactttcatccgtgacaatttcgaggcggtggtcggcgatagttcggagtttgcgcaattgccgtgtatcaaaagtcggattatcgtttcggcctccgacgggggaagagaatttggtgaattttgattcgaaattctaatgacacattgatttgctcttaattacgataagtaattattgtgtctatttgcatttgcagcagcacaaagtgaccaatcgcacctcaaagcgccccttctcccctcgggggatgaactcgccctgcgctgtcttcgctatttccagcacagcgcactccgcgcagcgggcgaacgcgtcgatgcgcacatcgaatcactggcggagaaaacgcaccttttggtgaccaactcggaggagcagcacaaaccactggcgaacaacaatgggggcgcaagcagtgcggcgccgacgatggcaaacaatggcaatgggcagcagcacaacaacggacgactgcaggacgccaacgaattggacgagaaagtgctgtggggggggggggaatgtgggatttgcaggaacacattaaaacaaaacacgacatgatgttacaaaactccgacaaaaaactttcatttcattggaaatccatggtaaattcggtttcagagtatgttgggatcgtgtgacctcgtcagggactacaaacggagcgcgagcatagcagcgagcgggaaaaagtcctttattgtagcatcatcaataccgaatttggatttttcctatttgttaggcttttgtcgagcaaaaccgaccaacagtcgtcgcttcacgtgatgggtgccaccccaattaagctgaacggtgccgacatgggaagactttcgaccaaggatgccattaaattcgcttcatggtgataaaaaagtgcgaaaatattttcttactaatttccaatcagtgagtcgctatgttcggtgggcagttgctgctccaacggaagcattccgtccgaaggcattgccgtaaacggcgattcgctcgccgccgtcaattccatcgcctgtcgtcagataatttgtgtactgcccactgctcccggcttctgggtttgtctggccctgctcttccaccggttggtccgcatcagcatccatctcagcgaggacgaggaactaatccgaaggcatcgcgaagatagagaaataattttgcattcactcccttttcagcagtcgtacaagttcagtcgcgagcagtacagatgggattggtgccgagtcggatggttcggtcacctcaaccgacgaccatggctccaccgacggcactgttgatggccgacgcgcagttctacctgcgcttggcgaagcacgttgtgccattggagcagcctttttggacggaaaaatcctgatttcgggcggatacgaccgaaatctttgcttacgaacatcggaggaattagacatttgtggcggagcggaagagtggcgacagttggcaccgatgtgttgcgaaagggcacgttttgacgcggcggtggtcaacggaaaagtctgggggaatcacaaaagata

SEQ ID NO: 63097 - DNA, 912 bp, Heterodera glycines
  Genomic contig location: Contig_ID=SeqID_6849; Location=71..982; Strand=+
  SCN-specific regions: Sequence locations=1-835,859-912
  Gene Ontology: Mol. function=transporter activity; Cellular component= spliceosome complex; Biological process=mRNA splicing
gtgttcgcagtgtgtggctccaacgggaacaacgacctttcctcctgcgaatgttttgacccgacgacgggacgatggaacgaagtgtgtccgttggagccggcaagaagccacaacggtaaggaaggaggaggagacggggacggcattttggcaaaatgggcaccacgagttcaggttgtgcttccctcagcggactgctctattgcattggcggctccactgatcacgcaactttgggcgattgcaggtgctacgacccggcgacaaacgaatggcgagagatcgcaccgctaaaggcacaacggtcacaggtgggcataaaaaatttaatgaatttttcgtaaaaaatttttaatgatggggggggctgatccgtggggaaagggcgggggaaaccagtgtatcatactaccacaggctggctgcacggcgtggcgtggtttggtcgtgtgcgttggcggctgcgacaagtggaactgtttggactcggtggaggcgtacgacccgcaaatggaccaatggcatcaccttgcgcgtctccgtacgcctcgtcgcggctgtgcggtcgctgtgctcggcaattcgttgtttgctattggcggtcacgatggtcacaacgtgctggccaccgtcgaagttttggactcgccaaacgcacagtggcgccctggcccatctatgcagcagagcgctcgtgttcaccaccacgcgatttccgcctcgggcattggcatttttgtcgtcggcggatttgacggcacacattttttggccagcatggaagtaatggagagcgaggagagtggtgagacggatgtttaaatgtggaaacaaattctaatttaaaattttaaaggttggcatttttcgcttgacgaccggaaggtggaagtggatccgacacttact

SEQ ID NO: 63098 - DNA, 1267 bp, Heterodera glycines
  Genomic contig location: Contig_ID=SeqID_6850; Location=49..1315; Strand=-
  SCN-specific regions: Sequence locations=1-654,678-778,800-951,973 -1267
caaatttctccaacgctacccactgaccatcgaaaagaagcggcagcagaaagtgttcttcaaagagaagccgaggcaaaacaaaagggcgaggatcagcgcattattgttgtccatgccgaaagagagggcactgaaacggctgaaaggacgaccgtccacttcaagcgcaattggacatcgcatgcctccgcgttgacaacttcggcaccaatctgggacgggcgcatcgaaattgatgacatgagcagcaccgacgacggtgggtgtgaagagtatttaagtgcccaaatttgaattgttcatttccctttaacacctttcatctgcttattttctgttcttttgagaagctgaaattgacgccgtacttgcagacgcacagcgattgcgaaagattgcgttggaaagagaattgccaccaaccgctggtcagtgtattaatattacaattattccatcaaatttattgttgccacatcttcctgatgcattcattcatttcccctttagcgatgagtcgtcctctgttgtacaatccgttggacttttccctgtcctccgagtcgggactgatctcgcccagcgacgcggctcttctgcccgctgtcacttacaaacagttgatgctgctcaccggaggtggcagcggtccttctgaaaagcagcagcagtcgaacagcgtcagtggcaccggcacttccctcggctcgcccaccgtcattggtgacgacggcgtcaacactgtctccggcacttgcacttcgtcctccgcctctgctgaaggagcgcaaccaccgctacagcagcgaccgcacgcgacagttgcgcccaccaccacaatccaagcagcaccggccacaatgtataaaatgaatggggtacccaaaggggggggggctgaagggggctaaagcctcctctgaaatccaaaatttaaaaaaatgcaacgaaaaataggtttttaaaaagggaagaggctcgtaatattgaagtattccattttgcgtaggattgtccagcagcagtaccaataccaccaccaaaatccccaactccgtccccgttcgcatccgtactcccaaggctatgtgccaccgccggttgtaagtggttcagtaacactaacagaaaaagattgtcaaattcttgcaggggcatgcctatcgctaccaagtgagccgcgggtcagtgtccaaagtgtacacgggcggaaacaaaatgcaatttgccatccaacagcaaaatgtgccgttgggagacagag

SEQ ID NO: 63099 - DNA, 132 bp, Heterodera glycines
  Genomic contig location: Contig_ID=SeqID_32855; Location=320..451; Strand=-
  SCN-specific regions: Sequence locations=1-100,122-132
tatgttgctgtctcttgattatgtcgtcctgaaactttgcgacttcggcacaatcgctaagcatcggacggacatggcgagcacttgtggcacggccgcatggatggcacccgaagtgttcagaggggagag

SEQ ID NO: 63100 - DNA, 762 bp, Heterodera glycines
  Genomic contig location: Contig_ID=SeqID_6851; Location=1436..2197; Strand=+
  SCN-specific regions: Sequence locations=1-762
atgactacggaatcacttgtcatccccaaggacatagccaataaaagtaataaattaacaaggaaaacttagtgaaatcggaaatattgttttcgtttcattcctgaattttttttacactttttagattatttgaagggggagggtccggcaaatgcgacaagggaaaatctttggaaaataaagcaattatattaaaaaaaacagaaaattttcaaaatgtctatcaatttaattgaggaattcttacaataacaataggaataagacggtttctcaacaataacgaggcaaaactaattaaaagtcatttagtcatcgatgaactcgaccagaattcattcgaacgatggaaacgaaagggatgcgttctcgaaattgtttgtgaatttttgtttccttcatttttatttccccatttataaacagaagcagaggaacaacgtgcgcttgtttcttaatgggactttgacagaaaatgagtgagtgaaatcatttcgattttagtggaaattactcggactaaaattcttacttttttttattcttccaggactttgcttacaaatgaaatctttcccttgttcaaacaagcgcgagaagctcttggttcagacagttttatatttacgcttggtctgcttattccgaacccaaaatgcggctatgtgatcggcaaagaggggaaaaccgtccaaaaaattcaggttgtacagaactcgggtccacattattaacgttggattccgatgaaaatcaaaa

SEQ ID NO: 63101 - DNA, 2070 bp, Heterodera glycines
  Genomic contig location: Contig_ID=SeqID_6851; Location=3736..5805; Strand=+
  SCN-specific regions: Sequence locations=1-201,224-249,272-477,501 -901,930-935,957-1175,1199-1330,1386-1397,1419-1443,1467-2070
atgcgtttcaaaggccgccattctcagattcgtcgactcgaggcgcgttcattggagttcaatccgtacgcaatgccaagggacaacaaaaagcgatcggcggacggcaaatggatgacacagaatgaacgaatcaaattgccaccatttggacactttaccagcgaacagcaaatgcattttcgagaaattcaggtcgtcggaatgggaaatttcttgaaaaacgcggcaatttttcattttagtggcatttatttaatttaaaaaatttctgtagaaatcgtcggccatcaattgggttttcgatgagctgctcaatttgacggaggcgggcgacggacgctttgtgactttggaaggcgacgccgaattggtgctcagtgcgaagaagcgactggcaaaactgatcaccgaaattgaggtggcaaacaaaaggcttaagtcgtgccaaatttggcaattccctgccaaacaaattcccatttttctattatttttcaatggtcatattaggctcttctttcaggattcccatctccattcttcgtccgttcggctggccaattcgccgaccaccggccgaacgctctatcgaacggttgtcaaagtgccgtcgcccgcctggcgattagtcatcggaggcggtgggaagacaatcaaagggttgaaggtgggtgtcatcaacccaaatggctttgctaatacaacgaatgaatacttttaggagcgttttggcgtgtccatgcgctttttgggcgacaatttcgttgcctacccgcacttccgatcacttagcatctttggacacgatcaaatgaatgttcattcggctcgcgagcacattgagcgcgaatttgtggcgaaaaatgacgaatatttgggagtgcgtaaaaacttttccaattattaaattatttatttttaaaattggaaacaatcattataaatgggaattagcattttaagcaaaacacttcccaagcgaaagcaaaaggacgtaggaaattcctttccacgacggatgacccgaacaataacatcgatttgatcgatgcgaatgcatacggacacaaaacggagattggcggatgggaatcggacgaagtgaggcacaaagacagaactcgaattattttctcagcattctcccgatgattaataatgcataatgactcttttttttaataaaattaattatgttttacttcattttttctattttaaggaatcgtgggctgtagatgaaccgcatgtttgctctgatttcacaatgaatgaacagaaaactgatgaaacagtgtcaaattcggaggaggaattgctgaaatgggatgacgaagacaaagaagaagataaagaggaagaacaaaaggatgaaaagaagacaaaatccaacatttttggaggagagagaggacagaacggaggagacggaaacactgtgaaggaattgggaaaagaggcagagagtgcgaagaatgaagacagcggaattgtgggagacggagaggaggacgaactctttttgctcattgaggggaaagggacgcaaaaagacggggacgatgacgaagtcggaggaaggggaggacgaagtcaaagcggggagcaccagcaacagatcagcgccgaatttggcacgggcgaaataacaaagcgacgaacgaccaggtgaggaggagaagcatttgggattagttggcactcttccgaaacacagtctgagcgatggcattggcaattcctgcgtctcggccgcttcctccgccgatttctacgccgacgagacggtgcaacagctgatatttcagccattggatcgtaatgccttggcttgtcaattagaacgtgccaaagcgacgctgctcggcgatgaacatttgtcccgggagttggcgcgtacggtaggtgtttggggatactctcgtactgttttacagtacctatcaaaatgatattattgctcaatttcagcaagcccttctccgtgcccgggagcgcgagtgcgagcagttgcgtttggaaaatcagcgtctcaaacttcaattatcttcatcgaccgtagcataa

SEQ ID NO: 63102 - DNA, 407 bp, Heterodera glycines
  Genomic contig location: Contig_ID=SeqID_6852; Location=1380..1786; Strand=+
  SCN-specific regions: Sequence locations=1-407
atggcaaaggcgacgaaagcccgatgggccaagaaaagtgagttttttcactaattttaattcaagatcatttttttaaatttcagccgctccacagctgaatcccaatgccgaaattccaccgcaggacgaagcagggccgaggataggggcccgaagggaacaatttcgaaaaagggatttgaccggcaactcaataagaaaaattttggttcgcgctacagaaatggacgaacttttcacaatggaatggcccaaagctatttgtaggacactcgaacacctcggcaaaattcaaatttttttcaaaagtgttttgtccgattttattaagataaaatcataaattttaggcacaaattttgtccccaaatgacccaaggcccatcttctactcttccacttag

SEQ ID NO: 63103 - DNA, 306 bp, Heterodera glycines
  Genomic contig location: Contig_ID=SeqID_6852; Location=1..306; Strand=+
  SCN-specific regions: Sequence locations=1-202,237-306
ctccgaatgtgtcattgcggctccaattcgtttcccttgggcgttcgattgcgcgactgcacccatctcagctgcgttcaatgtttcgtcgcatatgctgaagaacttttgtcccggatgagtctaaaatggcacccccaagtcggttacaccgtcggatgccccttttacgggtgcaccggtaaaagcgcttaatttttcgctttttaaattggcatttttccattgccctttttgtttcacaattccaacgcacttcagctgtcgtcaccgatgttcacactttgtatttgctggacaagcatt

SEQ ID NO: 63104 - DNA, 76 bp, Heterodera glycines; identical to SEQ ID NO: 51705
  Genomic contig location: Contig_ID=SeqID_6852; Location=1005..1080; Strand=-
  SCN-specific regions: Sequence locations=1-76

SEQ ID NO: 63105 - DNA, 209 bp, Heterodera glycines
  Genomic contig location: Contig_ID=SeqID_32864; Location=697..905; Strand=-
  SCN-specific regions: Sequence locations=1-185,207-209
tttggtacagaagtgtccattttctctgggactcagttgtcccagtgcttagatggcattggttcgagtttataccttgttttttagacttagctcatcaagcgctttcgaatgataccaaatttgtccgaatttgagcgttttaaaaggtcaggaaccccccttttcactcaaattttcgagttttaaaccggttcaaaaaccggttt

SEQ ID NO: 63106 - DNA, 832 bp, Heterodera glycines
  Genomic contig location: Contig_ID=SeqID_32865; Location=71..902; Strand=+
  SCN-specific regions: Sequence locations=1-297,319-463,490-597,620 -758,780-832
  Gene Ontology: Mol. function=guanyl-nucleotide exchange factor activity; Cellular component=actin cytoskeleton; Biological process =transmembrane receptor protein tyrosine phosphatase signaling pathway
atggccatcgaattgaacaacaacaacgcatgtgcatcaaccgaagaggacacaagcagttcaccgaacgcggccaatttgaccggcacgcccagcggagaggcaatgagcggtgaggaaagcgcacgactcaaacgaaggttatttttgcggatgaaacagttcaatcctaaagaaactcattgagttggccgatgcgtcaataagtaaaacttaaaagaagcttttaaatgtttctgtggtttctgggtggcaatggacccgtaatcagagatgggggggggaagcattcctatgaaaaagtgaaaggaaaaaactaatttcctttgattttttcggttgtcataaaaataatacttttgagtcttttatgactttttaatcaaattttcatctctctggactattacattacaccagagtatggaaaacaattgtgctttttcgcatttaatttctatgcattttcccttttcttaattttttacctgaccatagtttattctgcaaaaaaaaattgaaattttttgttcagttatgttctgcaagaattggtggagtccgagcgcacttacgtccaggacctggcctctatctcaggttctaatcccttcgaatgccggacgaattcggaaatcgcaaaatgcgctcctttcagacggttacatcgcctccctgcgggaaatggaactgagcgacgaggacagagagaaagtgaagatcattttcgccaacatcgagcagattctcgactttcacaaaacattctttttgaaagaaattgaaaagagtttgaacgattacgaagcggcgggcattccttcattaatat

SEQ ID NO: 63107 - DNA, 234 bp, Heterodera glycines
  Genomic contig location: Contig_ID=SeqID_32871; Location=1..234; Strand=-
  SCN-specific regions: Sequence locations=1-234
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaagcgatataacc

SEQ ID NO: 63108 - DNA, 145 bp, Heterodera glycines
  Genomic contig location: Contig_ID=SeqID_6853; Location=2177..2321; Strand=-
  SCN-specific regions: Sequence locations=1-49,95-145
aaaaatttaaaacttgatgctttattcaaagttttggctctaccagacgaagaattcgaagaatggctcagagaacttaagcttctacacaccacccgtttttgcgactgtggcaaggaaatgcgctacaaatggattaaaggac

SEQ ID NO: 63109 - DNA, 2648 bp, Heterodera glycines; identical to SEQ ID NO: 6853
  Genomic contig location: Contig_ID=SeqID_6853; Location=1..2648; Strand=+
  SCN-specific regions: Sequence locations=1-503,527-575,598-924,946 -1175,1207-1281,1304-1729,1751-2227,2273-2462,2484-2617,2639-2648
  Gene Ontology: Mol. function=CMP-sialic acid transporter activity; Cellular component=integral to plasma membrane; Biological process =CMP-sialic acid transport

SEQ ID NO: 63110 - DNA, 132 bp, Heterodera glycines
  Genomic contig location: Contig_ID=SeqID_6854; Location=533..664; Strand=+
  SCN-specific regions: Sequence locations=1-132
aaagcttctcaaccaattttagcgcatccaattccttctacaatcgcctttatacatcccattatgaacgctaaaattatcagagtgccgaaaatcgcatgtgatctacgcctagcaaaaaatggtgtaagt

SEQ ID NO: 63111 - DNA, 152 bp, Heterodera glycines
  Genomic contig location: Contig_ID=SeqID_6854; Location=1349..1500; Strand=-
  SCN-specific regions: Sequence locations=1-24,46-152
gtaacacccagatatgttcaacggcaaaattgtgcaaaggctttggtgaagttccaaagccatttggagaccttcgatttgaaggtttaattggacaggactaaatcctgtcaaagcaattacctttctcccagtatttcttagttggtaat

SEQ ID NO: 63112 - DNA, 180 bp, Heterodera glycines
  Genomic contig location: Contig_ID=SeqID_32873; Location=37..216; Strand=-
  SCN-specific regions: Sequence locations=1-135,158-180
gatccaatttaccaacaattggcagagcaaaaatatgcaattgacaatttcccgggattggatgacattttcaggaagacgcgcttttttcttgtaaattcacaacccgaagtggactttgacaattacagaagtgtcaagggcatggacaagtcaaattcatcggaggatttaatttaa

SEQ ID NO: 63113 - DNA, 816 bp, Heterodera glycines
  Genomic contig location: Contig_ID=SeqID_32880; Location=150..965; Strand=-
  SCN-specific regions: Sequence locations=1-134,158-159,205-345,367 -395,422-663,687-816
atggttgagaagcataaaaagctggtccaacaaactcgtccggtgaaaattttcaaacttacaattataaaatttcaaaaaaaattttacaatttgaaaactgtaaacatcactcaaataaaaaaatgttcctttaattctttaaaaacttttttaaggtttttttttaaatttctaatatgtttgaaaaattttttaatttttgggcgaagaaacatggtgcaccccgttttactgctcacatcagcataaagcaattaccattaaaaacatttaatgcatttttctatttttttcagcttggtgttgaaataattgacaccgcaaagaagggtagggttattattaattaatgccaatatttaaattgtataaaattgattaaattaaactaattcccttttttcccccaaattttccagtggccagcggctgtgtgacgtgcattgtccgactgctcaacgaacgtggcgaagaatgcgcgggccgacccaagccggaccatggcacattcccaacactgttgcaacagatcccgcccaattacacactggtgaagaacgaccagctgttcatcctggaccaatacatcaaagaggcacagcacagagaaaatgtgagggttacaacaaaaaaaaaagttgaaaaattttcatgaataatttgtgatttttctttgaaaaatatttttttttttggattttcataaatataaattccatccttaaaaaacaagaatttttttaatcgctgagaccatctgctgattgtgaaccaggaactcattgccccaatcagaattaaaaaaaaaataaa

SEQ ID NO: 63114 - DNA, 2026 bp, Heterodera glycines
  Genomic contig location: Contig_ID=SeqID_6855; Location=199..2224; Strand=+
  SCN-specific regions: Sequence locations=1-258,280-634,656-973,997 -1180,1202-1376,1399-1436,1468-1711,1733-1879,1912-2026
atgggcgcgcgtgcgctgctccgtcctctgctcacactgcaccccgtcaaacaagcggaagcgatgagacgcgtccatttgcattccgaggcgctgcgattggcggaaaaacgacggatacgcgcggatttagttgccacgatggaggagatgcgcgcacgacggaaggcagacgcaacgcgggacggagaggccaaatccgaagcatttggcacaaactatcagcaggagagtgagtattataataacatttatgggtcttttttcaccctcctcctcaggtgaaggcgcccgtttttccacgcttatgccactggacgaaaagggaagggaggaacggtcggtgccgtcctattgggagtacatatcactcgaggcaaagttgctgttctgtgcgcatcggccaaattgccccaagcacactttggagacgaattggcgacgcgcacttggcgaagtgatcggcgaggtcagcagcagacttgttggcaaatattaacacaaaatgctcattttgggaagaattttgggtaataattgaaaattataataaaaatggcgacgaatagttccaagatgtgccgtcgaatgaatttttaaccaaaaattgttatgcaaattatagttatttgatcggttcaacaccgacgcacaccatcgcggacgcacattgcatttccagcgcattcagtacggttatgtgcgagttcggcccacatacggggtggacatggtattggacataggtaagccagccattcggcggccaaatttcagacattgttccctccctcccatttgggtgttaccgttttatttggctccattcagccctttggtaccgccgtttccgtgccccgcgccgtgccgccacgctggcggtgcgtcggcacgcgtatgtgcagcgtcgcttcgggcacactgtcgcgcgcgttgcctccattttgccaataggtggcagcgacgcttcaaccgctggtgcgctgctgcgcagccctacgccaattcattttgtggtggcactgaagggccgtcccgacacttttgaacgatttgcacaaaatttgatggagctgcacagtgtttttggacgacaaagcggcacgcttcagctggtccttgtgttgtacaggtaaatgaaaaccaaaaaaatcacctaaatttttttaaacatcttaatttcaactaataatttaattggttcattaatctaattactatcaatgccattgatcaattatagacctaattcatatctgattttccttttttgtttgtttgtttttattacccataattgggtgcttaaaaaattttgaatttttaatgaaatttgttaagaaataaggcaattttccaaattgccaatgagaaaatttttaaagtttctgtttttatattcgatcgactttttcgctgacttttttttctctccctcatttttattttctccctcttcctcccttcaccccccccccccacctcgtacgatcgactgtctcgaacccttacgatcgactaagagaccccccctgactacccccttgcacaggtatacttcaaatggtcccccgttttcagctcttcattcgctgccgatgacctgcgcatcaatgcgacgctcacccgcctcgtccgcttcggttttggcactcgcacactgcgcatgccctccggcgctgtgttcagtcgcggcacggcactctccgcgggtgccgcactgctcccaccgggcgcactgctttttgtcaccgacgtcgacgtgctggtcaacgctgatgcaattgaccgcattcggctgaacactgtgcgaaattgccaagtcagtcgcatgagtgccgtggcaatgaatacgaattttctctttcatttccatatcataagggctgtttttacaaaaatatcagaattggaagatttttttcttttataaattaagcattaaaaaacatattcaggcatttgtgcctgcccatgtccaaaatcggatcaaacttaaatttttcaagctgatagcctaaaaaca

SEQ ID NO: 63115 - DNA, 1276 bp, Heterodera glycines
  Genomic contig location: Contig_ID=SeqID_6855; Location=3408..4683; Strand=-
  SCN-specific regions: Sequence locations=1-1244,1266-1276
atgtcttccgcttcctccgcccgcttcgtcccttcgctgctcttcgccccgcgccatgcgcttcgccatcgttgcgcgctgctcgtcgccgcgcttttgctgctgttcggcctcgtcacagtgtgtgccggtgcgtccaccgacgggcaaaggtgcgaagaatgacgcaagcattgcctattggcatgattggcattagcaaatggttcggcactgtgccgaacttctcgggggatacgaagggcgaagccaatattaagctttactcctaatgggtttttgaattgttttgtttaacaaaattataagtcggattccgaggacaaatttgtgacattttggattcaaaattgaaatgcttacgatggcatttcaaatgttttttcgcaggtggagcaacggcgtgggcctttggggcaaacggagcgatgacctgacaaatttggcactgttcagtgatctcgttgatgtaagtgccctgtcaaatgacgaaacaattaaagccgattagcatatcattgttgaacaggatgcccgctcaatgcgcaagcggccggagcatggttggcacaaactgaacgccctgtggggaaaacggtgagaggcattgtgaagtgacaacaacattattgtccaaatggaatactgtagtggctttattccgatacggtagaaggtgtccaatcaatgccaagggactgacaattgggtcagcggatgaaagagtcaataaacggcaatgatagacaccgaataaattgacctggaccatcctcaagccacctctgatcggggcgacttctgttggcatatttcttgatcggaaatgattctcatagacaaagttcggcctctgatcagatgctaacccatcgttgctaactttgctctaacaaattcccatcaatttcagatcagccaactcaaattggcaaacagccaatggcctgtggggaaaacggtaaattttattttaaatttcatcaaaatgcattgcttttttaggtccgtcgtccctccgctgcaacaaatgggcgaagaggacggagaatgaaagcgacgacgactgattgtgagcggtgaaatgtttttgccgtatgaaaaagaaacccgacaaaatatacgcgtcaaattttggtttttcctccatttttcataaatgtcggattataaaacggcataacaattaattagttggaccttttgaatatggcggctaaattagcttttatcttcacgaaaaatatcatttatttttcatttctatataaataaa

SEQ ID NO: 63116 - DNA, 231 bp, Heterodera glycines
  Genomic contig location: Contig_ID=SeqID_32883; Location=58..288; Strand=-
  SCN-specific regions: Sequence locations=1-19,42-59,89-231
atgtgtccattcgtctttttagttgctccaattgcattgggtgagcaattaaaaaaggcatttaattttgtttaaataattaaaatttcgcttaatttaggccattgtctccgccaccgaaagaagaagaacaagaagcgggacaaagcagcgaaaaaggggcgtcgtctgctgacaattagtgacggacaaaagaacaaaaacagtgatcagccgcagaagaagaaatga

SEQ ID NO: 63117 - DNA, 1149 bp, Heterodera glycines
  Genomic contig location: Contig_ID=SeqID_32884; Location=210..1358; Strand=-
  SCN-specific regions: Sequence locations=1-344,380-569,592-967,989 -1070,1093-1149
atggctcaacatggggctttttccactgcggcacgtacggaggaccaatgcgaagttggcaccagcaaaatcgcaaccgaaatttggggggaacagttgagttactgcttttgcgcagttggcgatgtcggggcgcacaattcaaatgtgaaagtggcatttcctgaggaattgtcctacggttggtcagggagagaggggggagggggaatatggggagccaaaatgagaccaaaatggcccaattggcggcaaaattgtgaaaaaaaagttaaatttctaatcacaaatacgcaaattgaccctaattggattgattaggtaattaagcgttgccaattaagtccatcttttattttgaaaatttgccaaatgttttcagtgagtcgcggcattcgttgtcgctgggaccattttttggtgctgatgatgctgtacgtgataacaaatattaatttgatgttttaaaagagtgttgcttattagagttgtgcattctgaaaaaagcctgacctggattttttctggacaaagaactaggaaaagccaggtccaggctctggacttggattttttgaaattgtttaaaaagcaaataaatttttaagaaaaatcaattatttcttaggaaaatcaaaaaaataaaaataaatgcaatgttttaaaatcgttttaacatttttgataaagaaataaaaaagggtcactcgaaataacaaatataaaaatattatccaggaaaaagattttcgtgattactggacctgggagcctggatccaggtccagaacaggtcgaactctaatgttgatgatgcattttgggccattgcgtcacggatattttgttgataaattattcattacttttattacataaatgatcattgtccctaacagcacacttaagtactgctgataaaaattaattcaactttgaaagcaagaaggtcttgtgccagaaatgaaaatttaaaagaattttcaaaataagaaatattggggggttcggcggaatatttttaacttcttttttttgaatttcataagtatttatttaataggttttacgctctttgaatgcttttctcaataataatttatactcacaaatttcaattttctctgaccaatgaattcaaataataaa

SEQ ID NO: 63118 - DNA, 164 bp, Heterodera glycines
  Genomic contig location: Contig_ID=SeqID_32885; Location=242..405; Strand=-
  SCN-specific regions: Sequence locations=1-34,58-164
atgcgcactttgcttcgcggcgacccttctgacttggaagcactgactgattttcttcgtgccaacggagtggtggagaacgcagcggcaatggccgcgtcgccacttttgaccgcggaaataagtttgggagaggggacggacagtgccaaaagcacggccag

SEQ ID NO: 63119 - DNA, 827 bp, Heterodera glycines
  Genomic contig location: Contig_ID=SeqID_32888; Location=1..827; Strand=-
  SCN-specific regions: Sequence locations=1-564,586-827
  Gene Ontology: Biological process=tyrosine catabolism
tgactgactgattgtgccgggtggcggaagggattgtgccgtctttaataattgcgatggcttttaggcggcccattggtattgcgtcaacttcggcttcatccctttcgcctacaggtgtcgtctctcgttaatcactttcggcatttccctttgtccctccttttcggcatttcccgcctttttctttcattttgtccttttatctttccgtttgtcccttcaggggcctcgagacgggaagtcgaaaaacggtggcatatgcagtgaaacaggacaaagtgaagtttaccgggggagaaggaacactcaccgcccaccaaccaaccgtttcagatcgtttttgtgttcgagtcggcactgctgcctaacaacggggaaatgagcgcacatttggccaaacatggcgatggtaagccataattggcataattaattcactttgatcactgatcatccatcctttgttcatttgattatttttgttgtgccgtttgaccattttttgatcacttttccttttaggtgtcaaggtcagttctccgccgttttctccgtcttcggcttttccccttcccttccactgattaccgccccccccccccccaatcaaaggatgttgcgttcgaagtggacaatttggactgggttttggacactgcgcgtcgtgcgggcgccgttgtggcggaagaaacggccgaggagagagaccaaaacggacacatccgaagggcatccatccgaacggtgggcattattttcgcttactgtactccccccaccttagtacggagacaccattcattcactgattgaacggcatcact

SEQ ID NO: 63120 - DNA, 716 bp, Heterodera glycines
  Genomic contig location: Contig_ID=SeqID_32889; Location=177..892; Strand=-
  SCN-specific regions: Sequence locations=1-716
atgccatcgacgacggaagaggcggaggacttggaggaagacgaagaggaacggcacaacgccaccgaagcaggaaacagcgttgtcaacacgcactactgctgtgagtggggggggggaagcgaagcaccaaccgacccccagcaatgcttttatccgaagttccctttccgcgaaaaacatgcatttttagatttggaaagtccttttaacgatgatttgtttgcgattatggtaatagaaagctactgtcctcgcatcgtcttctcaaatttcagcagaaccgctggaatttgagctgcgcttgtgcctctgccgatgggagcattgacaattcaaaggtccatttgggaagggacagatttattgttagaaacctttttcagatttatcgttttgatgttctccaatgcgtggatttagacgaatgtctctacgaagaatgccccaaaggttatttttttgttttttttttcactttggacaattcatcgtttttcaaggtcaacagtgtcttaacatgaacaaaggaaaaatctgcgcttgtcccgtgggctcttataaatctaaagacggaagaaactgcattaaagttccggtttccgggaatttaaaagaacttcttgaagctccattttattagtttgcactcggttatttgttgcacttgaaatacctaaataatatttgtacacacggcttattacatgaataaa

SEQ ID NO: 63121 - DNA, 142 bp, Heterodera glycines
  Genomic contig location: Contig_ID=SeqID_32890; Location=803..944; Strand=+
  SCN-specific regions: Sequence locations=1-142
atgtcgacaaagcctcccgctgataatgagtccaacaatgaaggtcaacagaagagcagtaactcactcgcacgagacgggaattatgaagatggaaatatgaagaatagagacaaacaaaaagagttcggaggacctgctg

SEQ ID NO: 63122 - DNA, 136 bp, Heterodera glycines
  misc_feature (8)..(8): n is a, c, g, or t
  Genomic contig location: Contig_ID=SeqID_32891; Location=735..870; Strand=-
  SCN-specific regions: Sequence locations=1-74,112-136
cacaaatntaaattatttgctgaatctaccgaatggtaaaaaaagagcgaagaaagattaaactctttttttcgtttttttttaaatatttttaattttatgttttttttactctaaaaatttccataaaattcgc

SEQ ID NO: 63123 - DNA, 2632 bp, Heterodera glycines
  Genomic contig location: Contig_ID=SeqID_6857; Location=689..3320; Strand=-
  SCN-specific regions: Sequence locations=1-302,324-480,503-746,768 -1585,1607-1912,1934-1995,2132-2208,2230-2335,2404-2515,2538-2632
atggagtcggttccgttgcgctattttgttggtatcactcattccggccattccgtcactccgttccgtggcgacgactgttgggccaaacatcatcagcaggaggagcatgtcgaacaacatcaactcaacccggaggattaccatttggctgctgccactgtgtgctttgagccgctgcaacgtgttgaacgtgccaacgagttggagacgtatccacgccgtgcgtactgtcgtgatgtcaaaatgccaaaatcggcggatgaaagaggcgagccattgccatttgcaacacgaattggagcaattcttcatttgaaatcgacgaatcggacgacaaatcaatggcagccaccaccaatttccgtctacaatggcccacacaaattgttggcgccggctgaacaactgacacagaccgacattgaagcgtcaatttgccaaaatctgccgcccaattctgtgatgccgattaaatctgtcaaaaaagaggaggaggaggccactgataatgtcgcaattaacgctgccaatgccaacattgttcggcatggatcaaagaaaatggccaaaatttttgtcacgctcaaatccgttacaacgatgcgtgaagatcaagcagcaacagcatctgctggcaatgtgaatgcgctacaaatcatcataacgccaactgctcaaattgtacacgaactttgccccaccagcgaattattgtccgtccccattggttcatgcattgataaacagcagaaagatgatgatgacgccaaatcagcagacaacaaccaaataaacggaggaggaggaaagaaatttgtggcaaaaattactgtaacaacatctgccatcacgaagggtactgtagggcccacttcgtcccgtcataacgccaatgaagaagcaagagatggtcaactgcaacaattgcatttgcttaacaggaaagatgagttcatgggccaaccaatcgagcaaattgttgcaatggcaaataaacggtcaactcaagttggacaagatgatgatcagcagcagaaagtgaagacgacgtctcggaaaaaatatgccgccaaaattgtcttaaaaacaacccaaacaaatggggcaacaacatcaaaagaggccgaaaaaatgacaaacaaacaatttgaagcaccagcagcagaatggcatgtgcttaaccgagaaagcgagttaaagtgccatccaattggagaatttgttgctttgacaaaggctgctgaacaaaaacgcactgatgttgagaatgacgagccaaaaccggcgaattgcaagaagtacaacgtcaaaattgtcatgaaatccccttccgatgatcatgttgtgtgtccgccaacaacagatgaggaatgccatttgcttagtcggcactcggagttaaaatgccgaccaatgggcgaatttgtggcaccaataaagaacaaactgatggaagaaggaagaagtgacgtgcaaaaagcggcaccaacaaatggcaaaaaacttacggccaaaattgtgaccaccaaaacaattgctgctgttgaacaaacgcaacaacaattgctggaaaatgaaccgaaaaaccttcagcagcagcaacagatgcattcacttcaccgtaatgaagagttaaagtgccatccgattgccgaatttgtgacgtgtactgcttcaacttcagcaacagttgtagatgatgatgaagcgagtaaaaaggaagaattggaacagcaaggacaacagaacggaggattccctgctgttgatgaggaggggaagcgactgagtcgcaagcggaagagaccgtccgccaaaatggcacttcttgggggcttttggcaggtgctaattgattgattagagtttgatgattggttttggatgtgctgagtaaatgctttgaaccatttttattggaccaattttgaccattcaaatctgatcatgtttttcttggtacggtgggttcatttgtcctactgtactttatctctctctgtctctttcttttttctctctctcactgacaattctctccatttttctctctcacctctctctctcctttctctctccctctcactctctctttctttccctttctctttatctctctcctcctctcgattagatttttaccgttttttgtcccatatttaaatagaaaattgttcattaatcatggattgggtagaaggaatgaattaaaatttgaaatttaaatttaccattttaaatgagggtatgaattcgaatttgaaattaccattttaggtggaaaatgtgaattccttatttgaaaacttgattttagcaaattggcacctccaaggacaagcagaagaagaagggcaaaaagaagaaaacggaccatgagaagaaggcgaagaagcagaacgggcaaaaggcgacggcaactgctgccaccacaacgtcggcctcgagcagttcatcatcaccctcaagcagtgacgcggaggaaatccatgtactggtccaagacgaagagggcaagcagcagcagcaaatgcctgcaattaatgttagcatcgaaaaagcatcattaaaaattgcattgattgacgagagtttctcgactgaacaacataagcgtttttttttgtag

SEQ ID NO: 63124 - DNA, 510 bp, Heterodera glycines
  Genomic contig location: Contig_ID=SeqID_6858; Location=2299..2808; Strand=-
  SCN-specific regions: Sequence locations=1-123,145-510
atgcgtgtccatcgttttgcatggccgggcatcatcaaattctcacaccgtcgtcactatttcagcatcaaattgaaggcgggcgaggtttgtcaccagatttgggggtccatcccccaaataaaatttgatggcattttttagcccaatttttttcaggtggaccccaaaaaggagacatctttgacgtacactttggtcggtgggaaggaacatgccaaattgttgtgggaatgtgccgttgaacaccatggattcttcaggtatttttttctgttcgatttttttttttttttgcaaatttttccacaaaaagggggacttaaaaaaatttgtatcaaaaattgagagaagtttcacttttttaggtccagtttttgaaatgttgttacttcacgtttatgcactggggaaatacaaaaattttcaaatgtaaattttcagaaccaatctattcaaacgttgtttaagagagagaattgttacactcagttttttcccaaaaataaa

SEQ ID NO: 63125 - DNA, 245 bp, Heterodera glycines
  Genomic contig location: Contig_ID=SeqID_32896; Location=324..568; Strand=+
  SCN-specific regions: Sequence locations=1-73,146-245
  Gene Ontology: Biological process=embryogenesis and morphogenesis
gtccgttccaccacaatcacgcagtccagcactgggcctccagggcctattggtcagcggaattggtaaaaacaaaaataataaaaagaaaaatcgtatttaattacttaaattttaaacaaaataaaaaaatgaaaatatttttgcgcccctcaggcactttgccgtcaccagtgatttggggatggttggtggacagtgcatgtttggtgtgggacaatgaatgtgagcttggctcgtgtcaa

SEQ ID NO: 63126 - DNA, 734 bp, Heterodera glycines
  Genomic contig location: Contig_ID=SeqID_32898; Location=72..805; Strand=-
  SCN-specific regions: Sequence locations=1-8,32-63,98-734
atgccgatagaggaaaaagaggaaaaggatgtctctcgaattgtcgtttgggtaagtttaagcaaaaaaaaaatatatatatatacaaaaaaaaaaacgccttaatttcaggattcggaaacatcgcaggattcgatttataagggggaccagaaggaacatattattaattatatttcggtgagagtgacgtgtacggaatgctgtgacgacaaaaataggacaaattgtaaaatttgcggggaggagaggaccaaggattggagcgaggcggagggacacgagccgacgaaggattttgtggaatggattttaatggcctttacgaattacgatacgtacatttttgcgcataacgccgggcgttttgacggtaatttcaaaatttaatttttttttaaccctaaaattttaggacattttgtatttaattatctctgccgtaccgggaagaacccgctaccgctcatcaatggactgaaaatttatgaattcaaagtgcgaaactcgaagaaacattcaatgctgatatggagagactcatgcttattaatgccggtgaaactcgagtcgatgaaggcgacattcaatttgggctgtgaggacaaggcctttttcccctattactacaacaagaaagaaaattatggaatacgtttggaacatctaccaccgatggaggattacgcaccaggatctatgaataaagagaaatacgctaaattcgaaaaatg

SEQ ID NO: 63127 - DNA, 2676 bp, Heterodera glycines
  Genomic contig location: Contig_ID=SeqID_6859; Location=680..3355; Strand=+
  SCN-specific regions: Sequence locations=1-290,312-657,679-904,949 -963,985-1373,1395-1441,1463-2206,2228-2392,2415-2446,2468-2676
atggaccgatttaaccgcgctaatcaccaaagccaaaatgcggaacaaaggcggctgaaaaaggaaaaagcggagagagcaatgcgtgacattgaactgtacgaagagctgcagaaattgaagaatgaaacgacagcaatcagcgagacagtcaaaaagaggaaaagccattcaatgtttttggtgagtgaatgccaaaaaagtaattttaaagaagggattgtctaatgcttttaaagtgacaaataagtgcgctaaaaataaaaaacacgaaaattgttaaatatggataaaaatgtttaatttggttaactttgacaaaagttatgacgattttttgtcgaaaagtgctaatttttgctgtctttttccaattttttatgccctttttgttatttcatacatttttatgcattttttcacttatttcatgcttttctgtgcttatttgaaagaattttcgtgcctaaaagtccggtccctattgtttaaatttttaatcactatgtctagaataatagtaaatgatatctcttaggattaaatctatctttttcaaaaaaaaatgaaaaatatcgcggtcacagcccccaatgacaattcatcaaataaattgcctatctttaaatttaatgattaatctcttagctatgccattttgcccatctttgtatgtatgtattatatgatcttccggtcttctctctcccatttgtacgctcatttcgttccgtttttatcatatttaccttgagcaaatttcacgggcattgggtccatgtcaaacactcaaatttaaatctcggaactgccaactgtgtcattagtggtgccatagtttgagtccggcctctgattgatattgctcatggcattttgcacatacgagtagatatataagaaagatttgcagaccatttttaaatttctccaattatttcttcattttcttaactctttgttttccatctcatccttccccatttctgttcatattggcaatcgaccatttttatgagatttttcgtcctcccgttttggcattttcataatacctttcagtcattcagcttcctcaatccgaacatggttgcacttttctgatcacacacactggctttgattacttttattgtaattatctttcccaaattcggttttcctacatttctgatcacatacattggcatttggttactttattgtaattagctgtccccaaattcggtttttccacctttctgatcacattagtctaaattgacaatctatcattttgtatggcaattgaatgtcctattgttttctcatttttatattaagtttcaattattcattgttttcaatccgaacatgcaacttttttgttagccaacattgacagaatttgatatccacgaaatttgacatgttctacatatctgatcagtgatcatgttgccaaaattgacatttaatcttttttaatgtaagttctttgtcccttccttcctattttggcattctcctaacatctttcaattcttcatcgtccgaaactcgattatgcaactcgaacacgatgcatattttctgatcacatgaccaaaattggcattcgatcactttatttgttttgccgttttcataatgctgttcaattattcatgttgctcattcctcacaccaaatttaccttaaagtttgtggcattcgatcatttaacggcatttctatgtcctcctgttttgcatcactttgaatgttacaaatctctgatcagaaagccgaactttggtactcgattattttggggcgccttttctgcatttctgtcattttactcttattgtccaatttgtagttccatttctatttaaaatttttgccacccaattttaacgcttcttcttcacccaatccgtcatccaaaactaattagtaaatttcacaatttttgtccagttaacttttgcaattgttctttttttcatttttttgacaaaataaggcataatatttcgctaactcttaacaaacaaaaaaattatgtcatcaaatactaccgcacccgaagaaaacccctctggggccgaaccctcgaaagaggaattgtcttataaatgttcttttcatcaagaaacaaaacaaaagatagaagccgagtctaatgagttgtttactgagctcgtagaaaaggtgtactaaaaaagtccatttttacatgttttaatcccccaaaaattttcaggatgcacaaactgtggaactcgaagcacaaaatgcagaacacatcaaaacgatcaacagacagaaattacaaatgaaagagaaagatgaagacattgcaaaagtgcgaaaacaaaacgaggagcaaacaaaaatggttggcacacttcaaacggagatcaaggaattgaaggccaaagtggagttgcgcgataccaatttggagataaaggaagagataatcaaaatacatgaacaaaaaattggcggaatggagaaggcaaatgttcaactggcagagacaaacaaaaaccttcatgaagaaattgccgtactcacggagaccaatcaaaatcaagaagaattaattgccggacagggagaaacaatcaaaaatcagcaagaaaaaatttccaaattggaagggatgctgatcaccaccggccatgtggagcagagcattggcat

SEQ ID NO: 63128 - DNA, 1879 bp, Heterodera glycines
  Genomic contig location: Contig_ID=SeqID_6860; Location=390..2268; Strand=+
  SCN-specific regions: Sequence locations=1-516,551-822,1076-1235,1265- 1359,1395-1403,1481-1501,1525-1661,1728-1819,1855-1855
gatgcacaaactgtggaactcgaagcacaaaatgcagaacacatcaaaatgatcaacagacagaaattacaaatgaaagagaaagatgaagacattgcaaaagtgcgaaaacaaaacgaggagcaagcaaaaatggttggcacacttcaaatggagatcaaggaattgaagtccaaagtggagttgcgcgataccaatttggagataaaggaagagataatcaaaatgcatgaacaaaaaattggcggaatggaggaggcaaatgttcaactggcagagacaaacaaaaaccttcatgaagaaattgccgtactcacggagaccaatcaaaatcaagaagaattaattgccggacagggagaaacaatcaaaaatcagcaagaaaaaatttccaaattggaggggatgctgatcaccaccggccatgtggagcagagcattggcatgtgagtgtaaattgtgccttttaaattgaaattagacaaatatttttttattagaataacatgcttttacaatttaaaattttgtttataatttaaaaaaattactccttttaccagaaacgatcatttttctttcaatggttaagttatagttagggtgccggtcttattttgtttgggttctctgaaatcctgatcataataaaatgtcaaaattttcaattaaatatgactataatttataggaatctgtcgcaaattcaaagtggacataaggtactgacattggcagacgaattggccgactgcgagcccaaagcggagttagataaggcggcaaaggacgacaagcaggaagaattggaattggagaaaaattggttggtttaattaattatggagttattaattaagcaattaattaatttaaatattagcttgattaatgaaatttaatttaaataaaaattatttggttggattaattgattgatttatttatggatattaattaatttaatcaatttaaattttttaataaaatttcaatttaaattcaatatggagatatttggttgattgattaattaatttatttatggagttattatttaaataattaatcaatttaaaatacggagtaattttaattatggaattacttttattgttaattttatctattaattatatagtgaaaaattttgtttcgggcttttagttgttttttagtttttcactttctcaaaagggattttttggtttttccgagccacgagtaaaaaaaggaataaaaaaaatttaaatattgaataaaagattcatcaaaatttatgtcaataattttgtagcaaattgccggcaccaacggaaagcgtagagggtaaccaattggagagcatccagagacagcaggagaaggatgaaggggggaagcaggagaaagggtaatttggctaaattaaatttattttacacaaatttatttttaattataaaaattaatgaaatttttttatgaaattttttttattgttccaaaaaggtgcattaataacaaaagataaatgaaaatattaaaattgtgatgttttaaccgtgaaaatattaaaattgtaatgttttaacaaatcaagatttagtacaacagatgaatgtggacaggaaaatcagcagcaggagaagggagagaaggacacggaagagagcaacaagtaaaaaataataaatattgaattaaaaataaaagaaaaattcattgaaattttttgtaaaatttttgctcattatttgtaagaaatttggcgacatcggaggacagtggcaatccgctcaaatcttccgaggaaaaccaaaaacagcagcagatggatgaaggagaagagaaggaagaggaggagtgcaaagagtaaaataaaattaatatttaatta

SEQ ID NO: 63129 - DNA, 161 bp, Heterodera glycines
  Genomic contig location: Contig_ID=SeqID_32905; Location=85..245; Strand=+
  SCN-specific regions: Sequence locations=1-79,113-114,136-161
atggctatctctatttttgagaaattttctatgcaacaaacgctttcgaacatgaaacgaagtgcggtgcgccatggccattttatttttcaaataatttttatatttaatagatattccagaaaaatgtattccagaaaaatggctatctctttttttga

SEQ ID NO: 63130 - DNA, 146 bp, Heterodera glycines; identical to SEQ ID NO: 56264
  Genomic contig location: Contig_ID=SeqID_32905; Location=352..497; Strand=+
  SCN-specific regions: Sequence locations=1-79,113-146

SEQ ID NO: 63131 - DNA, 161 bp, Heterodera glycines
  Genomic contig location: Contig_ID=SeqID_32905; Location=730..890; Strand=+
  SCN-specific regions: Sequence locations=1-79,113-114,136-161
atggctatctctatttttgagaaattttctatgcaacaaacgctttcgaacatgaaacgaagtgcggtgcgccatggccattttatttttcaaataatttttatatttaatagatattccagaaaaatgtattccagaaaaatggctatctctatttttga

SEQ ID NO: 63132 - DNA, 514 bp, Heterodera glycines
  Genomic contig location: Contig_ID=SeqID_32905; Location=951..1464; Strand=-
  SCN-specific regions: Sequence locations=1-143,166-514
atgctttttgggacggaccacgaaattcaattcgtttttgtatcaactgattttgcgggtataatgtatcgaaataaatgtaattctaagaataggaatgctttttaaactaattttcatatgtaaacttttttttgtaagttgtctcgtttttcctcttctttaatctgtgtggtaatcttttcattgtgaagctggcaattgttgtgttatatattagagtcggatcggtacgggatatcaccgggattttaccgggattccgatcacgtctcatttccaaaaaagtccgggtcagggatcttggttgaatagagatttgattaacggtagcgagatccatatttcagcaatatcgggatttcaaaaacattaatccaataacgacctgaccacggccctcgctcccgtgctcgatgtagaggggtcggaatggcatagaaaagatcagaaagggcgggattcccctttttttggacttttttttaaatataaacattattcgaaaaataaa

SEQ ID NO: 63133 - DNA, 56 bp, Heterodera glycines; identical to SEQ ID NO: 52733
  Genomic contig location: Contig_ID=SeqID_32908; Location=561..616; Strand=+
  SCN-specific regions: Sequence locations=1-56

SEQ ID NO: 63134 - DNA, 71 bp, Heterodera glycines
  Genomic contig location: Contig_ID=SeqID_32909; Location=616..686; Strand=+
  SCN-specific regions: Sequence locations=1-1,23-71
attaaaaatttttagatttttattcatctccctttttgatagtgaaagcatctgagtgcctataataactt

SEQ ID NO: 63135 - DNA, 1208 bp, Heterodera glycines
  Genomic contig location: Contig_ID=SeqID_6861; Location=1166..2373; Strand=+
  SCN-specific regions: Sequence locations=1-20,42-54,76-311,333 -347,394-1074,1096-1208
atgaaaatttgggctgaatggtcagatgaaaatatgccttcttcaatagtacagtgtttaataagtttttcgttagaggttaagaccaggtcaagcaacgaatttccccttgtaggtccattggttgtattaatatatgagaatttgttaaaaaaagtcacaaaatatttcaccgagattactcattgttatatttctttattaattagaacaccacaaccaccaccacgttttaatatttttgattttctatgtgtttaatcgaaattataattttctacaatccatgggtaaaaggagcattcctcctttgtccatgtctcagtcagtaacaagatatctatttgattatttattatatttaaaaatatttcgttaattttattattaattgatctgatgttaattagacacgctttaacttgcccccgggagactattgtgtggccggaattttcagaatttttaggtgaatttgtttataagcgatccgatttcaagtcagttttccttatcagtgtcaatcaattgctgccgaaaactgtggacttcttctggaggatcacagcacccgcataaactatccattcttttccatccttctgtcgtttttcgacgcattgtaaatacagacgacgacgttcctccagctggaccttggtcagcgattcacggacccgaacattctgcagagagattggaacttcgaacagcggcggacttcttttgtcatgccaccaaagccagcttctggaaggcacgggacgacaaaagaactttcagcggtcgcggacttttttgggctgggtgataaggacggcccatccgataacaaatggtgccgcattcgacccccagcgagtcaaatataccgttaactgcggcacggtccatttcagccctctttgagggtgagttgtcggcctgttctgggaggcctatgacaacgacgcttcgctgtctctctaattcctctgctgagattggcagattagcacaagaagtgggagcggcggtgcggagctgagaaattgattgagtcagcaggtcaaattgggtggacagccaaagtggtgatttttactaaataccaagtccgctcatcacacattctctgagatggaattgtccgggttttgctgttcgttttcggttgcagttggcatttggtttcgttgtccagttttgtttaatttagcttaatcaga

SEQ ID NO: 63136 - DNA, 411 bp, Heterodera glycines
  Genomic contig location: Contig_ID=SeqID_6861; Location=3135..3545; Strand=-
  SCN-specific regions: Sequence locations=1-104,146-363,385-411
atgtacacagcagtggacaatttaaatatcgcagcaaacatcaaaaatgaacgtaattgatgataataattgccgggaaaagagataattaattaatataggagaaaaatttgttaattttcaaaattattttaataattaaaatcttactcattaatattcaattctatttcagctgacaagaaaaataagaggaacaggcgtaagaagcggttcgttgatctggcatctcttggcttcttagcttttcttatcgtattttctcttatcatatggtacatttctgggaaaattggcacatggctggccaaccaagactttgtccctaattggctggtcgtgtcaatttgccggtttcttgggccagaaatgcaatgactaactttcaacagaaaagaagtatgaaataaa

SEQ ID NO: 63137 - DNA, 540 bp, Heterodera glycines
  Genomic contig location: Contig_ID=SeqID_6862; Location=25..564; Strand=-
  SCN-specific regions: Sequence locations=1-118,140-188,221-540
atgaaatctattcttttctgccgcttttctctgatcgcttttgcttttccgctttttctcttcccaaaagaatgcttttcaatggatggacagaaaatgatggcacaaatggcggaggacatgaaaaatgaggtgaaaatgggagaatgggggaataatataattggaaacctgatacataagcattctttaataatttacatttaaataatttttttttgatttatgcatccgtaagtatttggttgtgcttttttagtcgctataaatcctttttacatgaatataaccatcagcagaattcatttaaaaaaactgatgactatgaagcggatttttagggttgaaaaattccaattaggggcctaaatgggggcaaaaaatggcgaaatagggacccaaaatggtaaaaattggtaagaaatttttctaaaatgccgaaataggtgcaaaaaagggtcgaatgctaaaatccgctccctactgatgacagtgcctataacctaaaatggagcaattttaaacgctaaattgattaaa

SEQ ID NO: 63138 - DNA, 2326 bp, Heterodera glycines
  misc_feature (418)..(418): n is a, c, g, or t
  Genomic contig location: Contig_ID=SeqID_6862; Location=929..3254; Strand=+
  SCN-specific regions: Sequence locations=1-5,32-318,429-467,489 -567,590-624,646-759,781-873,903-966,1001-1160,1190-1245,1283 -1286,1308-1739,1800-1817,1839-1898,1981-2004,2027-2095,2191-2326
  Gene Ontology: Mol. function=permease activity; Cellular component =cytoplasm; Biological process=acrosome formation
atgggagttttttattttatgttattttctttggtgttattgaacggaatacaggtaaagattccgatctcatttaccaaattcgatttccagacatttttgttggccaatatactgatcaccgattcctgaaatattcaaagggcttagaaaaccaatttcaaagtgccgatcttaattcagatccttatttttgaacattgacttaaaacccaaacgttgaaaaaaaatttgagacgatttttacaattttttgatatttatcaacaccgccttaattcatatttaaattatacaaataatagccatacaaataacaataaaattgattattttattttgtctttaaaaatatttaaaatttgacaaagaataaaaaaagataataaaatatttatttttttcttcattattttanaattatttaagaacacacatttgttcgcaaaccattcgatttggctaaaatttattttaaacattatgtactcaaaacaatttacaaagtacttttatattaaatgttaaatgaatataaaagtattagaattcatcctttttactatttttattaaattaaattgtcattgactttcatttattcgttcttaaataatctttgcgttttaaaaccattaattaaaactttcgcccatcaattctttccccattagcaaaatgattttatttttttttttttgcctgtttttcacttttctccgcgctttccgcccaagaacataatattgatcaatcaaatttttattaaaattactaatgcacactaatccattcgcttcgtcagcaggtgcaaaacgggcggcctatgaaaacgcgccgtttttatttccccatttttaacttccaaaaacctttttttaaattataataaataaataaatgtttattcgaatgctatttaaaaaatgctgtattgattttttaaggctcaaaaaatgaaatgacataaaatttaataaataaaaataattttatttttcttatcgtctttcattgtgctatttatttgtgcaacaaattatatcaattatctaccgaaatttttgtgaaatttgtctgtgtgtttaatggacaaaactgctaataaccagggaagtgttattttaatgatttattatctctaattaatttcccatgcgaaatttttcttaaaaataaaataattattccaataagataaattttggttccaacaattgaaattaataaaagcgactgatcataatattttaaaaatatgttatttttctgtattaatgaacaaattctcaaattcttttaaaaaatgttactgccttttttaattatctttaagcctatttctgacacaatttttcgcttttatttggtccaatttccgtggctaaacaatttaacacttttaaattagcctaatttcagtacagtcaaattgtcccaaattaccattttaattgccaaataatggcttacccaataattaccctttcagaacccctcttaccgatgctttctccaaaaagtgacttggatttgcacactcggcggccttctgttcggctacgacacaggcgtgatcaacggcgcgttgccgttcatgcgcgacgagttggagctgaccgatctgaccattgggctggtgaccagctcgttgctgatcggtgccgcagttggcgcttttgtgtgcggtaaattgtctgatcgacttggccgaaagcgaacactgattattttgagcgtatttttttcattttaaatatttaagtatgtattactagtattaatataataatttatttgaaatgattaatcaacttaactaattaacaatattaatttaggtcatttttataattggcacaattggctcttctttaatgccaaaagtttgggtattctttttaaatatttatgttcaatattttttattattttaatttaattaaatgaatttaatcaaaataaaataattgaaaatatcgaaaaaatatttcttttagtctatccttccctttcgctttcttcttggctttgctgtaggcggtgcttctgccattgttccggtaagaatattaaattaactctattaaaactctattaattaatattattatgtaattaatctttttctattcctcaatttttattaaattaactattaattaatttacaaatatttttctatttttaggtttatttggccgaagtgtcgccggcgaagcggcgtggtcagctggtgacacgaaatgagctgatgattgtgactggacaactgttggcttatgtgatcaacgccattctgggcaacatttggagtgatcagtaa

SEQ ID NO: 63139 - DNA, 364 bp, Heterodera glycines
  Genomic contig location: Contig_ID=SeqID_32912; Location=6..369; Strand=+
  SCN-specific regions: Sequence locations=1-260,282-364
agtcagccgtggtctcgccagcatcaccttctgtgagagggaaatcggcattgaggaatcggctgtcattgattgtgcacactacatgcgcgaagtttgtgccagcttcattctgctccaacagcaacaccaaatcggcgggaacaacatgaccgtcgagatcgacgaagcgctgttcaccaacaaaaataatgttggccgtgtgctgccggagcagtgggtcttcggagcagggctgggcgaagctcggcttagcactcgaagccgaagccgaaggcgaagcccaatttttattcgaagccgaagtccgaagctcgaagcccaaaaacccgaagttttcgaaggtttcgaagccgaagccgaa

SEQ ID NO: 63140 - DNA, 104 bp, Heterodera glycines
  Genomic contig location: Contig_ID=SeqID_32914; Location=371..474; Strand=-
  SCN-specific regions: Sequence locations=1-104
gtcagtctaatccaggaacaatttgtgaaggctttgcaaatccatttgagccaatgcgaacatgggccccgactttccgagattctcacatggcatgtgtttga

SEQ ID NO: 63141 - DNA, 894 bp, Heterodera glycines
  Genomic contig location: Contig_ID=SeqID_32916; Location=33..926; Strand=-
  SCN-specific regions: Sequence locations=1-244,266-573,645-894
  Gene Ontology: Biological process=protein folding
atggagccgaatgatgggattactgatcagccaactgatcaagatgggagtgatacagaagcaaccgattcgacgacagttggatcggatccaggaccaaatgacaatgatcagaatgccactgggccaactgatgaagatgaaacaggaacggaagcaaccgattcgacgacaacaacaactgaatcaaatgcaatagatgaagaaggtactgatcagaatgctacaaactcatctgatcagggagaaagtgatgcagaagcagaagcaaccgattcgacaacaaatggatcggatctggaaccaaatgatcaggatgaaaatggtgcggatgctgattcgacgacaacaaacggaatttgatcaaaatttactgaaacaaaactggcaatgatcagttgaattttttgatttgcagcgtggttgatcaattaatgacgaatgtcaatatcattttgatattgcaattaaaaccgatgtagttcatttgcgatacaattttttttcatgtgtacaacgaaacgtgaaaaaagtctattgggcttttttatatcatcaaaaaagaaaaaatgcaaaataatacaaaattattttaaaaaattaataattaaacgatccaaaattattattatttatttaattttgaaagttatcgcctcggttgtgattaaatttaattacagcaattaatttatttgaatatgggtgaaggacgacgctaataaggcaccaaaaacaattaaataattgagggacgacgctaataaggcaccaaaaaaaattaattaattgaaggacgacgctaataaggcaccaacaaaatgacaattaattaattgattgtgtatgcaaaacaagttgagtgagtgtcatgaaaaaattgacaacaataaa

SEQ ID NO: 63142 - DNA, 779 bp, Heterodera glycines
  Genomic contig location: Contig_ID=SeqID_32917; Location=91..869; Strand=-
  SCN-specific regions: Sequence locations=1-136,158-194,233-280,322-779
atggcaacagtcccgagggagaagaagagtcgaattgcggaggcagtgtgtgttcccttttttgattacccttaaatggtctgttaattttataggcttcgccttcgtctcttcgcgactgtcattctcgagcatcgaccaacgaacacaccaacatttctcatcactctcttcacgatgacaatgcaccaccgtatttttgtttttaaataacaaattttatattttaattggaatgtcttttataaactaataagtcaatttattttctcataatttaaatttattaaatgttttcatttaagttctccctccttggccaatatctcaacaaacattgaactccatccacacaacaatgcgcttggaggttcctcctctcataaattcatcaaaaggccattgaatgcttatatgatatggacaagacaggaaaggaagcgaattttaacggacgatcccaaaatgaaggtgagtggacgggcgaattaagaaaaaaaagaattgatcaatttgttagatgaacgaagtgagcaaagctgtgagtttttttatttgtttctctatttatcaatttgtattcgtgatgtgttgtgctgacatattgaccattacattgttagattcagatgggcgaaaaatggaagaaaatgtcggacaaggaaaaggtgacctttcccaaatttctcaaaaacgattgttttcagaaaccttacttcgaaatggcaaaaaaattctctgaagaacacaaattggtgagtaacacagatcaaaataaa

SEQ ID NO: 63143 - DNA, 762 bp, Heterodera glycines
  misc_feature (690)..(690): n is a, c, g, or t
  Genomic contig location: Contig_ID=SeqID_32918; Location=104..865; Strand=+
  SCN-specific regions: Sequence locations=1-61,99-295,346-415,447 -586,617-762
atggttcttcagccaatcgaggcagttccaatctatcgaggtatttatgattattactttctatttaaatttgttttatttttgttgattaattgatagttcatttaattctgtttcatttcacctttaggttagtgggaaagctgcttcagtgcccgaaaatgaggaggagacggggatcgaagtgcgtgagactttgcctctcccggcatttgtcggtgttcgttgggtccccgattcggattgtgaccaatgtacatcttgttcgaggtaataattaattttctttttgtgcaatattttaattttatttttgtacatatttatttgaatttgaataattttgtatttcagtccgttcactttggtcagacgtcggcatcactgcagaaactgtggtcgaatattttggtgcaataaaaaatatatttgtaaatttatttattgccctttttcagcggtcaatgttccactaatgcaatcgctattcctgagcttggttatgacagaagggttcgttttgccccccccccaattgacacactattttaaaatgaagggattttatgggagtgttatgaaaattcatttttaaccatttttctttcttaccttattaggttcgagtttgcgatttatgctatgaaaatcggttgcgacaataccattccgagtccggcgatcaagaanatggttcgttttggagaggatggcgaaactgcaaatgctttggctgacaacggtccgacgactgcaggtccg

SEQ ID NO: 63144 - DNA, 354 bp, Heterodera glycines
  Genomic contig location: Contig_ID=SeqID_32919; Location=227..580; Strand=+
  SCN-specific regions: Sequence locations=22-180,202-354
atgaaaattaaggaggccatggagacaattggcacggacgtaaaagtcgaaaacggtacgttttcacatcccgaattatgatgaaaattaaaggggaataggcatttgttaaaagcccaaatagttacagcgcatgaagaggcttcctccgctcgtggtaaggacatgcagaacatttacgaggccgagaagaagcagaagcgtgaggaggagccaagcgaaggggggcgggaggagggcgcaccggcgaggccccctaacagcggggaagggggcagaacgacgaagaaaggcggacgaaagggcaaaagactgaccgacttggacattggcaatgcgtccgagtcggacacg

SEQ ID NO: 63145 - DNA, 252 bp, Heterodera glycines
  misc_feature (57)..(57): n is a, c, g, or t
  misc_feature (60)..(60): n is a, c, g, or t
  Genomic contig location: Contig_ID=SeqID_32919; Location=501..752; Strand=-
  SCN-specific regions: Sequence locations=1-85,107-252
aaaatgttttggtacttttttgtggctctttgccaaatcacctcgcagatcgccttncgnagggaagatactcgtcctccgatggttctgggtcctcttcattttcatctgcactgctcgccttccattcgtcctaattttctatgtctccggaatggcatttctcactaaccgtgtccgactcggacgcattgccaatgtccaagtcggtcagtcttttgccctttcgtccgcctttcttcgtcgttctgc

SEQ ID NO: 63146 - DNA, 696 bp, Heterodera glycines
  Genomic contig location: Contig_ID=SeqID_876; Location=83..778; Strand=+
  SCN-specific regions: Sequence locations=1-580,602-696
atggcaagcctaatccaaaagggcatcacattcacactcaaggcgctggatagtgccagaacgaccacggcactttcactacatccagacgccgacctctcaaactgggaatacgcagtcaaattggagactcaatgcactcgcgtgaacagagaagtccaaacaatggaagcacaactggacaatctgcgcaacctctccaacaattggattgacctgctaaaccgcctcgaaggagcagaaaaagacaaaggcgaaaaggaatacgtgaaattcgacacgcatgagaaaattgccgaacgccatgacgcggctacaaccaaactccgggatctgggggatctcgaagcaatgctcagtgccgatgccaaactgtaccgaggcagagcagaaagagaagcaagagcagatcaacaggcaaatccgccaccacaagcagcaacgccacctatggcagcaccgacattcacggcaccgctctatcaattccagccaatccagctggacaaattcttcggccaaaagcgaaaatggcccgaattctacgagtctttcaaatcagccatcggcagccaaacaatcagcaaagcacagaagctgaacttgctccgcaatcttctgggcggagaagcacgggaactcattgctgggttccgccttgaggaccaaactacgagacggtcctccagctgctga

SEQ ID NO: 63147 - DNA, 5816 bp, Heterodera glycines
  Genomic contig location: Contig_ID=SeqID_876; Location=952..6767; Strand=+
  SCN-specific regions: Sequence locations=1-7,32-604,627-1475,1499 -2428,2450-2924,2948-3424,3446-4356,4378-4630,4654-5096,5118 -5239,5264-5816
atgttggagaaaaagctgactccagcattcctacgcaacatcctcaacaaaaagggagaggatccggcaaattggacaacaacaaaattccgggacgttcttaacgaagcagttcgcaaggaagttcaaattcaagaggtgatgggtgagtacggacaccaccatcagccactcaatcggccagcaaggccgcaagcacaagcacatcaggttcagcgagcacgcatgccgacagcaaatttccggaacagaaatgcatctcccgccaatcgggaacgcactttcatgtcctcaacaattgaggaggttcagcaacgaatgaaccacagaccgcaactgcgaaagtcccaacagaggggatcaaggccaactcaagcgccttacaacgtgccaatccggaatggcacagcacaagcagggtcaaggaatccgccttcaccctgcatcttctgcaatggcactcactggaatgagaaatgccagaaactcagtaccgttcagcaacggtcagcctttgttcgagaaaagggcttatgctttaagtgcatgaaaacaaatcatcgggcaaacgaatgcccccgaccagcaaaatgctacaaatgcaaacggtcacacccaccagcactttgtcctgaaggtaacaactcaatgacacaacatgccgccgccgtcgttacagaacgaccccaaggcgaaagtgaatccacgaatcagacagcacaactgtgcaacgccatccaaagcaaggacacccgagcgctgttaatgacagcgaaggccacgatttacaatccggcacagccatgcctcagcatgatggcaacagtgttcatagacccgggaagccaccggtcattcgtctcatgcaacacagccaagcagttggaactgaccaaccttggaacggaagaatgcttcctcacaagctttggcgagcgagagccaaagagatacgtaagcgaccgcgtcgctattggctttttgtgtcccgacggggaccgattcatcttcaacctgaacgcactgaagttcttgttgaacaatttgccagtcttacaactcaatgaaatggacaacatgcagcttcaacagaagaagctttacataccacatgagtcaagacagcctgacgtcatgctgggtatggacgtgtggcacgaactgcaagtgcaacccgtcgaacgactgccaagcggcttcacgatttgtcaatcgaaaattggcaaaatcatcagcggatccgggcgcattgaactcagtcaaccgtccaacgtcacattcgtcgtcacagtgacggacgaaaatgtcttcaccacagaggaagacttgaaagccgacgatgaactcaacaagttctacggcttgaacatcatcggcatggacgattcatcaccaccgattgaccacgacgaagtcatgaaaaacttcaaacggaatttgtcgttcgtcaacgaccggtaccaaatcgcattgccgtggaatgacaaagtgacacagttgccaacgaattatcatcaggcgaaagcaaggctaataagcctcgtccgaaaactgcggacaatcaacttggtcgacgagtaccaagttattttggatgaacaactgcagaatggcatcattgaaagggctaacccagaccattcttgtggaccagtgcattatctgccacacagggcggtaattcgcacggacagagccacaacgaagattcggatcgtgatggatgcctcagcaaagcccaaatccactccatcggcaccatcactcaacgaatgcctgcacacgggtccgttactgctcaaggacttgacaggcattctgctccgcttccgtcaaatggaaaaagtcgtactggccgacattgaaaaagcattcctacaagtgggagtacgagagcaagacagagacgctacacgattcctttggttggcaaatccaaaggaggcaaacctcgaccaactcagaaaagaggacatccacattctccggttctgccgagttagcttcggcttgaccgtgtcgccatttcttctaaatgccacaatacgtgaacacatggcactctacgacacagatgtggcacaacggataagcaacaacctgtacgtggacaacatcatgatggaagtgaagccgggcgaaaacatccgagaaattgccacagaggcaaaaaacatttttgagtctgccgggatgcgaatccgtgaattctacgggagccacatcgaagagctaaaagagctcgactcctcagacttggccaacgaattggaagacactaaggtgttgggcatcaagtggaagccaaaatacgaccaactcgttttctccatgccacacttcgacagcccaatcaccaagcgaaacattctttcgcacattgccaaagtatatgacccactgggactcatttcaccggcacttctgccagcaaaacacttccttcaaatcgtccaaaacgcaaattacaaatgggacgacccgttggcagaggatttgaaattgatgtggctaaaactgatgcgtgcgtgggacggatttggattcaactcactcgtcgaattcccacgccacatcatcgctgggataagcgaagagttccattgcttttgtgatgcgagcaaatctggtctgggtatcgcgttgtaccaggtcgcagaaacgcattacaacaaaagggaaagcaatttgatcttcggcaaaagccacgtcaagccactcaaggtcgcggaccacgattcgaccatacccaaattggaactccaggcgctcactttgggagtcaaggctaccaagttcgtccaaacacagctcaactttgccgacagccaagtcattttgtggacggacagccaatgctcgattgagcggttgaaggaaaaccgcacccacgacagattcgtagtcaatcggctaaagaagataagagaggcaaacttcaaagtccgacacatccgaacagctgagaatccagcagacatcgcctcacgcggcacagacccgcaaagcctccaagcatcattgctttggcgatatgggccagcctggctcaccaagacacacaaatggccagaaacgaacgtcacttacactcccggagaagagacacgggaagagactgagccaccgatcgtcgagtggagtgcaacactccaagaagagcagaaattcagcccgtcaatccaatttgaaagattttcgaattggaaccggctcaaggcggcagccgcctatgccattcgtttcgctttggcacttcttcaaaaaagaaatgtcgttccggcgatcgattcacttctgtatcagcaagaaagacaagcggggctgctaacagcaaaggaattggaaaatgccgaaacatggattttgttggaaacccaacgtcttcactcgcccacagaaacagccacaaacaatttaaaattgtccagctcgagctccattgagccactgagatgccaggggcgattggaaaacgccgatctgccctacgaaagcaagcacccgacctttttaccaacagaagcctggaccaccaagctcatcgttatccactacgatcgggcgctgaaacactgcggcccacggacgcttctctcaaaactccgagaaaagtattggataccaaaaggccgacagacagtccaacacatcctcaactccaacaaattcggatgtttgaagtgcagacgggagagactcaagccatatgcttatccggacgctcctgacctgccaaaggagcgagtcacggaaacacgacccttcaatcataccggagttgactacttcggaccgctgaaagtcaagcaaggaaacacgactgtgaaagtgtatgtggcacttttcacatgcctcgtcatcagagcgattcatctcgaggtagccgaggactactcagctgaagcatttctgagagccttccggcgatttgctgcacggcgcggcattccaagtttgatgatgtccgaccaagggacaaatttcaccgccggcgccaaaacgatccaagaaaattggacaacgcaattgttcccaaatgaaatccgtggacaattggcacaccaaggagtcacatggctcttcaacacggcacacgcaccttggcgaggtggtgcctgggaacgacttgttggcataacaaaaaatgccttacgacgaagcatcggtcgaaatctcctcacgtgggaggaattctgcacactcaccgttgagattgaaacgatcgtcaattatcggccattgacattcgagtcggatcgtgaaccgagccccgtcattcgaccaatcgattttctgattccgtactggtctgcggaaacgaatttcccagtgattgacgtggatccagaggatcctgagtacacaccaactccaaacaaactgacggaaatgctgcataaaacggacaaaagactcacccgtttttgggatctgtggagatcagaatatctcctatcgctgcgcgaacggccaagtctaaaccaaaaccacggagcacacatgccccaagaaggggatgtggtgttggtcgaggaggatggcactcctcgatccgtctggacaatggccagaattcttaagcttcagaggggacgagacggggaaactcgttccgccctcattttgcttaatggaaaggaaaaatggagggcaacgaaccaacttttcccaatggaagttcaatccgaaattccagaaacccagctcatcgcattcatcatggacgtcgacatggattcagtctcactgcccggaagcgaagacgaagcttcagagcgatcggcacccaactttaaaattccaaagaagcgccgcgccttcttgcgaccgatcggtcaacagcatagccctttgcaagggcctcgtcgaaaaaagatggaacttggcgactccggactacgcaagctctttgccgcaataagcgaagagcaaggcggcagcaaggcgacgacaaatgcgataacggagagccgacagatggaaaaggccccggagcgcgtcagaaaggagcacgacaaggaaatggccagaagacaaagagaaaaggtccaacgaataccaacggaggaaatcaggcagaaattggccgccctcccacacatcacagtttcttcggagaatgccgaaacacagagaaaggagcgaaaggaaaacgaagtgcgtcgcaaaaacaatcagcagtccacaagcgaaggatggaagcaactcgccaagcaactggattatgacttgaaggatcagcccgatgaaccagccctggaacggcgaaaagctaccgaagaacagtcggtaaaaggaagagaagtcgaacggcgtcaaattgcacggaaaaaaggcatcgtgcaaatgaagaagcgcgcaaaaccgctgaagtttcccaccgaagatgaaaccttgctgagctacgtaaagcggttttacgacaaggataattgggttctctcttggaaaagccgacgtattctggacgaacttcatgacttggagaacgaaggacgttggttcttataccacgcagcaaatggcgctcaactcactatctcaagaacgttcgatggaacacgaccatttgcagaatttcgatatgtggaagaaggacacctcgtggatctgactccaaaccaagtcatcttccgccaaacggttccagatgagcccgaagagagtccagcgagcaataataaaaagttggaagagaaggcagaaaaaccggcacgcaacgacaaacgaacaactctggccactcggaaggtggaggagtattgcacggcagagatgaagcagaacagctactgctatgacatatttgaacc

SEQ ID NO: 63148 - DNA, 3407 bp, Heterodera glycines
  Genomic contig location: Contig_ID=SeqID_877; Location=589..3995; Strand=+
  SCN-specific regions: Sequence locations=1-96,119-897,924-1369,1392 -2454,2476-3407
atgtcaccagggcaagaatgcagaccacgacagagccaacaacacgcaccaggccggtcaaatcgtcaaaacgagacctcgggatcaaccgagatggccatgacattttctggtgttcggatcgcggaagcacgacccggcaacgaagtatcaagaatgcatgaagaactgatcaagcccaccacggaattggaagaagtggctaaacttttccacgacgaacaaatcgtgaaaaacaaacgcggactcgggaaggatcaacaagtgatgaaagtcatcgaaatctggagaaattcatgcgatcgcttcggagagcttttcaccaagccagcgatgcagcagatcaaattccggccaatcctgattgaacacaatggccagtataaccaatggatcaaccgccaaaacacgcgaatggcggaattattttccaaaatgcgaacgaaggctcagcatccgacctacttgagctacaactgcacaacggtgatcgtcggcgataacgtagcggaacttttcaccccactatttgatgatgccaaatggttcacgcatttcccagcggacacatgccgattgatacctgggccaaacgtcaaacatatcatcatgggatatcaagccacggacgagaacatggcggcgcagttggcaccgatgatccacaaattggcaaggacagaaatccaaacgactttgatcattggcaaggaggacaacgccaaatggatcatgaacaagaagcacctctttgatgtttgccgccagttgaaggcaggattcatcgtgttcaatcgtgagatgggagaagcccgaaaaatctctgatcggataaggcaacgaatggaagaaccaatggaaattgacaacgaaatagtgccgtccacctcgagtgttgtttcgagcagccaggcatccagagctaccatggcttcaagcagtgtcatcacactgatgttgctcagtcttctaggccttcttcttgtgccatcagtttccgcagctccactgcgaatacaccgagcaagtctgtcactaacagcacaaaattatttgaaagcaatgcataactactataacacgctcacgacgacaaattcaactgataccacgacagccacaagtttgccatggacaagcacaacttcaaattggccaatttcgactttgccgacactcacaacgacgatggtcacacgcacagctccaccagggaccacgacgacgactcagcgaacaacccttgcaacgagagcaaggacacggatccagtatgtcaccagggcaagaatgcagaccacgacagagccaacaacacgcaccaggccggtcaaatcgtcaaaacgagacctcgggatcaaccgagatggccatgacattttctggtgttcggatcgcggaagcacgatttgggaactcaagggcacggaaaattcacctttttgccgccccccgccatcactcactgctcaatggcacaacctggcaattgagctcttcgtaaaagtcatcaagcccgaacagatcacctttgcatggcattgttctgtaaagcgcactacggagcgctattacactaatcttttggccgataagttcgtcaccatcgagaaggagtttccaccggtcaacaagcggatctgcaaacaaatggccattcaccaggaatacccattcgccaaatctgaaatgacgaaccacgaaggacagctgtggtcgacgaacgacgagatggaagtcaacttccccggaccaatcgccggactgttcaaaggggaacaaatcagcacggcaaccaattgctttactcaaccagcaacactgttcgtcaaacggcacaacttacagatgttctcgccggtccaccatgttcaaaactgccaatacgccaccgaattctgccaactgcccgacaacacgactctcatttggaaatcaacctgcaatggcaatgaatgccaaacgtgtgactatgagaaagcggaaatcatcaacggcaaattcactgcggcctacggcgaatcaatggcaacttggatctccgaagatcaccaaaaggcattaacgttcgtcaaaaatgcgccagaattcatcgcctgtgatggcacacggatcgtcatgtccgaacagaatttcggaatcgccaaggatcagtacgaagacatcgtaagcacaacaacgagatggaaaagagggatccgaccagagcagctcgcatcacaactctcggcatcacaggtggcaacaagcgttgcgttgaatcagctctacacgcgggagtgccagcgaaacacgagagcagccaacccaactctccaagccagacgcttactacgacagcctaacgtccaggcgcgctggatcggagaaatgacaatggaagtgtttccatgcgtcaacgtttcgctccaggacatctcctaccgaccaatgaacgattgccgtgtctacattccagtgacagtgcatttccccgaccgagcgatagcagcattcctggaccccgaattacgcatcatttctttgacggcgcaatttgcaagctgcaacaatcaccgtttccatcatcttcaactgcgaagcaatccgaacatttggctactgatcgactcacgaaccgggattgcacgtcaaatgccaaaggactatacgcatgagctgtacgaaacgacactcaaccagtccaacagcaacatcgagcttcatcctctgatcttccacgcttggcagctggacaacgaatcagatgcgacacgttttccgcacattaacgagttcatcaacttggagcagttcaaggaaaagttggaacaacacatcacggcgagaaccgaggcgttaggtgccctaaaaggtggcatcgaaggactgaccatgcgctggctaaaaagcatgatcgacgaagtcatcacgtggtggattcgaatcgcctgtgtctactcaaccttcttgttcctgcgtgacattgtccttccatgcacactcgcctacttgttcaaccctgttcgggtcacatttttcagcttaatgggagttcgacgtcagccgcttcaaccaatgctcggcaaaacgctacgacaggaggaagtgccgcttcgagaagttctccgatcacctcagccacgcacttcaccgcaccgttctctgtcacccgtccacctggacgtgatcgctcgcagtgcccgttaccaacaaactcgagcgcaaagcgatgcaaatctggcagaagtcgacaccccgttcggacgacgaacgcgacgaagagaggagcactgaggaccacgaggatcaaggaacagacgagcccaccgagaaggaacagattagcccccacgagaacgaatgatggatgaacccatgcctcgggaatgtcgaaattttcgtaaaatcaaaatttgattttagca

SEQ ID NO: 63149 - DNA, 682 bp, Heterodera glycines
  Genomic contig location: Contig_ID=SeqID_32923; Location=554..1235; Strand=-
  SCN-specific regions: Sequence locations=1-14,43-58,84-615,659-682
atgaacatggtggcacatcagcagcagcaacaacaacagtttgtgcagcagcaatcaaaacaacaacaacagcaacaacaacaggtggccgttcgggtttgggttatacagacttacaagtcgatcattggtttgtgttatcagatttacaatccgatcatcccccatgtaaggttttagcctaatttatataagggatcatttttgattatagctttaggaccggatcatttttgtgcaagttcattcatatatttaaggtctcatagccttatagccaaggaggaaaagctttcaaaattattaatcacagagtattgttaattttttcaggagctaatggaaatcgattcattccaacatcaagccgggggctatctggtggacccgctgttccaggtgaggcgctaatagttttattatttgaatataaccctaaaaaaaattcctattacatataatctgagtgttgcctaattttgattacagtattggttttgtggagttttagtaatcgtataccattcccaattttaggagctgtccactggtgatttgaatccgcatgagtttgacaaatatttgatcatcaacgacacggcgagggctgcagctcaacagcagcagcatcaccagcaacaacaacatcaacaaaacatggcgcaataaaacaaaaaataaa

SEQ ID NO: 63150 - DNA, 426 bp, Heterodera glycines
  Genomic contig location: Contig_ID=SeqID_32924; Location=33..458; Strand=+
  SCN-specific regions: Sequence locations=1-157,179-426
atgtgtcaagaattagcagaagaggccaaacaatcaatcgaaatagccaaaaattatcggcaagaaattgggcatatttatcggaccgcttactcgcagcccgatttaggcattggagacttggcaaataaactaaaagaaacaatgcgcgaaaaccaaatacggtttgaaaagcaaagacctcaggaagaatttagggatgaatttattgcttataaaatttaagaaaaaaaattcgagaaaatgaaactgcatgggaatcaaaggttgtgggacataaaccaaaaacaggtaaaaagggaaacaggtgaaaataggtgaaaaggaaacaggtgaaaacaggtgaaaataggtgaaatttcacctaaaaatatataggggcgtgtatttaatggggcatattagataatgtctcaactagtatca

SEQ ID NO: 63151 - DNA, 850 bp, Heterodera glycines
  Genomic contig location: Contig_ID=SeqID_32925; Location=56..905; Strand=-
  SCN-specific regions: Sequence locations=1-243,282-314,336-603,647 -701,732-809,831-850
atgtcagccccgcaagtgttagccccgcaaatgtcagccccgcatatgtcagcgccgccaatgtcagcgccgcaaatgtcagcgccgcatatgtcagcgccgcaaatgtcagcgccgcgaatgtcagcgccgcaaatgtcagcgccgcaaatgtcagcgccgcaaatgtcagcgccgcatatgtcggccaatcttgaattgcaaattgaacctttttattctcttctttttgttacctacatttctctctctctcgctgtctctctctctgcctctctctccacggtttccgtgaataatttacactgtataaaattgaaaatttcagaattacataattgtttcattaaacaaaatctgctaagaaatcggggcaaaagtttcaaaaattcgtcggcggcgcctaacggcaccgccggcccttttccctatttctaaagtcacggcaaactcttaatatttcagttaatttagaaaattaatagttttaggtccaacggtgctgacatgtgccgccggatgaaaattcgaaaaatttgattcatttccgaaaatgaccgacttacggacagatagaagcgaagattcccggacgattaatccaattatttaaaattttaacaaacaattaaaatatttttttaatccagctcaatttaatattcatgtaaacaatttccggctaataccatcagaaaccgaaaaaattataaatatttattttattttatcgattctctcaggaaattaatcatttgaatgaagctgggttgacgcataatgggaaattgaaagcctcatatcgattatggatgaatttcatcatcatttatttggcaactataataaa

SEQ ID NO: 63152 - DNA, 328 bp, Heterodera glycines
  Genomic contig location: Contig_ID=SeqID_32928; Location=129..456; Strand=+
  SCN-specific regions: Sequence locations=1-262,285-328
ccgggactcaaatgtcccgctcaggccaaaatttttttctatttccgggaaaaaatcgaaatttttccgaaaaaaataccagtcgatagagctcgaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatctggaaaaatcgagctcaccgagctctacaataagtctgctggccaccctgcgctcaggtcaaagcctaatgagttattcaacggggactgaactgggcaaa

SEQ ID NO: 63153 - DNA, 370 bp, Heterodera glycines
  Genomic contig location: Contig_ID=SeqID_32930; Location=347..716; Strand=+
  SCN-specific regions: Sequence locations=1-370
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaattagttttcggtgctctaattaaccgcgataaaaacatccgaatcaattaaatagcttctgagataataaggtttatcataaaatttcatttaaaa

SEQ ID NO: 63154 - DNA, 96 bp, Heterodera glycines
  Genomic contig location: Contig_ID=SeqID_32931; Location=29..124; Strand=+
  SCN-specific regions: Sequence locations=1-96
atgggggaagcaaaaatccaacgcagacattcaagtacaggctatagggaagctattcccgaaggattcggtctccccataaatctgggcgcatcg

SEQ ID NO: 63155 - DNA, 365 bp, Heterodera glycines
  Genomic contig location: Contig_ID=SeqID_6866; Location=1301..1665; Strand=-
  SCN-specific regions: Sequence locations=1-365
atgtcagttcggcagagaaattgccccttttacagtcgtccaatcctcgcacttacagtcgcacttcgtcgcgtgaggaggcgcggcccattgaccacaatgacccgctcaccggtgaagaaggggaggtccaggcaagtaaaagttaaataagacatattaaattgccggaaaatgcaccaaaattagaaattgcgtattttcttatttttaagggcggttttgtgtcctaccaacacggggacccaagaacaccgatgggacagggccaagcgcgcaatgtcaaccaaaatgggtcgccatcggatgtcggggaggaggacgacgaagactcgccgctaatgaaccgaggtctgttcgcgtaa

SEQ ID NO: 63156 - DNA, 2146 bp, Heterodera glycines
  Genomic contig location: Contig_ID=SeqID_6866; Location=1160..3305; Strand=+
  SCN-specific regions: Sequence locations=1-642,679-1369,1391 -1822,1845-2146
  Gene Ontology: Mol. function=heterogeneous nuclear ribonucleoprotein; Cellular component=nucleus; Biological process=RNA processing
atgcccaacctcgttgcagttttggcatcggacgacatggagcgtcgttttgccgtcaagagcaatttcggcctcacaaacccggcacacaaccattggacctgtgaaatgcggttgatgattggggactttggggtgattttacgcgaacagacctcggttcattagcggcgagtcttcgtcgtcctcctccccgacatccgatggcgacccattttggttgacattgcgcgcttggccctgtcccatcggtgttcttgggtccccgtgttggtaggacacaaaaccgcccttaaaaataagaaaatacgcaatttctaattttggtgcattttccggcaatttaatatgtcttatttaacttttacttgcctggacctccccttcttcaccggtgagcgggtcattgtggtcaatgggccgcgcctcctcacgcgacgaagtgcgactgtaagtgcgaggattggacgactgtaaaaggggcaatttctctgccgaactgacatcacgggacattttgaatgtctgcaaaatgcttttaaacttcaaaatttctcaatgacaaatagaaaaattgataaagccggagtgaaaaggggcagaaaacagtgggaataagtaatcagcagccacagatgtttattttctcattttttaaataaaatgctaagcattatgccaaaaatgaaaaatacgaattttggcttttaacgcgctaaatgctagacacacaattgattttattactttttgaagacggtaatcgacagtaaagctttaaccagtattagtttaaccttgatcacatttataagctctaatttaattttaacttccattttatttaaggtttattatttgacaaatttcccgtcagtggctgggcatgaaatgattgtgctgatgaaagtttgttgaatggtgacacaaggtaaagcattttggagttaatttctaagaacaataattacaaatttatttcccatttgaatgaatcgacgcctttcttcgtatctttgtgatctaaaagacaccgatacatttataacatatccgttaattcgaggcttaacccaatgttaatgcaattttaagctttgtaatgatataaatttgagccttcccccatttgtacaagcttatcatgtatttgcaacgtttcggctagccgagcgtttgctcagattattttcataactttagatatcactatttttgctcggtttgatacgatttatttgattgattagaatcgatcgattcgaattccgtttatttcacacattcacgatttgttggtgtaggcagtgcattgagagagagaaagattctacgaaatagacacacttccgtacgtacgtaggcagaacacagacttcacagaagaagagaatggttattgcttttgccactaattctagttgaattaaaagtagtcaatttttatttgtttttttttattgtcaaatggattaaaaagtactgctagaaagccaattttgttttcacatttaggagcacgtaaagttggaatcaaatggaggcagcaaagcggagttggtcgacggggagcaatatcgcaaactgttcattggtattgttttttttggaatagtcaggctccaaatatacccagaattttgttttatctcatttatgtttttaggcgggctgtccctcaacaccacaaatgagacgctcagtgatttctactcgcaattcggctcattggttgactgtgtggtgatgcgcgatccgcagacgaaacggtcgcgtggctttggtttcgtctcgttttctagtctggaagaggttcggtttctttaacaatcggaattggcttttcaacaaccctaagcttgtttgtttttaggttgaccgtgcaatgactgcgcgtccgcataccattgacaaccgcgttgttgacccaaaaagagcggtgaatttttcccgtccatgtttaaatgtaaaaaaaccaattttgccacaggtaccacgggaaatggcaggcaaaggcgagtcaaacgtctccaccaagcgtttgtatgtgtcgggtgtgcgggatgaacacgacgaggattcgttcaaccgatacttttctgagtatggaccagtcattaaggtatattttaaattcattttatga

SEQ ID NO: 63157 - DNA, 660 bp, Heterodera glycines
  Genomic contig location: Contig_ID=SeqID_6867; Location=1..660; Strand=+
  SCN-specific regions: Sequence locations=1-185,208-479,501-538,560 -637,659-660
  Gene Ontology: Mol. function=chaperone activity; Cellular component =cytoskeleton; Biological process=protein folding
ggtggtgttgcgtggaccgagcaaggacatcatcaacgaggtggagcgcaacattcaggacgcgttgcactgtgtgcgcaatgtgttgactaacccgcgtgttgtgcccggggctggtgcgctggaaatggccctttcgcatgtaaattacatattaatttgtcgaaggggggggggggtaatttttcgttgttggttttctttaaatcatattttctgtcgtcaggctttgttggagaaggccaagtccatcccgggcgtccgtgccggcccgtacaaggcggtggcacacgcgttggaaattgtgccgcgcacactcatccaaaactgcggcggctcctccaccatacgtcagctgaccgcactgcgtgccaagcacgcccaacagccggacaccaactggacatggggcatcaacgggcgggacgcgggcggcgagttggtcgacatggcgcagcccgagggcgtttgggactcgctcactgtgcgactgcaggccatcaaaacagccatcgagacggttgtgccaagacaaattacgaggggtatttcttggtggtaccgccacggtttcaggccattatgattttgcgcatcgatgacattgtcagtgggacgaagaagcgcgacaaagacgagaacggaggcggaggcggcggt

SEQ ID NO: 63158 - DNA, 419 bp, Heterodera glycines
  Genomic contig location: Contig_ID=SeqID_6868; Location=174..592; Strand=-
  SCN-specific regions: Sequence locations=1-186,216-302,332-361,391-419
atggaaatttcggcgcaaggagttgatgtgttggcactgacggcagcagattttgcggctatggatgaagcgcataggcaatgggagactgaacggcggcaacgaaaagaacaacgacaaagagagcaacaaaatcgcccgaaatggaagaggtctggtgaatggatggtgctccaaagagagtgggaagaagaaaaagaagaagaagaaaaagaccccaaaaatggaaaatggaaaaggaccagcaaattgaaaaatggaggcggcgaaactatgaactttggacgaaatcggcaggtgcgggtggcagcagcagcaacaacaaaaaatcggacgctgcccaatacgtttgggattgggccaaattgaaaaaacaagaaagagaaaaattggaaggcggtgggttgtggtaaaataaa

SEQ ID NO: 63159 - DNA, 519 bp, Heterodera glycines
  Genomic contig location: Contig_ID=SeqID_6868; Location=2089..2607; Strand=-
  SCN-specific regions: Sequence locations=1-4,26-125,380-430,463-519
atgagagaaatgaaccaaaaaagtacttcattcagtattcccatccgcctatggcagaaaagtggcgcccgccccacccgtccagccattcaggctgaggcaatgacgggtggagcggagaaggcggaggagacgccggagaaggagaggaaagcggagttggagaaggagggcaaaagcgacgcgggcagcagaaaaggccgagaaggggcggaaagcggcaaaggcggagatggggggaaaagcggagaatgagcggaaagcggtgacggcggagaaggagggcaacgcggagaaggagaaggagggcaaagtgacgcgggcagcggagaagggggagaaggccgaggaagcggagaagacaaagaagtcgggggagaagtcgaaaacggacggatcaaagccggggggaacgcttgaagcgcggcagaatatggtggcggtggggagagagagaacagaagtggcagtggcacattttgtgctggcgctaaataatcttgtaaattgtttaataaa

SEQ ID NO: 63160 - DNA, 1342 bp, Heterodera glycines
  Genomic contig location: Contig_ID=SeqID_6869; Location=1629..2970; Strand=+
  SCN-specific regions: Sequence locations=1-438,460-470,512-782,809 -851,879-992,1014-1029,1060-1342
atggaagttgaattattgtctgcaacaaacacgtctggagggcacgaacgttatgctgtgtgcaatgcgctgctaacaaattctgaactggcgcgcgtccttgttgttgcatggcgtaatcgggcgcagcctgctgagcaagtgtttttggtgggtggaccaggatcattgtttcggcttaccaatcttgtgtggcgtgggactcgagagaggttgactgctaactacacgctggccattggatttgggtcttcaattgaattattacaggtttaaaaaaaaataaatttggattagaccaaatttattgttaagccaccggcaccgaatatatattcacagtttcatttgcaaacacctgctgtatcggaagcactaccagttcaaattcaatccaaccctgtgctgcatttggctcaacccagcaacaacgatgcggagctgattcaaagcataatgaacgagcttttaaatgcttcataaacacttgtttcttttatttaagtttttacatcttaaggacaacaatagtatggaaatgccacaaatcctcctgctatcactcaggcgcaatcgggaaatcatcaacaacaacaacaacaccaaccaaatgttcaattgggccaaatcccgactactattggcttggttgtaaaccaccagcagcagcaatcgctagttggcgcagaaatccagcaagggcaaagcgaggaaccgccacctggaccaatgacaaatcgtcatcagagccagcgccgcgagccaatacatggaagcactattgctgctgctgctgttgctgcttctgtggaagaagcaaacaccgtaagcattatgtttattaaatacttcaatgcagtatttttaaagaaccaaccggtgtttcggcgccgtcgaaacaacaacaacaattctggacgtggaaccactaatcgtgaaaatcctgttgaattggtgagaaacggttgagaaaacaaaagaaaaaaaaacttttaccaaatattttatttttcaataaattttgagcgacatgtgtatgtgtgtgtttaatattagggggcactgccaaccgtgagacgaaaccagtccgttgcaattagaacccaaccaattcggacccaactacgtcgaagaagaagggaacccattcctacttttgagattggagggggtctaactgctcaacaatgcgatagtattttgcccaacctggaagtgaaccaacaaatgctccaaaatgatgaaagatgcgttgtgtgccagattggatttactttgggatccttgaatgccacggaacttccttgccaacatttttatcatttaacatgcgctcgggaag

SEQ ID NO: 63161 - DNA, 279 bp, Heterodera glycines
  Genomic contig location: Contig_ID=SeqID_32942; Location=307..585; Strand=+
  SCN-specific regions: Sequence locations=1-119,147-279
atgacgtcatacaaaaaatggacaaggacgaaagaatgtgagcagacagcgtatgaacaatttcaaacaacggagaaactgaacacaaaaatggaagcagccaacacaaagctaacagagctgaaggacctggagatgcaggtggaagcgggagcaaagctgcaacgctccaaagcggacagagacgcgcgagtggagcaaagagaacatgcaaaagcaatgtcgaagtcgaatgcagaagcagacaaaggaaatagcgtgcgagaggcaatgaaatga

SEQ ID NO: 63162 - DNA, 189 bp, Heterodera glycines; identical to SEQ ID NO: 32946
  Genomic contig location: Contig_ID=SeqID_32946; Location=1..189; Strand=+
  SCN-specific regions: Sequence locations=1-14,42-189
  Gene Ontology: Cellular component=cytosolic ribosome (sensu Eukarya); Biological process=transport

SEQ ID NO: 63163 - DNA, 684 bp, Heterodera glycines
  Genomic contig location: Contig_ID=SeqID_32947; Location=77..760; Strand=-
  SCN-specific regions: Sequence locations=1-88,121-209,231-684
atggccgctgccgcagtaacgccgtgggcaccgtccgcttggcaatggagcgcagccgccactgagacggccgcgctgcttaacggaacatatggaggaggaggaggagcagcagggacgacgacggcgacaagttcggcacagtcaaacggaggatggaatggtgcgtcgtattttggcaacacttttggaggtgggacaattcggaggagggaaagacaaattaatgaataattgaaagaagtcgcttcatgggtggtaaaagttcaattgggtttccatttcgctcagttttattcgttttgccaggtttggtctccaaccaattgggggctaacattggaaatgcgtgctttttctcaaactctcaacctcaattcactcccaccacaacacatgccgattccggtttgaagaacaaaagttcaacaacagtaacggcggcacaacgaaacgccaaaaaagggagcaacagaacgccagaaaaagcaaagaatggcacaatgaaacagcaaatgccattggaaacaaacaatggatcagtgtcgacaaactctcatcgtgaagcatttaaatcaaatgcaaagggacaaaagcaacgagtgaaagccggggggaaaacgaaaagcaaaagcggtgggggaaaaacggggcgcaactgcgaatgtccgaattgcaaagcgg

SEQ ID NO: 63164 - DNA, 895 bp, Heterodera glycines
  Genomic contig location: Contig_ID=SeqID_32951; Location=22..916; Strand=-
  SCN-specific regions: Sequence locations=1-302,329-362,384-418,441 -475,497-498,522-538,561-572,594-895
atgaagttatggcgatttccgccgttgctcctccctcctccattgtcgatgttccgaaaacggttgataccgccccgccgccgtctttgtctcagccggtggccgcaactgccgccgctgcaccaccaccaacatcggaacaacagccgaaccctgcggttgtcaccactgccgcggccaacaacaccaaacaatagttgggctcaaaggccaaagtctgtcgtggccggctcgtacgcggccattgccgctgccgcacgagggaatgggccgaacaatgttgataacatcgtgaccgtgcacgttcctgctgctgttgctgcaacgaatggtccgacggcacctactccgtcaaaggagattccacagcacaacaacaacatcgcaaagcacaatcccgaacaccaaattggtcaacttttttttaattatataaatttcaatcaactgggatgttttttacccatacattgtggtttttatactgtttgttttatataatatgtattttaaaccgtttattcactgatttacttaatcttttctttagctgtcaaacaacagcagcaaacgccgccatctctgccgcccgttttgaacatcgcgcctcgtcgggaatggacccatcgcatttacttcagccaattgaccaagccgggccgttttgtagactttaagctgggccagcaggagctgatgcgcgaaattcaaggtttgttcatttgaaaaacaaaaatttcttcaatttaatcctaattttttagccattaccgacggtgtggagtttgtgggcatcaaaccgaattctttgcgtcgtgagtatcgcactgcgttcggctttattgactttaccaccgcggcggacatgcaggcggtgtacgacgcgtgcaaacag

SEQ ID NO: 63165 - DNA, 2771 bp, Heterodera glycines
  misc_feature (1150)..(1150): n is a, c, g, or t
  Genomic contig location: Contig_ID=SeqID_6870; Location=471..3241; Strand=+
  SCN-specific regions: Sequence locations=1-430,463-830,852-1027,1067 -1561,1583-1815,1845-1860,1882-2437,2461-2695,2718-2771
  Gene Ontology: Mol. function=structural constituent of cytoskeleton; Cellular component=spectrin; Biological process=body morphogenesis (sensu Nematoda)
gaggccaaccaggagcaattgtacaaccgcaacattgaagacgtggagctgtggctcagcgaattggagggccaattggccagcgaggacttcggcaaggacctgatctcagtgcaaaatctgcagaagaaacttggccttgtcgaaagtgactacaacgcgcaccaggtgggactaacgggaaaaatgatcaatgggagggaagggagaaaagtaaaggaatatagaaaaagtttcgagactcgactcgggttttttctgggaaataattggtatagttttatcgaaactggtgaaatctttgggttgagacccctatttttcttttctcattttgagtgaataaattgaatattttgttctaaaaataattgtttgccaataagatcaaaaatgtcaattcaggaggcccgactttgatttactagtctaaaattgtatttaataattttaatttttaaacatttatcactatcagagcgaaattttcgacatttcaggaacgcattgacgcgatcgggcatcagacgcgcgagtttcacgacacgggccacttcaacgcaccgttgatcggtaaaaagttcgaggcgttacgcgcccgcttcgaggcgttgcgcgagccgttgcagcgccggaagcaaaagttggccgagtcgctgcttggccaccagctgttccgcgacatcgacgacgaattggcatggattcgagagaaggaacaaattgcagcgtcgacaaaccgtggccgcgacttggtcggcgtgcagaacctcatcaagaagcagaacgcactgcacaccgaaattgctaaccacgagccgcagatggaacaggtgaggggcggggtgaaggtatactgtaaattacggtagtgagtggagcagaggttaacttccaagggcatttcgcttactgtacattacagtacaccatggtcttggattatcaaatagggaataccatgggcggattagttgttaatttccagtgaaatggcgtaaactgagaccgatagatcaagaaattaatgaattgaaattttgtttttatgggataaagaaaaaaggaagtgatgtcaaacaaatttttggaaaatttaacattaaaattgtgtggatgattttatcaacaaaaaatcatgtttttttanacacgtgcaggttgcacaatccgcggaacagatggtccaacgtggtcacttcttggcaccagacattcgcgacaagaaatgtgagacagaattttttttttttttacttattttgggctcggggaaatttcttgaatctcggagtcacaattttcgaactgataattgtcattctcgttttcgactagttaaaatataaatttagcccaactgcgcgaccaattggcgtgcactgaaaaccaaggcggacaagcgcaagcaggacttgcaagactcactgcaggcgcaccagtacctggccgacgcgaacgaggtgggcctttactttttttctcttttataccattaaaaaatttcaaaaaattttcctttaatgacacgcgcccattttcactcaattaattttgtctctttttcaggctgagtcatggatgcgcgacaaagagccgctcgtggtatgttattctgctttaacgctggaccccattgtgccattattttgtgaaaaattgtcccaaaaatggctaagatttgtcatttttggcgcaaaacgatacaaatccgttttttttccccggcgctgaaaattttgaaaaagaacactggctaaaaaaattttaaatcagtagatcaaaaaaaaagaactctttcgggtgcttggatacgggcctgctcttccttcattttttgatcaaccctgtgctaatggattttgaaatttcagggcagtacggattacggcaaggacgaggacagtgccgagtcgctgctgaagaagcaccgggcaatgatgagcgacttggaggcgttcaacaccaccattgacgagttgcgccgcgaggcgggacaatgcaaatatcaggagcagttggatggacagttgggcaaggagtgtgtggtggcactgtacgaggcaagtggcagatgggatggactgatcggattgatcgggtcaaatataaagtaatgaggtgtcaattattttttattgtggcactttgtgagggtagataaatagatattcattagttgatcagtcagaaatttacggaatttgctcatgaactgatcaggcaagtgggatttcttggtgatcaaacattggtggaaattattaatttttgaaatatgtttacgtagtgttgctcgagaccgataatttctcgacccagaaacccataaaacacatggcttttctcgaattatagctctgatccgttatttttgattagcattattatgtgccacatgtggtgcattttattcccctgattcgtttcttctctcccaaacctccatttaattctaaattccaattgttcatataaattactcctaccaaatctcagctcagctcttggggctgggtaattaggcctaaatgctaaggcaaattttcttaattaattgattaccattactatcaatcactaaacacttttcgtatctcttataaattatgtctttttttatttaagtacaccgaaaagtcgccgcgagaagtgtctatgaaaaagggcgacgtgctgacgctgctgaacgcgtccaacaaggactggtggaaggtggaggtcagcgaccgccagggcttcgtcccggccgcctatgtgaagcggattga

SEQ ID NO: 63166 - DNA, 737 bp, Heterodera glycines
  Genomic contig location: Contig_ID=SeqID_6871; Location=462..1198; Strand=+
  SCN-specific regions: Sequence locations=1-384,406-414,590-616,638 -703,726-737
  Gene Ontology: Mol. function=structural constituent of cytoskeleton; Cellular component=spectrin; Biological process=body morphogenesis (sensu Nematoda)
attatcagcgcttcttgtccgactaccgtgatctgatgcaatgggtggacggaatggtccaattggtgtccagcgatgagttggccaacgatgtgactggcgctgaggtgggtagcctatcgaactcgcaataaaaaaccgagaacgctaattcgtttgtttcatcgttgttgtgttgcaggcactgcttgagcgtcaccaagactaccgtaccgagattgacgcgcgcgcgtccaccttccacgcgtttgagcagttcggcaaccaactgatccgcagcgaacactacgcggccgaggacgtgcgccaacgaatggacgaggtgaaaactgtataaaataggggggggggggtctattttaggaaacacggtatggcatggataaataaaattttctatttgtccggctcaatttttcgcttatttaattttttcttccgttctttttttaatcctttattttaaaaatttgcattaattttccgctttttttcactcctcttttttaccctgtctcgtgttatctacttctttttctctctgtctctgtttctctgttctcctctctattttctattattttcttctacagtattatttacagttatcgtatacaaaaatcattttcacttaaggtgaatgatgctcgacgtcggctggaggaggcgtgggtggagcggcgcaaggtgttggaccagtgcttggagttgcagctgttccatcgcgactgcgagca

SEQ ID NO: 63167 - DNA, 918 bp, Heterodera glycines
  Genomic contig location: Contig_ID=SeqID_6872; Location=466..1383; Strand=+
  SCN-specific regions: Sequence locations=1-49,72-86,108-345,374 -386,408-753,777-918
  Gene Ontology: Mol. function=structural constituent of cytoskeleton; Cellular component=spectrin; Biological process=body morphogenesis (sensu Nematoda)
gcttttctgtcccaagaggacaccaccggggacaacgtcgagtcgctgatcaagaagcacgaggactttgacaaggcgatcgcgtcgcagcaagaaaagctgaacaacttggacatgttggcacgacagctggtccaagcagggcactacgcggcaccggcaagttgcttttaacagtgccaataatggcaatgccaatggacctccctgctgagtccggagcagaccctcgcacattccccccccccccctttctcccaaaaattacaaatttgatctaaaagattattttaaaacgattttttttgcgaattttcccgattttttcataaaatgagaattaagttaatttttttttaatttcttaaaatttcaagcaccatgaagttaatggcattttccccattttccagcaaatcactgccaaacgtgaccaaattttcgagcgctgggatcagcttaaggcggcactgatcgaaaaacggtcaaagttgggcgagtcgcaaaccctgcaacagttctcacgcgacgcggacgaagtggagaattggatagcggagaagttccaagtcgcgcaggaggagacctaccgggacccgaccaacattcagcagaaacaccaaaagcaacaggtggagtcgggagttggggacaaaggttttggcgccgagactcgatttctgagtggaattttctcaattttgggcaaagtttttcgtaattttgatcgtttgtcgaaataaaaaaaaacaatttttagtattttttgtgcatttctcatgctttttaggacagcaatttaccccattattaatttccatcatttcacgtttccaccctttatttgtcttaatattgccattaattttaattgctttctgcaggcatttgaagctgaactgtccgccaatgctgatc

SEQ ID NO: 63168 - DNA, 203 bp, Heterodera glycines
  Genomic contig location: Contig_ID=SeqID_32956; Location=50..252; Strand=-
  SCN-specific regions: Sequence locations=1-151,173-203
aaccggtttaaaactcgaaaatttgagtgaaaagggaggctcctgaccttttaaaacgcccaaattcggacaaatttggtatcattcgaaagctcttgatgagctaagtctaaaaaacaaggtataaactcgaaccaatgccatctaagcactgggacaactgagtcccagtgaaaatggacacttcagtaccaaaaaataaa

SEQ ID NO: 63169 - DNA, 203 bp, Heterodera glycines
  Genomic contig location: Contig_ID=SeqID_32956; Location=772..974; Strand=-
  SCN-specific regions: Sequence locations=1-5,27-203
catctgaagaagaaaacaatggaaaatgcgatgagaaaaatgtccgagggaataccaaattgtcagcatcaatacggagaatgtctaagtcaacaaataagaagcttatgccattttaaatacctatctccttaacctcaagcttaatataaaaaagaatttagctctatttatccttttaattcatatagtgttaagaaagc

SEQ ID NO: 63170 - DNA, 228 bp, Heterodera glycines
  Genomic contig location: Contig_ID=SeqID_32958; Location=52..279; Strand=+
  SCN-specific regions: Sequence locations=1-45,67-228
atggaattggaagtgtccgcggcattggccgagttggacggactgattgaacttgttcaccaagttgacgagcaaattgaggctcaggagaaccgcctattttccatcaaaaagcaactcgcaaaaatggacgaacaggcgaaattggtcggcgagagaatgcgaacgttggaaaaacgggctgaaagaatgggcggaaagggcacggctgacccaactccgatcatt

SEQ ID NO: 63171 - DNA, 329 bp, Heterodera glycines
  Genomic contig location: Contig_ID=SeqID_32959; Location=375..703; Strand=+
  SCN-specific regions: Sequence locations=1-94,176-329
atgtttttgatttttctgctcatcattttgctaacaattcttttatcggtgtttggacagaacatttcgggacaaggtcagtaaaactttattgaaaatataatttataaaaaaataataaatttaaatttaaaaattaaattattctttaataggaaaatcggaggaaaaattagattcaattaatgcaatgggaaaatttgacaaagttcggctgaatgaaaagaattatgggctcgttagaaacttgcacacgaattggtacgcgggtggcatcaaagcgattatgggcaaaatggggagagatttgttcagaaagttattgccga

SEQ ID NO: 63172 - DNA, 725 bp, Heterodera glycines
  Genomic contig location: Contig_ID=SeqID_6873; Location=139..863; Strand=-
  SCN-specific regions: Sequence locations=1-89,137-480,502-558,580-725
gccaaaggccagcagaattgagcagcgcgaaaggagcagctcatcagcatccaatgaacgcctggaaaatgcgcttggcgatgagtgagaaattaaaaatttaattttaaaataattttaatttttaactatttatgagtccctactgttttgcaaaaataattgtcattgtctaaaaatgttattaaattaatgggggggggggatttctcgaagcggattcgatgagactgagacacccaaaaaatccggggtttttccgagtccggtctcgaaatttgatgaggtcgagatcacccaaaaaaaaaattgggattttttctgaatttacgccgagacttcttttgaatgtcatttgattacgctcggcaccgtcgggactcgggaacacttttttttaatttaaaaacgaaaaaacatttcgccaaatattgattggttaggaaattatttgaaatttaagcttttcattaatttaaatttattcagatattttgacagttctttctacgccccagcttcttcatcctaccgacaatcatttgttgttgtcgtcaatgctttgttcaatttggcacttttggcactgtttttggcaatgattcagcattgaaagaacggcagaaaatacttaattaataagcttaattaccccctaattggcataaagaatttgatcagcatttatgaaaacataacatatgcataaagattttttcaataaa

SEQ ID NO: 63173 - DNA, 1219 bp, Heterodera glycines
  Genomic contig location: Contig_ID=SeqID_6874; Location=397..1615; Strand=-
  SCN-specific regions: Sequence locations=1-325,347-360,384-420,445 -470,492-562,609-741,775-981,1014-1119,1141-1219
atgacgatggcactgaagaaatcggcacaaccacaacaaaaagaacaacaagcatcagtcatactgtaagttggtttaattagcatactgtatttgtaatttatatataaatggtgggtgtactgtaatgatggagttggcttaattaagtacggtgttttcccaacttttcaaaatagggaaaaaccacaggattttggcaccaaagataagttaaagcgccaaaacattttaaaaaatcataaaaactgaaaattccaaaaaataaaaaattccaaactcaaaattaaggacaaataaggacacttggaacgcaatttttaagttaattttaatacatatttttcagccaaaaatgagattttatattattttattttttagaatttcgcttcggctcagagtttgtcatcgaaaaagtatttttttaaaaattattttttacccgaattttcaaattttcggctcacttcttcaacaagcacaaaaactgtgaactcattattccatcgtgcgcataaggagcaaaaaattgtaaaaaatatgtgtcaaaaaatggatgtaaaaaataattaaatttatttaaaaaaatgctttttttttaaattgacgaccctcataatttcgggggctatatttcttagacaacacccctgaaaagtggggtacaattacaggggggggggggaaaggaaaataattcagtaaatacggtaatttttaaatctcagcaaaaaccgcaaaattttgccattttttccaactccttcaattaagagcccggccaccgccgtcagaccaactacaccatcaaaatcggcaccatcattggcaccatcggctgcttcctcagcagcgatgccaaagccatcaaattcgtcttcaaaattgttgccgttgcagaacagcacggtgcaaagtgaatatgatcgacacaatcgggtccatgtcatccacgtgagcagccggtgggtaaagcagataaaaaatatatatataattagttaaaattagagcccgcaaatttcaaaagatccggattcagatctgcgggattgggactcaaagtttttgcggggccggagcccgcgggattaatccagcaaatccagcaatttccaaaaaaggcgtgattgcggactgggattccgtaaaatctcacgccgggattgggattcaaatttttgcaggacgggatcacgcgggattaattccgtaa

SEQ ID NO: 63174 - DNA, 691 bp, Heterodera glycines
  Genomic contig location: Contig_ID=SeqID_6874; Location=1778..2468; Strand=-
  SCN-specific regions: Sequence locations=1-513,537-691
atgccgtcactttctacgattatttggacagtaaccaatttgtctgtatgttgaagggcgaatttggggagcagcagggctccggctgtgtacggaaacgttcaggtggaaaaacaaattaattagaaaaattaaaatgttcgaaatccgaaccctaaatcccgaggggtcgattaattttccaaaaatccatttcactaaaatgtgaactcattatttcatctttagcataaggaacaaaaatagtgtaagaaaacatgtaaaaaatggatgaaaaccatggtggaaaaataattagtaaaattaaaatttcattcaaaattcaattgttaatatcggagtaagaaaaatttattcaaaaaaccaaaaaaaaatttcaagcttatttcggtcgctaatttcgcagcaaaaaattttttttttaattcagttgttaattggaaaaatggatttcagaaaatgagtgaatcttggcgcttccgtaaattttttgtttgtgaatgaaacattatatttcaaatttttcaaaaccctaggccttgcttaggcctgttggtcgaaagaaaaactcaaaatcaaaatttagggcgcaaaaaatgccatttttcaggcaacattcgctgctggtgttttggccgttccaattgcaacacggccgaaaattcgaagctgctttatgaggcgtttgtga

SEQ ID NO: 63175 - DNA, 782 bp, Heterodera glycines
  Genomic contig location: Contig_ID=SeqID_32970; Location=62..843; Strand=-
  SCN-specific regions: Sequence locations=1-105,142-179,202-493,535 -587,611-782
atggccaccggagtcttggacaacgatcattcagttgatactgtagacctaagcaacgaaatgttcaacatcgacaacatggacaatgtgaaagaattttttggcatttttaaattaaaataaattaaaaaattttttttagaatccaattgccgaagaatgccaaaacagagccaaaaagcatggaaattcaatggcaaaactcacttggcatggcattagcataaaacttaacagacaaagtgctgggataaacacggcaattttggacacatcattctgcgagaaaaggtaaaatttgccatttatattgtaattttttgaaattcggtaattttgatctaccgtattacgatgatgaaaaactgtagtttttataaataatcgaaaatttgctattgcaatttagttacattgtgcccgatgtttttcgccaattcaacattcatttcggcaacaaaagccattttgctgcttacattacaattgatggtaaaaataatttaaaattatttttaaatttaattttaaaatgcatttatattttagaagaagggattgacattgaagatggaaaagttgcgcagtataagaaaatggcattaagtggtgccaaaatcaaagattttgtgggcttttgggtgctcggcttggacatgatcccatgggatgagcaaacgatgagacttttcgtcatccggcactgcaactgctcattggaagcatttgtaaaaaatgccaaaatcaaaaattgaatgccaaaatcgttttttttaaataaa

SEQ ID NO: 63176 - DNA, 150 bp, Heterodera glycines
  Genomic contig location: Contig_ID=SeqID_32971; Location=301..450; Strand=+
  SCN-specific regions: Sequence locations=1-150
atgggttttgtggaaccgtacttccattgctcaactcgcggtatcgccggcattcaaaaaggctcccggacatttggacagtggacacttcgacagtggacatttggcagttggacagaagcggacaactggacagtggacacttcgaca

SEQ ID NO: 63177 - DNA, 1619 bp, Heterodera glycines
  Genomic contig location: Contig_ID=SeqID_6876; Location=427..2045; Strand=-
  SCN-specific regions: Sequence locations=1-216,238-448,470-1005,1032 -1137,1210-1338,1376-1619
atgagaacggatcagactgatcaaaattgcatttgtcacaacagagttttgttgtccgattactattccgatcacttcagacacttcccaaacaattctgaacatgatcagggaggagttgcccaaggagggctacgaaatgtggcagccgacactcggaggtcggtttattacactttctcttttttattgccatttgccccgatgtttaggcccgggtgtgctgcagcatcagcaaaagccggagattttcacggcatccagcagctcagcggccagctccagcacaacgttcagcaccgggcggggcagcggctcctccatggctgtgccggtgaccgcggcgggctccacccggtccaacacgccggccagctcgcaccagacaacgccgtcggcacggcacaaaaagtgattactgattgactgccgcggggggttttggacgggccgacggacgacgacgacgcaatttctgaccagtcggatcagatcgatggcgaaggcacaatgtgcccatccatgcacatctctcccggttttgtctccagctgctcctgctgtgcaacacaacacattcgttcacatttcttatccctcgcccccgtcccttttccccttaaattgaacaccgcgcacttatcgggttccaaaaaatgccacaatttttatgtgagtacaacaacaaaaacagcaggagaatctgcaaaaagcatttcccttggtgatattccttcacgtgtactgctcgagatttttgtctcgtttggtttttgactaaaattttagaggtaatttttgcgacaatctcatgcaaattttgggttgcattttaagtttcaaagtgagattaatcgagtctcgactcttctgtgagtacggtttttcccgccatttgttaccgtattttcccaccattttccaccgttgtgcattttgacagattctcctgcccccccccccccattaaacgacataattttggcgctcttttcccccaaagtgccttccttctcctcctccttccttcacacattattacctaattaaataattttttcgtcattttccaattaataaataatggctggtcaatccttcgctctcttctctctgcccgaggccactaaattcaccaaaaatattttaaatattattttaacaatttaaaatatgtattttaccaatatgttttttatattttattttgccaattgtattccgacgacaattccttctccgatttgacatggcaatataaatattacgtcatactgtgctgagccgaacctaaaaaaagactcaatgggacgaattaaaaaaagtatcaaatgatagtaataattaattaatattattattttaattttattttgcaaaataataaaccataacttacaaattagttcaaactattcaaaaaattaaacagtctaaaataataattaattaaacacaataatcattgatatgtttttaggttcgccccattggcacttttatggtccggcctagcaaattcacaaacaatttcatacataattcgtatagattgattattgatcagcaccagttttatttttttgttttttgtccgcccatttttcttagaaaataaa

SEQ ID NO: 63178 - DNA, 185 bp, Heterodera glycines
  Genomic contig location: Contig_ID=SeqID_6876; Location=108..292; Strand=+
  SCN-specific regions: Sequence locations=1-185
ctgaacccggcaataaaaaagagacgcggagaaacggggagaaaaatcggcgcctaagaaaatttgattgactttgtcttttttgacatggaattttgcacttttattatttttgctgtttttttttgtctcttttgctgcagctgagtgtctaactgtcgcgtaaaaataaatttgcttaaaca

SEQ ID NO: 63179 - DNA, 2482 bp, Heterodera glycines
  Genomic contig location: Contig_ID=SeqID_6876; Location=2659..5140; Strand=+
  SCN-specific regions: Sequence locations=1-518,541-1611,1633 -1733,1755-1822,1844-2174,2196-2482
  Gene Ontology: Mol. function=dolichyl-diphospho-oligosaccharide -protein glycosyltransferase activity; Cellular component=membrane; Biological process=protein modification
atgagtgaacttgccaataaggagaaaaagagccttactgccgcagtcagcgcctccagcattggtggttattccactctgctcgtttttgttgtgcttggcctcgcttggtttgttgggttcgcttctcgtctgtttgccattgtccgtttcgagtcgatcatccacgaatttgacccatggtttcttcttttcgttattgaatgttcaccaatttaattattcatttgttaggttcaattaccgtgcaactcattacatggttgagaatggattctataattttcttaattggtttgatggtaaatgttacaataattcatttccgtaaattactcctttacttatgctgttttcagaacgcgcttggtaccctcttggtcgcattgtcggcggcaccgtttacccgggtttgatgctgaccagtggtttcatccactaccttctttcttgcctccatattccggtgcatattcgagacatttgcgtttttctggcaccgactttcaggtcttctaatatttgttttaatgcttaaatggtttttgcttttcagtggtctgactgcaattgccacttatttgctgaccaaagaactttggtccactggggccggacttttcgctgcgtgttttatcgcgatttctcctggttacaccaggttggctgactcgacaaaattttgccgccttcaggaatccattctcttttcagtcgttcggttgccggatcgtatgacaatgagggaattgccattttcgctcttcagttcacttactttctttgggttcgatcggtcaaaacgggttctgttttctgggcagcactcactgcgctttcctacttttacatggtctcagcttggggcggttacggtatgactttaacaatctttttgagaataaattagtccatagtttagttttcatcatcaatttgatcccgcttcatgtgtttgctctcatcatcagtggcaatttctccaacaaaatttacatcgcttataccactttttacactttgggtcagcttatggccatgcaggtgttccctttttcgtcctttttgtcttttattgctttttaggtcccttttgttggtttccaacccgttaagaccagcgaacacatggcagcagcgggaatttttggacttttacaggtcaaaatgctataacgaaacgcatcactcagtgcatttggtacgctttcgttcgttgtttcagctcatcggggccctccgctttctgcaaggtcgtctttctcgcaagcagttcatcactctgtttgtcaccaccattctggccactttttgtgccggcattgccctgctgatgttgctcacttacacgggtccaatttatggattttattagtcatataagagtgaccatcatttaagaattcttttcatcattgttataattcctttaaggttatattgcgccttggaccggccgattctattccctgtgggacaccggatatgcgaaggtgcacattccaatcattgccagtgttagcgaacatcagccaacgtgagaagaatttaaacaactgtgagaataagtctaacaaaatgcttttcctttctttaagcacttgggtctcctttttcttcgatttgcacatcaccgcggctgttttccctgcgggactttggttttgcgtcaaaaatgtgaacaacgaacgaatctttggtgccactttttcaatatttgcccattgtgctatttgtccatttcagtgattctttacgcggtcaccgccgtttactttgccggggtgatggttcggctgatgctcacacttacccccgttgtctgcattctcgctggcattgcgttctcaaacatttttgagaaatatatgttggacgatggagacgcaagaagaggaggcgaatggcgagaaccgaaggatgtcaaagaaggaggtgagacgaggagcaaaacatttaggaatgcctttctgagatggctttttaatctttttctaattcctcgcccaatttagaccgccgtctctatgacaaagcgacaacaaaaggcgggaagccgccaaaggtcccccaggcgacgaccgcctctttcagtccaagcgcacaacaagaaactgtggaccacattgggatgaacacacggtacaggacatggtcctctgttccttttcggatgccttctctctcagttccatcgttttggtggcgttgcttttcatccttttgatgtacgtcgctcactgcacttatgtgaccagcaatgcctattcccatccgtcggttgtgcttcagtcgcacaccaacgatgggtaagtatttgaattggattgtcaaactattcacaaattgtagaggacgcatcatcatggacgactttcgagaagcttattactggttgcgcaagaacacgccggaggatgcgcgagtgatgtcatggtgggactacggctaccaaatcgcagggatggccaaccgaacgtaa

SEQ ID NO: 63180 - DNA, 633 bp, Heterodera glycines
  Genomic contig location: Contig_ID=SeqID_6876; Location=2244..2876; Strand=-
  SCN-specific regions: Sequence locations=1-272,298-602,628-633
taaattggtgaacattcaataacgaaaagaagaaaccatgggtcaaattcgtggatgatcgactcgaaacggacaatggcaaacagacgagaagcgaacccaacaaaccaagcgaggccaagcacaacaaaaacgagcagagtggaataaccaccaatgctggaggcgctgactgcggcagtaaggctctttttctccttattggcaagttcactcattattgccgctaaataaaaggattattatacaagccaattttagacaatgctttggtttcaatgaaaaataaatatgagaaaactaacaacagggatattgagaaaagaaaaagaaaatacaagacaagagaaaatgtagaaaaaaacgagaacgagacgcgctaaaagtcaagaaaagagacgagaattctcttttaacgaacacctaattattaattaatcagaaatttttggttcgtatttttacggaacataatcgggccgggcggaatttgtatttcaaactgccggaataaaacggggcgggaataaaattgtttgccttcaatttagaaaacaaaaatcatctcaaaatttaaccaatcaaccttttttttaaaactatcaaaaattctaaatttaaaattttctaaaa

SEQ ID NO: 63181 - DNA, 675 bp, Heterodera glycines
  Genomic contig location: Contig_ID=SeqID_6876; Location=5996..6670; Strand=-
  SCN-specific regions: Sequence locations=1-383,405-608,630-675
tgctaaaatggcaaaaattacgcaaataaaaaatggcgaagagcgacggattgaaagcattactcggagaaaaaatgagcttgatgagaggagacggcttatcaataaatcattgacgggagaattgaagataaacaaacaaacaagatttgctgattccgatgaagaggaatcaacacaaaatagcaaagtaatctctgttaaatcaaatcgtttaataaaagggatttgtttagccatttagttttcttgcttcaatcggacgcatttatcccgaacaaaatgagaagagcaaaaatacaaatgttgtggatgattcaccagagcaattccttaaaaaaacgagacttaccaacgaaacagaaaaaagtgcacccaaactcaaaaatgtatgttttatttcaaatataataaatgctctctaattagcagatttcgttgtataaaccacccaacggcgatggtgacatgtggcaatgtttctttgtcaatgaacacacacccgaaatccgttcatccttttcttcatttcgtcggcaccaaaaagaagagacattgcgtaaggaatgggacaaaaagagagcgccaattgttaaggttctatttcctgctgtttttactcactttttagaccatttttagttttacaaaaaagaacggaagtcagcacttaga

SEQ ID NO: 63182 - DNA, 379 bp, Heterodera glycines
  Genomic contig location: Contig_ID=SeqID_32972; Location=109..487; Strand=-
  SCN-specific regions: Sequence locations=1-379
atggggcctcaggcgaaatatgcgggacaaacgaacgaatacaaagaagactggggaaaacagttctcgaagacaaacggacgaagttaagaagagtaacaaagcgagagagaacgtaaaaaacaattccaggatattatggcccattaaaagccatcgacagagaaaacgaacagacaaatggaagggaagacacgggtaaaatgggacaaacggaaagagcataaaaagcatggaatggaaggcaaaaaatgcttaaaacaattgcagacattaatccaccgccggaagggacgcgcattaaaatggacggacgaaacgatggaaaagcgaatgaaagggaaaggcaatggcacagaaaagacggcacaatcagtcc

SEQ ID NO: 63183 - DNA, 702 bp, Heterodera glycines
  Genomic contig location: Contig_ID=SeqID_32975; Location=272..973; Strand=-
  SCN-specific regions: Sequence locations=1-702
atggaaatttcaagcagctggagttttctgaaaatgacacttcaattagtgctttatctaatttatataaaggtacttccggatgccccaaaaattttcgggaatcggaatcctgaggaccaataatttttaaaatcggaattccgacaacaccaaaaatgtcgtaaatttttcgaaaaaactacatattttgataggctaaagttaaaatttataaccaaaaaataaaaggaaacgcgatcaaaaaaaattttgggaacaagggaagtccggcggtgccgttagttgccttcctggaaaaatttcgaaaatttgagtggctatattacttattttacacaaaagaaaccattctgaattggcaaaaaaaaaacaagaaaatttctacggttttttttttaaatttcagaaatcagtattctgtcacccaagatttttcgaaactcggaatttcggccccaaagatgtcgaagttgaattccatgacttacttgtccagagcacattcatgggcttccaaaagaattttaaggcactcaaccgatgaacccgcggccatttgaaatgcatcaaacgagttaacgtcacgtttgaagggattggctccaacgtccaaaaggaatctgaatcgattagagatttgagttccagtggtgaaaacgccaatagtttggtcaaaaatgcaaaaaattaagaaataaa

SEQ ID NO: 63184 - DNA, 208 bp, Heterodera glycines
  Genomic contig location: Contig_ID=SeqID_32976; Location=65..272; Strand=-
  SCN-specific regions: Sequence locations=1-52,99-208
atggccactttcaatgtggcccatctcatcactttaattggcgttggggtacaaaaatataaattaaatttattcctttttttctaatatttatttttgttttagtcaattgcttcagtgaaaactgtggaaattccattgatggaaattgaggccagtatccttggtatcaaagcaaagatttaaatctaaatttatgataattaaa

SEQ ID NO: 63185 - DNA, 525 bp, Heterodera glycines
  Genomic contig location: Contig_ID=SeqID_32979; Location=88..612; Strand=-
  SCN-specific regions: Sequence locations=1-525
gtgaaaagaaaaaattggagcaaaaaacatttgaagaaatatttggagaaaaatgggaagaaaaagaaaagtgaacagcaaaagagagaaattgttgaaaaattcatcaaaattaaagcgaaaatcaagcaaaaaggaagaaaatattcaacaaaagaatggaatacaattgaacagaaaatagcgaaaaaattggggacaaatcgaaagaaaatttacaaatggatcaaagaattgggattatacaaataccaatgcaaattgaaaacggatgcacaaaaaattgaaattgttcaaaaatttatggcaatgaaaaatgagtacaaacaaaaagggagaaaatattcgacaaaagaatgggacaaaaattatgcagaaattgtgaagaaaattggagtaaattatggaacaattcaaaaatggaagaaacaatttggaatgggcgaaagaatgtcggagaaagaaaaaatggcaaaagtgaacatttatttgctaaatgaaaggacaaaacccaaaaataagtga

SEQ ID NO: 63186 - DNA, 730 bp, Heterodera glycines
  Genomic contig location: Contig_ID=SeqID_32981; Location=1..730; Strand=-
  SCN-specific regions: Sequence locations=1-192,216-358,380-730
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctataggaaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaaaaattatggggagcaaaaatccaacgcagaattaaagtaca

SEQ ID NO: 63187 - DNA, 2278 bp, Heterodera glycines
  Genomic contig location: Contig_ID=SeqID_6878; Location=1..2278; Strand=+
  SCN-specific regions: Sequence locations=1-102,124-345,392-428,451 -501,523-561,633-633,657-912,958-1139,1161-1361,1399-1512,1540 -1644,1666-1807,1829-2278
  Gene Ontology: Mol. function=cystine/glutamate antiporter activity; Cellular component=integral to membrane; Biological process=protein complex assembly
cgcaaaaattgccgcttgtgccattattgttgtgatcggtttctcttttgggtcactcaaggttggcatccattttcgccaaatttcaactttgcaaattcaattttttctaattaatctgcattcttttttaattatttgtccatctcgcgaattgctcatttgtcaggtgcccattccaacaacttcgcccaaccctttgccaacagcaatttcgagccgggcaaagtcgtgttggcattgttcagcggactgttcagctacggaggatgggacattctgaacaccggcattgaggacattgcacatccgcacaggtgaaaaatgcagtttaaaagatcaaacaattaaattattaatttctaaaaaattatcatcaatttaatttattctaatcagaacttctttttttttgctccttttcctaaactaatcataattagtgtaattaaacattgatttttaatatggcatttgagaaacaatacatttggacatttatgagcaaaactggttttaatgaaaaataattttagtaacaataatggagtatatcgcatggcgtcgttggtgcagtggtagcattgctgccttccaagcagtaggggcgggttcgattcccgcacgacgcagaaatttattttttatttttttttgactaattgtttaggacaatgccattcgccattatcgccggcatggccatagtaattctgctgtacatgacaatgaatgtgtcctattttgcggttctcactgtgacggaaatgagaacatcaaatgccattgccatggtcagaggagagaaaaaatcaaaaaattgtggaattttttagtaaaaaaaaacaaccaaaaatcaatgaaaattttaaccaaatcgaatttaaaactgcttatttttctagtgagaacaaaataatacatatttcaaataataaaaattataatatttaaaatgggtaaataaatataagcaaaacaaattcacggatgaatattttttcaaatttaattttacccaaaatgtcgacttctaaaattaagctgatctcgtggatattgcgctaaatctgccccaatttaggggccatgttcggatttagacattctctgagcgtgtcttccacggctatcttcagtatttgatgccttttttggtgtgcattgtgctgattgggttcggcatcttttttatttgattaatttgttttttaattgtttttagttcgctaaatgccactttattcgggggcagccgaatgttatgggccattgcgcgggatgggtatttcccctcattcatttcgtgtattaaccggcaacacggcagtccacgggcggcacttttcattttcgtatgcattaattaattaattattattttttgttaaaattattcatttttcagtccaagaaaatatgcctgttaaaattatttgaatgttttaggtcgttctcgctatgcttttcacgtttcttggtgatttggatgttcgtctttctctctctttcattttattttaaatttaattttaatttctcaatttttaggaactgattggatacgttgagtttacgaattgggcaagttttttatttcaaaatttatgagaaattcaattattcaaaatctttgatccctccaaataaaaatttttattattagcattgcttaatgatcattggtgtttaattgattcccaattaattatctccaatttgcaggtggtccgttgctgcacaatggtggccctcttctgcatccgttttggccatcgtgccgatcgcattcaccccgaggcgctccgagtgccattggtgttaccaattgtctatttttttgtgtgtctttcgcttgtcgtggttactgtcgtcagaaatttcaagtcggcttttgaccttactatatttcctaatcttaggaaatacggtaattggggggggcattttttggtaattttcttcacaggtcggcaatgattggactttcgttccaggcctttggcctcttcgtttatttggttttcatttggccgccagcgataagccgcttctccaactaccgtaatgtggcacatcagatcaacagtatgcaaagggagactttgaaaattgaatttctgttgaaaaaggcaaaatgtccgccgtcgctcaaattgtttttgacggtgccatcgaagtgaaagatcggcgacaaaatgaggacggactgttcagtctgatgactgatggggacaacgactatttggcgtcaactcacaaagaaaacagcatcagc

SEQ ID NO: 63188 - DNA, 1095 bp, Heterodera glycines
  Genomic contig location: Contig_ID=SeqID_6878; Location=3723..4817; Strand=+
  SCN-specific regions: Sequence locations=1-378,443-504,602-658,782 -832,860-1058,1080-1095
  Gene Ontology: Mol. function=structural constituent of cytoskeleton; Cellular component=insoluble fraction; Biological process=epidermal differentiation
gtataaaaggcgcgcgaagagatggcaaagcatcacaaagcatttattcgcttctcctctcaaaaggacactcaacggttagtcaactccactttttcctccagtttaagtttaatttagcaacatcttctctaaactctctgaacaacaatgatcgccacaactcggtgtgtagtgcttcttttggtcggcgccaccatggcggacgccttcctctcggcatttgagtaagttgcacaacccaagcaattaatgccaatatataaagcatggtctgatcagaatggcctgatcaggtgataatatgggtatttagcaacatttcatttagtgttgcacccggcgcactgcgcgaccgacgccaatgcggttgcggatgcggcggaggcgggggcggcggaggttgcggcggaggatgctccagcggtggcggcgggggcggggccgtccaattagcggtcagctgcggtgctgcacaacaggcggcaccagcctcttccggatgcggatgcagcagcggttgtggcggaggatgcgggggcggatgcagcagcagctgtggcggaggatgcggaggcggtggcggtggcggtggaggcggttccgttcagctcacgatcagctgcggtgctgcacaacaggcagcaccagcctcttccggctgcggcggaggatgcggtggcggttgcggcggagggtgcggtggcggatgcggcggtggttgcggaggcggctgcggtggaggcggaggatgcggcggtggtggcagcagcggtggcggatcagtccaactcgcggtcagttgcggcgctgcacaacaggcggcctcttccggctgtggaggcggtggcggtggcggatgcggttgtggatgtggacgtcgaaagcgcatggccatgcgtcgtcgctgtgttcgcgcgctcggacgcttttgaattggaaaagaataacaaaaaatgcctagattttaacgctttttaattgaatgctttcgccgaaatccatttctagctaattagccctaattaatgttagttattataataatgcgtagacgcaattatttattgcctctaattttcataaatttggtga

SEQ ID NO: 63189 - DNA, 79 bp, Heterodera glycines
  Genomic contig location: Contig_ID=SeqID_6879; Location=778..856; Strand=+
  SCN-specific regions: Sequence locations=1-79
gttgaacaatttgagcctttattctcgcaaaaaatgaaactatttttcggggagtgacgacggcaaaagtgcagtccta

SEQ ID NO: 63190 - DNA, 47 bp, Heterodera glycines
  Genomic contig location: Contig_ID=SeqID_32982; Location=1003..1049; Strand=+
  SCN-specific regions: Sequence locations=1-47
acatggttaagacctcaaaatcactgtgtgattggagattctgaggg

SEQ ID NO: 63191 - DNA, 830 bp, Heterodera glycines
  Genomic contig location: Contig_ID=SeqID_32983; Location=26..855; Strand=+
  SCN-specific regions: Sequence locations=1-192,216-358,380-830
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcgggggactgccccgaaaacaaaaaaatcgattttttcaa

SEQ ID NO: 63192 - DNA, 138 bp, Heterodera glycines
  Genomic contig location: Contig_ID=SeqID_32984; Location=170..307; Strand=+
  SCN-specific regions: Sequence locations=1-138
cttttcacattgcccggagttgttgaacgcttctttccccgtcctgaagaagctcacatggtcaaagccgtcagagaagtgctcacaaaaagttggagcatcggagaaggggacgaagaagcggaggaaataataaaa

SEQ ID NO: 63193 - DNA, 60 bp, Heterodera glycines; identical to SEQ ID NO: 52045
  Genomic contig location: Contig_ID=SeqID_32985; Location=239..298; Strand=-
  SCN-specific regions: Sequence locations=1-60

SEQ ID NO: 63194 - DNA, 413 bp, Heterodera glycines
  Genomic contig location: Contig_ID=SeqID_32986; Location=163..575; Strand=-
  SCN-specific regions: Sequence locations=1-51,74-413
atggacttggggacaattgtaagtgttggtgttattgtagcacattcgcatagtcaattaattaaacactattaaaatttgctgtctctgcttgtattgttgtgctgtttttcaggaacaaaacatcaaagaccaccgctacacaacgattgccgccttcagaagagacattgatcaggtgaaaagggctaatcaaaaaaaggaaggaggaatgatccatttctccgatcttcatcagattctgatcaacagtcgcatcttcaacggtccccagtccgcctactcattgaaagccgaagaaattgtggagctgaccaaccaactgctgaacaactcgcaaaggcatttggccgagttggagacgaacattcaaaaggcattgacagtgagcacaaatgaggaggagaaaattg

SEQ ID NO: 63195 - DNA, 150 bp, Heterodera glycines
  Genomic contig location: Contig_ID=SeqID_32991; Location=285..434; Strand=+
  SCN-specific regions: Sequence locations=1-150
  Gene Ontology: Biological process=embryogenesis and morphogenesis
atgaaaattgtggcaattggctgtgctccgaccagcatcggatttgcttatcgccttcagcagctgaaagccgacggaattgaagaggcggcggacattgaacttttggtgttggagcaaaatccgacgcccggaggcctttcatgcaca

SEQ ID NO: 63196 - DNA, 1125 bp, Heterodera glycines
  Genomic contig location: Contig_ID=SeqID_6880; Location=122..1246; Strand=-
  SCN-specific regions: Sequence locations=1-382,411-464,486-791,813 -867,889-1125
atgggggacggattttcttcatcgaaaatggggcaaaacgcctggccgtttgttcgcctaaaaatgataatttttgagaaattgttttttcaccctttcggattttcatttcttggattgccattggtgtggacggactcattattcgttccttgcatatgatggtggtttaggctgaagccaagggagttccgcgtgtgcgcaatcaggggacagcccgcgcgttacattgacccggtgacgcggctgccgtacgcggacatggacgcgttccgtgtactgcgcgagaagtaccaccaattcttggagacggaccatgaccatcttcaacagagacagcaacaacagcggaagaagtcggcggcaaatgattaaattggtcgttatttgattttttaaaaaagaaaatgccatctttttttattcgttcgtcgtcgtccgtccattcatgtttgaacaattgcataaaacattcaatctgacaaggccgtagccagacccttggttttggagggcttatgaactttaatcaaatcaatgaaaagaatgtcaaaattcgtagaaatggacggaaaattgagatgagaaaaggaaaatatccagcaatacaatttatgtacaaagcttttgaatgggaaaagcgaaatgaaaagcaaatataaaaaaacagcgaaaaaatacatgcggaatatgttatgaattttccacttctacttctttcacacagaaatcaattgccaatgtcattttgtcctcacttttgtcgtaaaatcctttgctcgggtccatcatattcttaatttttccatattttggcataaagactgctaccacctaccgaaaaatttctgaagccaattcccaatttgtgcttttcattgtttaaaaatttcctattcatttcgtgcttccaatcttctttacagaatagtcgagaaacaattcgaaaagttgccgaacatttgcagctccaattaacttaatgtacagcgatggaaaaagtattgactcaagacgataaatttgttaaattaaaattcctctaggaatttttatttttattttccaaattcaagccatttgtgactttccaggtcaccatgaaggattgatcatgtcaataaa

SEQ ID NO: 63197 - DNA, 735 bp, Heterodera glycines
  Genomic contig location: Contig_ID=SeqID_6882; Location=1197..1931; Strand=+
  SCN-specific regions: Sequence locations=1-467,563-595,640-735
atgagagcaggagcagaactccaattaggaaagccgcacaatcatgccccttctccaacacgatgtgaagccgctcagatcaacagaagcgtgcgcaacacagcattgtcatcacgtggaaatatgccacgcacagttgtgaatggagagccgtgccgactttaccccgctccatttggcatccgaggagggccatttgcagatggccgcactgttgacggagaacggatcagaggtgattaaggattgtgattagattgggaggcattctttttgtgtattttgtaatgcttttgagagtctctgtctcgagtctcggctcgagaaaagtctcggatttttcttttgtctcgggctcgagtctcaggaaattatcggtcacgaatagcactagtatttggcaacttaatgaatgccatttgcaacaatttcagttcgtcatttattttatttttttgtcagaaaaattttaatttaaattttaatttaaattttgtttttttgggttttttatttttataaaattacatcaatttttattctcatatttttaaattcatttcaatcattcagttcaatttcatccgtaatttccaaatatttcatttataaattatttttacgaaattttttttaattgacatttggtggaagaggttcaaaaaaataatgccaaactactagagaccggcatcatagaaaccggcatcatcgatttatcggtcgaagttttca

SEQ ID NO: 63198 - DNA, 179 bp, Heterodera glycines
  Genomic contig location: Contig_ID=SeqID_32992; Location=791..969; Strand=-
  SCN-specific regions: Sequence locations=1-179
tattcgaagcgccgagtgccattgcggtcaactacgtcgtcgtttgtcatcgggcatcgcgtcgcaacatcgaggtcgttgagcgggagaatgaacggacgggcgagtggctgacgctgcgttggcgtgtgcccgtggaggctgtggttgtacgccagcggagcggcacggatcggcgc

SEQ ID NO: 63199 - DNA, 996 bp, Heterodera glycines; identical to SEQ ID NO: 32995
  misc_feature (861)..(861): n is a, c, g, or t
  misc_feature (927)..(927): n is a, c, g, or t
  misc_feature (931)..(931): n is a, c, g, or t
  misc_feature (933)..(934): n is a, c, g, or t
  Genomic contig location: Contig_ID=SeqID_32995; Location=1..996; Strand=+
  SCN-specific regions: Sequence locations=1-41,73-389,411-702,724 -806,854-996

SEQ ID NO: 63200 - DNA, 56 bp, Heterodera glycines; identical to SEQ ID NO: 52733
  Genomic contig location: Contig_ID=SeqID_33001; Location=188..243; Strand=+
  SCN-specific regions: Sequence locations=1-56

SEQ ID NO: 63201 - DNA, 426 bp, Heterodera glycines
  Genomic contig location: Contig_ID=SeqID_6883; Location=2413..2838; Strand=-
  SCN-specific regions: Sequence locations=1-326,348-426
atggttgctaaaacacgaggatggccccgttggaaattttatgattatttacacagtcgtcgtggacaacatggacaatttcggcacgacacaattagactcatgcaacaaattgaagccccaatgaatctggagggttacgacgccgacactttcttcctagagttttggatatttggaacaacagccaacaacattatcgttttgctgtgtttatttttggttcgtctggtcaatacaaaccagggctggacgtaattacggattacgtattacggattacggaaattacggcctttttggagttacggattacggattatgggttacggatttttgggatttttccgtaattttgatccgtaactggctttttagattatttttcgagacgatttcttgcaagattattttttataaaataaa

SEQ ID NO: 63202 - DNA, 1374 bp, Heterodera glycines
  Genomic contig location: Contig_ID=SeqID_6884; Location=2711..4084; Strand=-
  SCN-specific regions: Sequence locations=1-216,239-471,493-561,584 -600,623-703,727-744,766-1374
cagctgaagatttattcggaactttacgatcacatctgaacaatttgccccaaattacgtttgataaaagctctaataattctgcattcgaatggatgcaaaaagatggaattgcgattttatgtaacgaaaaaatgggcgaaatttccgaaaaaatccaagaaaataaattaaatgaacaattattttttgtcgtgaaaagcgcagaaaaaaaccgaaaacatttttgttcaatgttcaaagatggcaaaagcattaagctgatagcgcacaataatttggtgaataaggcaaaaaaatttgtgcaaattttggaaaatattccacctcaattaatggaaaagtttggaaaaattgcggaaaacgatgcacttttcaatgaggggaataaacaggaaattgccaaaataattggcacattttctaatgggctcaacttcttccgcaaatttgttgcaggttggtctcccgtttttggcacatttaattatttcccgggagtttttgtggtcactgaccacggatatgacatatattttaacaattccgacttcctaacccaatttaaaaaaaaaaaaattatgtcaaaaacgagaaatttcaattagacttttgtacaagttcgggttcgagtttaaaaattgatcaaaatagattttagaatcgtgatcagagaccacagaaaaatcctcaagaaacaaacatttttaataagttcaattaaattaaactaaaaggatccacctttagtttttaataaaattcaaaaccggggtaactttgataataaatagcgccgttatttttatttattttttgtagtagggtaatgagttgctttggaaaattttcatctaaccaaccctagtttcaagaaaactatgcccctttttaggaaattctgatcgttgcttgactgatcagctgcagacaagcaacaccgcctccatcatcacgctgctgaagaagccccatgggatggcacgacgaaaacggcgattttccaccatgaattttctcaaatgtgtcgttagcattgtgattggttccctgacaggagtatttgccgttatatttggtttttatttgttccaacatgtttttctagtttttctatgcaatatccatttcaattttggtcgtgggcttgtaatgttcctttggatcttttgcatcttaagttttgtagtgtgtttttttctattctactctaattgctttagtttcgcgtaattgaaaccaattaacagtcaatagtgtaattagttatttaatgtctatcaattagatttttttgaacaactaattattatctaaaattggactctctttttttctttttttgtttgtaatttaatcaaatgtataaataaa

SEQ ID NO: 63203 - DNA, 424 bp, Heterodera glycines
  Genomic contig location: Contig_ID=SeqID_33004; Location=355..778; Strand=-
  SCN-specific regions: Sequence locations=1-124,146-376,398-424
atgattttgcgttccggcattgctaagggtgttcgtgtggttcgcaatgacgacagaacgccgaaggcggctgtggtgttggacagtaagtttcgggaagtgtcgcgggtgctgacaatgataaactaaagccaaaccacaaccatttttagccaaagttgcggcgttcttcgagtcaaagaatttggtggacactgtcatggaaatactgccgcagcgtcgcaaaggcgggcgtccgtcgatgcgcgacttcactcccaaggactggtccgaggtcgaaacggtgatcaaagatgttcgcgtcgaggtttcgtctgttttgggttatggtgattcatacaatgggataaccaaaggtctaaaaaagcttactactcaaaaaaggcctcgggatcttggactctcaaaaaattttattttttga

SEQ ID NO: 63204 - DNA, 178 bp, Heterodera glycines
  Genomic contig location: Contig_ID=SeqID_33009; Location=745..922; Strand=-
  SCN-specific regions: Sequence locations=1-178
tattaaaaaataataggatttggaataagtaaaattgtaaaaatgagcgaatgttaattaaacctaacttatgccaagtggcgagggatccctcaggcttagtttttagaatcttattttttaaaaaagcacatttttctatttttgggttggggcccaaacgaccccggggcccaaa

SEQ ID NO: 63205 - DNA, 1848 bp, Heterodera glycines
  Genomic contig location: Contig_ID=SeqID_6887; Location=1..1848; Strand=+
  SCN-specific regions: Sequence locations=1-435,457-489,576-727,750 -802,824-1415,1437-1848
  Gene Ontology: Mol. function=protein binding; Cellular component =membrane; Biological process=signal transduction
cctaattaaacccatttttaattacctaattaggtctgacgagtgcccaagcagtggccaattgtgcacacaatccgatggtctcttgtaattgataaaataaacctaaattatttcttttgcccgtcatttaaggttctcactgctgtcaggatgcgatgcagggttttggattttgaataaatttttgatcaaatttcattcatgttaatccccccacagggatccccgtgagtcacatcaaagcaaagtcgggccattgtcctccgccaattggcatttccacgctgcaggacggaaacgtcggctgttggctggacaccaactgtcccggcattcagaagtgctgtctcgagccgaaccccggctcacacgtggccgcacgccgaatttgccgggacccggaaggcgtcagcagtcagttgagcgcgaggcgaacttgggggttgggggagggctaatccgcatagagataacggacaaacaattagagagagagacgtgagaaaagtagcgagagagagaaaaaggtagagagagagagaaaggtaaagagagagggagagagagagagacccaaatggaaaagataatttagataaattaggacagagaacatatgaacgggattttataattgaagcctgaaatgcccaagcttcgtgacctgtctcggcatgggttgggctctatcccggccgaccacagtgggaatgaaaagttggacggctccattttcagaaggctcttcaaaaattcataaccatggtaccaaaaaagctttctatcctcatttaggtccatacatttttaaaaatttgaaagttaagcataattgtttttctggacaaaattacattcgtaaaacattgcctcaggtgaatcgatttgcacacttccactgggtaattatcgtgagcaattattgtttctatcattagtgctttgtttagtggtcggcacttgtacagctttcgtcactcgctattattttgatgccagctcgggcaaatgcaaaccattccaggtgttttttgatacaaacctgctcgagagtcaaattttcgagaatcgtttaaatattatggagactcgaacagctcaagcgtatccatcaactaccgtatccctgattatccttatcacccattacagtactctggctgtggtggcaatgagaacaatttccaatcaatccaatcgtgccattccacatgtggtcttctgggtaattcctattatttcaatttttgcccctcaatttgtcaccatttttagggataaaagggaccccgtcttgtccgggcgaggccaacgcggaactgaactgtttgttgccgcacgcggacgcatgccacacagactcggtaagctaactaattgcaagttaattagaggcagccgattttgatgccttttgaattctttccatttttcaataactttttactaaaattggttcattagtggaggtgtaagtgtcgtgaatttgtttactgtttgaccggaattgccaatgggcgggagatctgaatagcttaattcttggggtttttttgggtccctgatcttaaaactgacatctattttgaccaatttctaatccctaactcgaacaaaagtcgaaatgcaagtttttcaatttatgaacttttttattcgaattttaggttaggaaatcggaattgtcaaatacataggtttagtatgatcaggcacccaaaaaatgtttcgttatttagctgtgctgtgttaattgaaacaattaaggattgtatgggaagagacggcgggcaacagccggtaagcttaaaaagtcaaattgactgacttttgaaaaatttgaag

SEQ ID NO: 63206 - DNA, 233 bp, Heterodera glycines
  Genomic contig location: Contig_ID=SeqID_33014; Location=393..625; Strand=+
  SCN-specific regions: Sequence locations=1-233
atgctcgtcgactctctccgtcccgccactctttcgtcctccaaaaaacgttcagcgcattccatggacgacaccgaccaattcattgaccacagtcccccgcacaaaaaacaactaatggacgaggaaaatgaccaaattttgacacaaaatacaccaaatgattcattggaccggcggaggccaattgcctttgccacaaaagcaattcacgcggggaatcggccagaaca

SEQ ID NO: 63207 - DNA, 630 bp, Heterodera glycines
  Genomic contig location: Contig_ID=SeqID_33016; Location=189..818; Strand=+
  SCN-specific regions: Sequence locations=1-92,128-151,175-324,346-630
atggaaaatgctgcgaccggtggaaagagagtcccccgtttctctcacagcgcggggacagagggcgccgagggggagaaggagccccaggcggaggagccgccctccgccggcaccgccggcgccgatagacctgccgaagaccattccctgctgctcgcccagctgctcgccgccttcgccctgttcggtcttgtcactgcgctgctcttccaattgcccgccttccgcgtgcgaagtcgcattggcacggacggacccgtgccaatccatcagttggacccgcaaatggccgaatgtgcgaagacatgcaggtagattagcagaaaagaggaggggaagagaattaccgtaacaccactctcagaatcgaattggtcgagagcattccccaaaacgtgtcttttcacctttccctcggcaattcgcccgctttggccatcccaacattctccgcttggatgcaactgatcagcgaggccaaacattcgctggccattgcggcttataagacgagtcttcgcggtgagccaacggcggagggagcgaaaattcggtgcaattttagggaaacacgtgctgggggaggaccaaggcaattactcgacccaaggagagacggttttcgat

SEQ ID NO: 63208 - DNA, 130 bp, Heterodera glycines
  Genomic contig location: Contig_ID=SeqID_33017; Location=427..556; Strand=+
  SCN-specific regions: Sequence locations=1-130
atgtattgcttctcaaaggttattagcattaataataccattccatttcactaatggatttgcgtgtcccgtaatgaattccatttaatattttttgcagaatttcatgataatcatactcaaaaattaa

SEQ ID NO: 63209 - DNA, 327 bp, Heterodera glycines
  Genomic contig location: Contig_ID=SeqID_33019; Location=117..443; Strand=-
  SCN-specific regions: Sequence locations=1-327
atgaaacatttctcccgcgctttccttctcttttgtcttatttttgtcgtcgcattaaactcttttaacgaagcggtaaattcaaagaaaaataataatttattctctaattttctgaatttttaagtttttccatcttttttttgtcagagtttaatcatcgacgaatgcaaaagtgtgtgcccaaagacgaacaataaatgcgcgacggattgtgtgaaatgcgcgagtggcaagtgcaaaaaagaatgcaaaaagccagcggcaccaaagtgcgcggagtgcggaaagaaagcggtgaatgaatgtaaagcgatgggaaagtga

SEQ ID NO: 63210 - DNA, 87 bp, Heterodera glycines
  Genomic contig location: Contig_ID=SeqID_33020; Location=351..437; Strand=-
  SCN-specific regions: Sequence locations=1-87
aaattcacggcttttttcccggttgtcccagccaaaaagtcccggtcccggtcttgcccaaatttcccggtaccgctgcactctagt

SEQ ID NO: 63211 - DNA, 59 bp, Heterodera glycines
  Genomic contig location: Contig_ID=SeqID_33021; Location=65..123; Strand=-
  SCN-specific regions: Sequence locations=1-59
tctaagattatttggcagcacatcattctggtaccttctgttactgctcgaactctgcg

SEQ ID NO: 63212 - DNA, 826 bp, Heterodera glycines
  Genomic contig location: Contig_ID=SeqID_878; Location=56..881; Strand=-
  SCN-specific regions: Sequence locations=1-88,136-191,216-275,297 -324,346-363,386-480,558-590,640-685,713-713,735-742,764-826
atggactggttaaatgtgtgggaaaaatgtgtaaggacagcgcatagtccaatcaatcaatggcaagcagtacggcataatgggtgccaaaaaattaataaattaaaactattaatataataaaaacaaaatttagtttaggtttgaggttgtccgagaaaatgaggctggagagatgaaaaaattgcaacaaaaaaaaaaaataaataaaaatacaatacctaaacactaatattaaatcattttcataattcaaattttgttaataaattggattttatttaaaagttttccaataaaataataaaaaggcttggatctgcttacatttatttcttcataattaattactttatttgactcaaaaacaatttatttcaaaataaatgattcgaaaaatgattctctatttgccattcctattcggtattattttcttctatttggaaattttgaagcctaattaatacaaaagtacacattaatattgtatattttaaaatgaattttttgataaaattttatataatgaaatttctaataatttaatttattttcagcatttaagtcttttgtcttattagtgtgacttttattagttaaatattattattagtattattgtataaaattataaaagaacaaaaggttgaacgttattcgtagagatcgacattttgaaaaatgcctggacctggacctggacctggattccatgttggacctggacctggatttcctggacaaaaatccaggaaaatccaggtccaggaaaaatccaggctcctcgagacctggatccaggcctggacctggatttttttaa

SEQ ID NO: 63213 - DNA, 230 bp, Heterodera glycines
  Genomic contig location: Contig_ID=SeqID_878; Location=4500..4729; Strand=+
  SCN-specific regions: Sequence locations=1-71,95-230
cgctggggccgacttcacgcggtgcgcactgtccttggtttaattgccactggcgtttatttatacgcagtaagcaaagaataaaaggagaaaggaactttaaatccgacaacataacataaaatgacatattttttaatgtcaattttgcatattcacaaatttgtgtgcgtacactttcaatcacatttgtatatttgcactttattacataaaaacattaaagcgtt

SEQ ID NO: 63214 - DNA, 722 bp, Heterodera glycines
  Genomic contig location: Contig_ID=SeqID_878; Location=2245..2966; Strand=-
  SCN-specific regions: Sequence locations=1-176,226-381,475-487,510 -602,624-722
atgaatggattcgtttggcaccactttgttttgggagctgttctcctaatcagcaattgcgctgattgtctcagaaacgttgattggacaaccggcaagcagctgaacagtgaagagctaaaaaaagcgccgatcgtaatttcggacggaggtgaaatgtgagtctgataagtaagaaaaataaaatttaaaaaaaacaaattaaaatattaattgtttatttatcatcaagttttgctaattagtgtcttgcaagtgggcttgatcaacaacattgtgcccaatccaatcacgttgtatttcaacaccaccctggacattgataatcgccatttgaaaatgagtgtgtgccgagttggagaatgtgcggccaaagcgatgtattatttattataagtcattaaaacaataataataaatataaatattaaaatttgataattcaaatataattaaaaatatattcaaaaaaatgtattagaattacgttttgttttcttggacaaatggacccggcaaatgcacgactgaattcgcagtatcacatggaaaattatgaggaggacaataaaattgcgaccaaatgcaaaatggcacagcaaacaaaatgggcaaaacattttgaacaggacaaagtgctgcacggctttcaaattgtaatgagtgaaacggatgaggaaaaagttatggatttgtacacatcgacacaccaagaaaagtaa

SEQ ID NO: 63215 - DNA, 1823 bp, Heterodera glycines
  Genomic contig location: Contig_ID=SeqID_879; Location=1299..3121; Strand=+
  SCN-specific regions: Sequence locations=1-9,31-178,208-249,289 -436,463-661,848-856,968-1011,1068-1122,1146-1184,1216-1233,1255 -1294,1316-1323,1388-1823
atgaaatgcaaaaaaggcactgtcctcgacactcttgacttagggatgaacccaaaaatgaacattagtgttgaagaatgcaaagccggctatgaatattgtgcagcttttacatgcacaaaaggtacttagtcaatcaggcatttcagttgagtgaaatttgtacataagacgctggaatttaaatgtaattaaaattaattaaatgccgtttaaatgtatttggaataatattagacttttagatggaattaaattaattaaatgcatttaaatatatataatattcggctgacctatatcactaatatttaacaattgatttaatcaagtttattattcgcattttacagctggtcgggcaggcttttcacgaatccaatggtattgtgccaggatcaaatcccctccttatgagtgtgccgagcggttcacaaagttggtggaagaatacatcacacattccaatggccattggtgcgaatgccatttcggggaaatgggcaaagagatggacaatgaacaatttgtgcttccgcccatccctgatgggatgatgtgcaaagtgggacagtttgatgagaacgaaattggccaagtgtcggaggggaaatgcctgcacgacgaccattactgttacattgccaaatgcacaaaaggtgagagagagagagagagagagagagggagagagaaaaagagatgagagtgagagtgagggagaggcgagagagagagagagagaaacagagatgagagtgagggagaggagagagggagagatgaagtagggagagagagaaggggagagatagagtgatgtaagagagagagagagagagagagaaggaatgatagagagagagagagagttagagagagagagagtaagagacgagaaagcgaaagggagagagtgtgagagacagcgagatgagtgatagagatggagagagatagagagagatgaggaaaggaaaggtgagggcgtgagagcgtgatgtaagggatagagagtgagaaagaaaagagagataaagagagaagaaacatgagagagagagagataatgaggctaatcatttttggaaaaaaatatgaatcgtttcataatttcgccactttattatattattattaaattacctatcttcaaaatactgaaaaatgtaaaaagtttcgccaaattaataaaaaaaaagatttaaaaaaaaagaattctagcaaagtgaaattttctgtacattataattactacaaaggatgctccaaaaaaaatatatgtaaaatgaattcttggtaaaagtatgaaaattgatggtcatatttttaaaaaaaaaacaatgagttatttttttaaatattttaaatttttattttaaatttacgacatgtgaaaatcccgcaaaaaatatgcacacggttttatgcaaattgcatttgtttttgtttttttcattttttaatccatgccattcccgccaaatgctctttagacaatgaatatttcaaaacggtgtgggattgcactgatcgccccaaacgtgatcacatcactgatcaaatcgggcaaaaggccagtgttacgttgtactgtgacgcaatgtttggcaagaagaacatggccatgtccaatgaacatttcacaattgaaaagctggaagagcacgtggaaatgatgaacatgatgacgacaaagaggcgacgacgtcggaaaaaaagcacaacaatcacaacgccaagcaccgatttggcaaccaccacaatgcctactgtaacggagcaaactgtgccagctactgttgaggaggcgacagtcacgg

SEQ ID NO: 63216 - DNA, 1297 bp, Heterodera glycines
  Genomic contig location: Contig_ID=SeqID_880; Location=840..2136; Strand=-
  SCN-specific regions: Sequence locations=1-348,453-805,827-846,874 -940,967-1046,1077-1081,1160-1228,1251-1254,1283-1297
atggacccaaccgtggcgacaaagggtggccgtttcagtcttgaaaattacaagcaaaaaaattcaattgcgacgagttgtgagcaacagctgcaacaatcgggtggaagtgaaacattggcgatagggaaggtgctgcacggcttcaacatcgcatttgcggaggacaagctgttgttgacgtcatcgaccagccagaaaaggtatacggtaaagtcgactgtaattgacagtattttcagtaatagtgaaagaaaatgatggtcagagatgaagcaatatttaaatgaatataatctcatattcatataaataaattaatgctaatcgattttaaatgcttcaatgtatttttaattgtaaattaatcataaaaaatagtgtaattttatatagaaaataataacgatgattgaatattaaatttcaaaaaaaaatattaatttatttttgagtcctactccttgacacgattccgctaattaaccatcattgttaatttattaagcccgtcatatgccattcgcaatgcgcaacaatgctttgacattcatctcgggagtgagaagaatttggacgggtttctgaaggattacacggacaataaaaagcttgaaaaggataacgacttcttcaccgaattgagctatgacattttgtccggcattccgcaaaaaggcggcaaaattggcattattgcggcgggtggcgcgtgtaacatcaaaatcattctggtaccatgggcaaagtacttggtcattgattcggatttacaatggcaccatttgataataatgacatggcaatggaacggaacttttttgttgccatgggctaatgaccatggaattttttaaaattatttttgctattattgtaaattgattttggtacggaattttaacaatcctcatcccaaaaatttctatatgttttcacttttgcaattttaaaattacattttcactaaaaccccgtcattagaggcttaattggcgtagagcactaagtctatgtagacttagtgggtctatctttctaattcggaaaaggaaatttaaaaaatatatattcttgcatgttttttaaatcaaaatttaaaaaatcatttaaaaagaaaagaaattttattttgattaaaatgtatttaattaatattcaggaaggcgatggattgggcaaatgttttgacaatcaatgtgcctaaagcaatgtgtaaacaagccattaagagaaggaagaacgaaagaatcaaaaagaaatttatttttctaaaataatgcaaatatttaataaa

SEQ ID NO: 63217 - DNA, 927 bp, Heterodera glycines
  Genomic contig location: Contig_ID=SeqID_881; Location=529..1455; Strand=-
  SCN-specific regions: Sequence locations=1-6,28-629,651-699,728-927
atgtcaatttacaattttttcttgttgttttcgtcattgcttgttgttgttctgcagcaatgttcggcagcaaatgccacggacaaaaacaatgaagaaaatgtaacgaaaggtgattaaaagatattaattagtcaggcctatagagtgtctcattactacaataagaaatgggcaaaatatgttaggcatcgggtgggaatcgaacccacactgtcccggtttatctcagttggtccccagcatgtttttggctataacttttttatttgccaaccaaatccagccaatcgtggtatcattcgatagccctaggtgtcctatattatcctgaaaaatttcaaaagtttgaacaaagttatggcaaaaaatatttgagcactcagttttttgaatttttctggccataactttgtacaaacataacataatttttgaaatttttcagaccaatagagtagggctatcaattgaaaccaagatttgcttgattttgtttgcaaagaaaaaagttatagccaaaaacaacatttatgatgcaaaatgttcttaacaaaattcattgaaaattctaaacttttttcccagcggtgcctaaggcgccgtcgccccacaaaattctcctaaaattttaaaaaattgaatttaattgcttttttcatttgcaataatttttccaaaaacctagtttttgacaccaaattttaattttgaaaatttatttttagcaatttcttccggcaaaattgtgccaaaatctgatgccattgtccactcggggcctgttattgaaagtgtgtttgctgcggagccggtgaagaaatggacaaattggcaaaatgggaagcaattggaagtgaaggaggccatggaaatgccattggtgataaacccggatgggcgagtgtaagacaaaatagaaataaa

SEQ ID NO: 63218 - DNA, 554 bp, Heterodera glycines
  Genomic contig location: Contig_ID=SeqID_881; Location=2395..2948; Strand=+
  SCN-specific regions: Sequence locations=1-554
atgataccattttgtctgggttggtttgacacttttaaaagataggagctttttttgcgggaagtagcagcctaagtaattcttatcatttaaatagctctgaaattttccaattcaagttttaactaccaaaagcttttcggtgaagggttcagaagttccggcaaataattttaaatttctgaattttaatctcaatttaaatgagtgatctggatagctgatcaatttaacgaggcaaataatgcccggcacgtagttttcgtgcttttttaactttacaagtcatttgtgggatttacttgaaatttcttaatcaaattgggaaaaaaacagcaggcctctctaattttcctgtccttgcagagctaggacttgaagtcatgaggccaacaccacttatgtgtcgactggcccttctttttcagtttttttaattaaaaaggagagattttatatctctgtaagataatgataatccatttatgcatttattaagatttatttaaaattttcaacttgtggcactttcaagatcatttgtctgttacata

SEQ ID NO: 63219 - DNA, 1153 bp, Heterodera glycines
  Genomic contig location: Contig_ID=SeqID_6890; Location=763..1915; Strand=-
  SCN-specific regions: Sequence locations=1-56,79-100,413-510,533 -650,837-863,1053-1153
  Gene Ontology: Mol. function=cytoskeletal protein binding; Cellular component=cell-cell adherens junction; Biological process =intercellular junction assembly and/or maintenance
ctaaaacaattgacctcgctgatccaacggaaggcggaagagcagaaaaatagtctggaagaaggagggaacgaaagaagggaagagaagaggacaaatgaggagaaagaaaaggaggaggataaaaggagaaaagaagaacgagagcagcagaaggaggagcaacaacaacatcaacagcggaagataacggaggaagagagagaaagagagaagaaggaggaagaggaaaagggaggggaggaaaggaagagagggacaacgaggagcaagaccaattcggaagtgagcagcggcgcaaagaggagggaagaagccgttgggagagtggaggaaggagaagaagcgggggaagggaaggaaggaaaaacgtgggacggaagaggcggggacgacgaggcggagaggaaggcgcgcgacttggagcagttggccatttaccgatcccgagtcaggcagcagctgaaccggaagctgacggcacttttggagagagtgatcagacgtatggacaaatgccatttgaacctttcccccattggagggaccgccgagtttagccaaaagggatggccatggaagaaaatgaattgggaagaaattcaccggagggccgaagcgaggggagaagaatggatgatgccaacaatggcaaagggaagaggaaggaagcgaaagagtggaagggaagaggacgaggggaaggaggaggaagttagtgtggggaggagggcgggagagaaaaagcgagtgaatggagaaagaagtgtgagagatacgaaaagggagagaaaagtgaagaaacgaaactcggaagaaaaacatggagaagaagatcagacgaaaaagagagtcacacgtaagagaaggggaagagaagaggacggagagacagagaaacagacaaagagaatgcatgacgaaagaggagggcaggaagagaaacgagaggagcccaaaaaggaagagaagcaggagaaaaacattcaggaggaacgcagagagcggaatgagaagcgagaggaagcgggcgaaagggaagagaagcagaacacacccccaatcattttgcggattcgcccaccgacggcaaagccaacggcactaacaacgatcaaacgaatgactgctccaagagcagcaacgggcaaaa

SEQ ID NO: 63220 - DNA, 439 bp, Heterodera glycines
  Genomic contig location: Contig_ID=SeqID_33023; Location=389..827; Strand=-
  SCN-specific regions: Sequence locations=1-92,116-156,179-254,279 -335,359-364,386-387
atggttttccatcaagttaggaaatccttgaaaatgtgcaaaaataattataaatgatgatctgatcaggaaaccatttccaatcacaattcttaaataatttaattaaattttactcagtggcgcgggcggtggcgttgagtcttcacgcgggttgaatttctgttgggctgggttcattggtaacacaggttgtaatgctgcaattggatttgatgttgacatagcctgttgaccattcttaaatttttgatgcaattaattaattaattaaacacttttttaacatggtttattttttgattttattttttttggaaaaattttaatgggcgttttttaattaattttttattttggacttaaaaactaatcaaaaagtaatcgataaattaaaaaatgaattatgtaaaattaattaaactaattaaaaaataaa

SEQ ID NO: 63221 - DNA, 878 bp, Heterodera glycines
  Genomic contig location: Contig_ID=SeqID_33028; Location=28..905; Strand=+
  SCN-specific regions: Sequence locations=1-247,269-309,331-485,507 -524,548-878
atgctctgcgctgtcctgctcttctccggccacactctgatcatgatggtcgccactttgactgtcgaccgttacattccgtccgcctttcgtttgctgcgccttttgccgcgtctttttgcactgatcggtgttccatgcatggtgatcagcaggtggggtgccttttactaatcatttgcttaatacggacccaagggatcggctaatgggataatggcacggaaaataacacaatttggctgagaatttcaatgaatttatttggaaatattttttcgtttttaattcttttggagcagtttaaggtgaatgtgtggatttagatgggcaattcgatattttgtgtcttaaactggcatccttttcattggcatttcatccattaattgcttttttcaccaccatttttgccactttcaggacccattacacttgcgacgtggtcattgcctatctgtctacaattgccatattttcgtatgtttttctcgtccattttaatggcaccgatttttcggcaaaaaattttggttttaatttttgagaagaaaaaattgtatattattagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatccatttcgaagtgtttggggtaaaattgtctttttttgataaatcatttctataaattgaaagttccagcagagaacttcgaaatccaatgacgaattaa

SEQ ID NO: 63222 - DNA, 820 bp, Heterodera glycines
  Genomic contig location: Contig_ID=SeqID_33031; Location=47..866; Strand=+
  SCN-specific regions: Sequence locations=1-144,235-241,265-775,801-820
atggcgcaggtaggtgtgtgtgtgggtgtgtcaggtgcagttgcaattgttgttttggtatgtaattgtaggtattcatgcccaaaagataggtaccaaaaagcaaaatacgcataaaaataaggagtttcatatattttttgcaaaaaaaaatgaaaatatggtaaaaagtagaaatgaatatataaaacaaaaatgatcgagaaaactaaaataaaatgaataaaaataaaattttaacaaaaatttattttaatttaaaatccccggcaagtttcgctgggattcaaaaaattttaattgaggcgaaaaagattgacccggaaatcaagaccgatgacgttaataattttctcgaaaaacagaaaacatacacgattcacaggcccataaggaaaagattcccgagactaaagacgataccgagtggcttccataccgattggcagtgcgatttgtgcatatttgaccagttgaaaaagcataacgacggttacaagtatctgttggtatgcatcgacgtgctgagtcgaatgatcttcagtgcaccggccaagtcaaagaagagtgaggacatgattgaggcttttgatcgggtgttcgacaagtcgaaaattatcccgttgaaaatatatagcgacagcggactcgagtttcaggctggaaaaatgaaaaaatattttgaggaaaaatttattatcaaaaatgtgatgtatagccccgaccttcacgccggagtcgtggaaagggcaaatcggacaataaaagagcgtttgtatagatatttttaaaagaaagaactctacgatgggtccaagga

SEQ ID NO: 63223 - DNA, 712 bp, Heterodera glycines
  misc_feature (709)..(709): n is a, c, g, or t
  Genomic contig location: Contig_ID=SeqID_6893; Location=1774..2485; Strand=+
  SCN-specific regions: Sequence locations=1-712
atgaccgaagaggaattgcgcagacgcttgttggtggtcagcattgaacgtagccagccgccagccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgtacttcaaccccaactcgaaatgttgaatttgaacagcaaataggaccattcccgtttgttgttgaccgcaacaacagagcaccaaccccacctttaaacatacggcaacaaattttccaccccatcccactgaatacacaccgcattaaccaaatgtcggttaacgcgcaacgcaacattgacgttcagtacgtaccaaataattgcgttaatgccccgccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatgactttggtttacccccaagaccaacagcaacaagtgctgatcgagcaacctaatttggctcaaatcatcaaaaatcactcgncag

SEQ ID NO: 63224 - DNA, 3851 bp, Heterodera glycines
  misc_feature (14)..(14): n is a, c, g, or t
  Genomic contig location: Contig_ID=SeqID_6894; Location=43..3893; Strand=+
  SCN-specific regions: Sequence locations=1-1012,1034-1109,1131 -1612,1634-1666,1688-3261,3284-3851
atgaccgaagaggnaatgcgtaggcgctgttggtggtcagcattgaacgtagccagccgccagccaacggaaatgccggaaatggagaaaacgccgaaggtttgcaaaacgcaatcagggaaaatgatgaacgaccgaattttggagtaaatggtcaaacatttgcccaccaaagtaggccgcatgacactttcttatcaaatttgatgaataatggaataggaaattttcctcaaaatttggtccatgtacagcgcacttcaaccccaactcgaaatgttgaatttgaacagcaaataggaccattcccgtttgttgttgaccgcaacaacagagcaccaacccccacctttaaacatacggcaacaaattttccaccccatcccactgaatgcacaccgcattaaccaagtgtcggttaacgcgcaacgcaacattgacgttcagtacgtaccaaataattgcgttaatgccctccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatgactttggtttacccccaagaccaacagcaacaagtgctgatcgagcaacctaatttggctcaaaatcaacaaaaattcactcgccaggcctttcagattccggaaacgaatcaagagcctagacatttccctacctatccccaaccgaatgttgcgccaagcaacctcgaattcaacttgattttggaaagaattccggatctaaatggaaatgagggtacagattctgtgcgccgctttttcaaaaaatttgatgcatacaccgacggatggccaaacgcgaaacgaatttcggcgttagaaagcaaagtttacaacaaagcagaaagagcttttgaggcagcaaagtcaacgcagccctaccgatacgagcatatccgcaaagatatgattcagcagttggaagaaaccgactcaaagcaactaaatgcttttgatgatcttatgttgggcgttcggagaagacaaaatgagagcattgatgagttggctggaagaatttctcgcctagtaaagagtgcttatccgggtttgaccaacaatttgtgcgacgaatattcgatcaaatttctgatcagatcgatgggaaatcccgatcttgcgttaaatttggaattaatccgcacaccgggaatgactcttgatcattttgtgtcactagcagcaagggctgaatcgacccaacgcgccgcaaaacgattcagtacacacccaaatgatggctttcaacagcgcgagcaacaacccaaatggcgacaaaattttggtggtaactcaagccaaaacatggcgaagggtcaaaattttgctggaaacataaatcagcacccccagcccaaagaagacactagaaatcaatggaaatgttacaattgtgatgaatatggccacctttcacgcaattgttcacgtccaagaacttttatgcaaaatcagccaataaatcagcaaaaaaattttgttgctactggtgcgaaccgaactcaaatccaacccccaaatcagaaccgaaattttcaaacaccaaaaccaaattcagctaatttcctaaagcaaaattgtttggtggtccagcgtgaagaagttttagccgaggcgagggtaaacaaaattgagttggcaccggaagtaagtgaattttatgaaaaattggaacggatcaccgaaagcaaaaatgaaatttttttgccaacaattggaaaggttatgtcgttgaaacttgaagtgtttggcacagaaaccgacgcaatgcttgacggaggcgcacaaatctcattgattagtagtgattttctgcataagttgctgattgagaaagcgattacgctggaaacattggagattttcaaaacgaaaacccaaatttttgacgtaaacggaaaattagtgaaatgtctcggcacgattaaattgcctgtcaatcgtcacggtttttatgaaccggtgaccattcctttgcacatcactaatgccccaattggtttcggtcttttaattggaaccaacgcacttcaggatttgggatttaagttgtatgatgaacgaaataaggcactggttgaattcgaaaaagttgaacctgaaaagaaagattttctgacggtcatttatcggacaataattgaggccggcacagttaagaatttagaattcagcgttaacactgaattcgaaggacaggaaattgtcgttacttcggacgaaacttcagcaattcgtgtagaaccgaccataggaatccccgaaaaaggaaaaattgttgtcccagtgacaaattcatcgtttttgcccattactctgtttgaaaaatcttcgatcggaaaagtcgaacgagtgtactcaatcggtgagactgaaaatttgttaagtagcccaattatctgttccacgaaatatgaacaaaatgctgcccccgaatgttacgagaaattcttcgaaagtttacaagtcagaattggtgaactgaacgaagcgaacgacaaagaagtgcggaaaatgatttgcacttttcctgaaattttcgctttaagcgatgatgacttgaagcagacaaatttagtcgaacaccaaataaataccgcggaaaattcgccagtaaaaatgaaaatgcgcctggtcccatacgcttatcgcgaaaaaatagcagaaatgctccaaaattatttggcaagaggcatcattcgtccgtctatgtctccatgggcaagtcccattgtgattgtcccaaaacgtgatggaacgttacgtttttgtgtggactaccggggcttaaattcgatcacccgaaaagatagtttcccgctcccaaatatcgacaatactcttttaatgcttggaggacgaaaatacttcagcactttagactttatgtccggatattggcagataagaatggatgaaaattccattgaaaaaactgccttttcgactgagtacggtctttacgaatttacagtaatgccatttggtctaaccaatgcagtggcaactttccagcgatttatgtcgcgtctctttgagggaatgattaatggctttctgttcgtttacattgacgatattttaatcgcatctaaatcctttgatgagcatctgaaacaccttgaagcggtcttttctcgagttaaagcagcagaattaaaactaaaatttgaaaagtgtcatttttgcacaaccgaattaccatttttgggccacatcctcacaagggaagggattaaaatggatgcggataagctaaagcctgtgatggatttgcctatgccaacgaccaaaaaacaactccattctttgcttggttttctgacttattatagaaaatttatccattcattcggcacgattgctgctccgcttttcaaattgataagcgaaaaagctgaattcaaaatcggagaacaggaaaaacaagcaatcgaagaattaaagtcaaaaatcattcgagatgttgtgcttcattttccggatttcgatgcagcacagaatgacctaactaggcagtttataatcatgactgatgcgtgtaagaccggcattgcagcaattttatgtcagcctgatccggagaaacagattaggccaatttattttgcctcaagacaatgcaatgtccatgagtcacggctacagtgctaccgaattagaagctttagccgtcagatttggtgtaaaaaagttcgcacaattcatcactatgattccgactcgggtcattacggaccataa

SEQ ID NO: 63225 - DNA, 792 bp, Heterodera glycines
  Genomic contig location: Contig_ID=SeqID_33032; Location=1..792; Strand=+
  SCN-specific regions: Sequence locations=1-194,216-272,294-792
ttctcccttcccctctcctaaaggcttttcgtcggcgtttcgctttgtttgaccttcatttttctcatcgttcacttctttacgctccaccaaacgcttttgtacttttggccatgggctgagtcagtgagtactgtaggctacagtcagtccaccaaataaccgtaaccgcacggatagtcttacggacataattttacaacagcaaattaagttcaatttaaatgaatgatttttttgaggattttctgttctccgcagtttccgctttcgttttcctcgtctgttcattcattgagtcgttttactccacgggggcgtggtaaagaaaagcaatgaaatcgcttaacattcatcagacaaacgatgactcaccaattgccattggcacaggtccaacaattgcaatgacattggcggcgacggagtgattcacaacggatgccgactgatttgggagtgggcattcgccgcggtgagaacaacgaaaggaacagcgaaaggagcaatttttgaatttttgttattttataacaaagcacttgtatcaatcaccacaaaaaagctgatggaacaaaatattaaaattcactcgttttttggggatttttaccgtattttttaaaattacagtaatatttttcattactcctttcccaccgagattcacccccccccccccccacagtttcttctcttcactctgtgcgttttgttcttcaccagtgctttttttgccaagcgacaaaaaacggaagaacgacgcatttatttgcgcgagagaaatgctgg

SEQ ID NO: 63226 - DNA, 70 bp, Heterodera glycines
  Genomic contig location: Contig_ID=SeqID_33035; Location=511..580; Strand=-
  SCN-specific regions: Sequence locations=1-70
gaaggaatttgagcgcacaattcgcacttacaaaagcccatacatcagcttcacctatttccactcacag

SEQ ID NO: 63227 - DNA, 130 bp, Heterodera glycines
  Genomic contig location: Contig_ID=SeqID_33036; Location=48..177; Strand=-
  SCN-specific regions: Sequence locations=1-130
atgtctcccctccgctttcttttggccctttttctgatcactttggccgtcatggccggcaccaacggcttttttgagaactcggtggatggtggaccaaatgtggcatctccccttatccgtgaacgcc

SEQ ID NO: 63228 - DNA, 72 bp, Heterodera glycines
  Genomic contig location: Contig_ID=SeqID_33037; Location=14..85; Strand=+
  SCN-specific regions: Sequence locations=1-72
tgtccgtttgggggtactcaaacaattatgggggagcaaaaatccaacgcagaattaaagtacaggctatag

SEQ ID NO: 63229 - DNA, 1015 bp, Heterodera glycines
  misc_feature (261)..(261): n is a, c, g, or t
  misc_feature (965)..(965): n is a, c, g, or t
  Genomic contig location: Contig_ID=SeqID_33038; Location=157..1171; Strand=-
  SCN-specific regions: Sequence locations=1-46,68-864,887-1015
ccatcaatgggcaccaatcccaagtcaagaacagtcgcgggaagccaccgccgccgccaactccaccgacggtcattaatcagcaaaaagaagtattttacaattgggtggatggccgatttgaattttcccataatcagcaaagtccaccggcgcctccccagcagtttccaccggtgccaaccgcggcgagttcggtagcatctccgcagcaaagacagtcggtgctaacagcggcgagttcggtggcgtctcctcctncctccaccacctcctccgcccccaccgccactattccaatcaaagccaactctgccggacaattcagtgccttccaccactgaatcaaaggcgtctttcgtcgatccgactaacaataaacgttccgaccttctgcaacaaatccaacaaggcaccaaactgaagaaagtgggcccaccatcaactgaacgaacgcccgtgccaacaaacgcaccgactttacgggacaacatgatggaacagattaagcaagggactaccttcaaacatgtaagtttgaaaatgtgccctcataattgtatcaatttcttagtaccaaatggaatttacaggtcgaccagtctgatgtggaaaacagtcgttgttctgctggaggcagtgcccaagaaattggtgtgctcacaggcgcattagccaaagcgttggaggaacaaagcaggcacgcaatgtactcgattgaaaattcggcattggcttcaccaactccctccacttcgatgtcttcaacaactttctcgacttcggctctttcacctgtgaagcttcaatttaagtcgttagacaaagcattgcctacaaatccgtgggaatcgggtaaatgatagaagaaatttggaaattaaaattttaactttatttgggacttgctttgtattactaacaatagtcatatttattcagaattggatgctttcctcgagctntgtggtcagtccgctgttttctcgtggaacgaattcgaagactcgacatg

SEQ ID NO: 63230 - DNA, 1203 bp, Heterodera glycines
  Genomic contig location: Contig_ID=SeqID_6895; Location=170..1372; Strand=+
  SCN-specific regions: Sequence locations=1-552,575-698,722-747,769 -1081,1103-1203
  Gene Ontology: Mol. function=helicase activity; Cellular component =cytoplasm; Biological process=mRNA catabolism, nonsense-mediated
tccgggattgtcacacaacagcattcttcccaaacggattatggtcagttttacctctctacgcaaggcgaacagtcacaaggcgtcccgtcaactgtcgatgcgtcgcagtcgcaaacagagccggacctgaattttcaagacgaggaggaaccgcttgtggacaatctgccgacacacgcttgcaagtgccgtttaccaggggcagacatcgcatcaacttgttaatttgaggtactgcggaattcacgacccttcgtcggtgggacagtgtactgtttgtggcaaatggttctgtaacggaaaaggcaatacggcaggcagtcatttgatcaatcacttggtacgagcccaacataaggaagtttcactgcacaaggactgtcctcttggagaaacccaattggaatgttaccattgcgggtcgaggtgtgccacgtttattttcaatggcttttttcattttaataaattaaggaacattttcattcttggtttcatcccttcgaaaactgattcggtggttgtcattttatgcagacagccatgcgcaacacaaaactctttgaaaaatgccaattggagtgccgaagattggaagccgctcatccaagagcggcaagttctctcctggctgataaaaattccttcacaacaggagcagttgagggctcgtcaaattacggcatccattatcaatcgtttggaggaactttggaaggtgtcgtgttgttctcttcttcgattaaattatgtttttaggacaatcccgaagcgacaattgaagacttggaatgccccggtaaatacacaacggaccctgaccatgtcttattgcgttacgaagatgcaagcatttacaagtactcttttaaaaaacggttttctctatttggagttttcaggcgaatatttaaccctttaatatctctggaagcggaatatgacaaaaaaatgaaagagtccatcagttgtcctgtcggtcaagttaagtgggacgtaaaatcggccaacaaagtgcatgccactttccaactgccaggatttagagatggaagtaggacactttgctccaacacattttacaccaaattcttcaagatatgaaacttatgatcggcgatgacttgcgtctaaagcactatcagacggtcgatgggtcggaatggagttgcatgggacggctgatcaaaataccggaca

SEQ ID NO: 63231 - DNA, 722 bp, Heterodera glycines
  Genomic contig location: Contig_ID=SeqID_33044; Location=1..722; Strand=+
  SCN-specific regions: Sequence locations=1-55,77-141,163-722
  Gene Ontology: Mol. function=3-oxoacid CoA-transferase activity; Biological process=succinyl-CoA metabolism
aaaaattccagattcgaaaattggtttcctcatacgttggcgagaatgaagaatttgcgcgacaatatttgggtggcgaacttgagctggaattttccccgcagggtaagtccattttaaagccaaattaatgatgaacacaaattccttattatttaattatagatttgcaaagaacgctgctatttagtgcgtcaaataaaaagccgacaaaaatccgaaccggaaaatacttattaaaatttacaaaatcccagagtgaaaatcccttgcccatttaatatttttaaacttttccacgataaaaattaaaaaaaaaacccgtatgttttcgtaaaaaagtgttaagatttaaataatcataaagagggctgagaattaaatattcgaaaaagtgctcagaataaaattaagatttttttttgaatttttgaagattttttgtataaaaatgtggcagaaaaattattattttgggagacatggattatctggacggatttttgtctgcgtgccatcaattttattgtaccattttaattaggcactttggctgaacgtatccgtgccggtggtgctggcattccggcattttacacgccaactggatatgcaacaatggttcaggaaggcggtaccccagccaaatacagtgttgcggaaaatggcaaaattgaaatttcaagcgacccaaaagaagtgaaaaaaatatttttaatgaa

SEQ ID NO: 63232 - DNA, 408 bp, Heterodera glycines
  Genomic contig location: Contig_ID=SeqID_33046; Location=439..846; Strand=+
  SCN-specific regions: Sequence locations=1-408
atgccgtatcgtttggtttataataaaaagatcacatatgcttattgtatttttgttagcagtaagtgcccaaccggttcaatttacggtacccgaaacttttggccaatttgaaagccatttaaatgggggtttcataaaatcctggattttaattttacgatcccatttttacattgtttgactgatggtggaatggtttcagaacgagaacacgtcgccagaatatttgctgactgtgatcaaccatttgcgcatggaactgctgaagaaggaggagcgcatccgcgacatggaggagtacacggacaaactgatcaccaaggtggacatggaattcaaatgggagcctctttcgcatcagtcaccagggggggttttgccagcgaaaaagcggaaactatttga

SEQ ID NO: 63233 - DNA, 608 bp, Heterodera glycines
  Genomic contig location: Contig_ID=SeqID_33049; Location=251..858; Strand=-
  SCN-specific regions: Sequence locations=1-231,263-398,421-550,580-608
atgccaaagccaacaagcacagaatggagacaatctgaggtgaaaatttggaatgaaaactggcattaaccaccctcattcaaattttaataattaaggcacgccagcgccacagagttctccgggttggccaacttcgcatgcggcggtgaccctttgtcgaccagcctcgataatttggaggatttggtgccagatcaacacttgaccatggaagaggcatattttagcattaaaatttacaatttaatttaatttttaagtttatcattcattcattgagttgtctctcattgatatttactttagccttctgtcggccgttggctttgatcttccgatgcttttccccgttgctttctgtgaaaatggacgggattttccattccgttaaaagggtttttgccttcttttccgccttttgtgccataatgacattggccatttacgaaaagtcccaaccaaatttgtaaatgtaataatattttaatgtttgcatcatttcaaaacgaataggccactcactcactatcacccacccacctattgtttattattattattattacaattattatttcatttttctttttggtaattaaaataaa

SEQ ID NO: 63234 - DNA, 483 bp, Heterodera glycines
  Genomic contig location: Contig_ID=SeqID_6899; Location=2649..3131; Strand=+
  SCN-specific regions: Sequence locations=1-297,319-483
atgccaccaaaacgtaaacatgtctacttggagagctacgaaaaagaattccggcacataaaaaaaagtcgaaaaggcgaagaatttgccctttgtgtcgtctgcaacgatgatattaatctcctttccattgggaaaaccgcaatttctctgcatcaaaaaacgggaaaacatcagaaagcggcaaaagcagcaaaccgatcaattccattgcaggaatttttgccaaatacttcggctccatcaactgaagaccgtaaagttctggctgccgaaggttaacaggcttatttttgatcaaaaattttataattaataggcactatcgcgtatcacactgcacaacattgtcaatcttttcgctcggtggactgtttgtcatctgacggaatgttgcgcacaatttttcctgattcaaccattgcgaaaaaaataagttgcggaaaaacaaaaacggcaaaaattctaactggtatcgcataa

SEQ ID NO: 63235 - DNA, 85 bp, Heterodera glycines
  Genomic contig location: Contig_ID=SeqID_6899; Location=25..109; Strand=-
  SCN-specific regions: Sequence locations=1-85
aaaataaataaaaatattcatgttgcacaacggactcgaaccaccaccctttgtccctttactatcttacaaaaaccacttcgcc

SEQ ID NO: 63236 - DNA, 1125 bp, Heterodera glycines
  Genomic contig location: Contig_ID=SeqID_6900; Location=65..1189; Strand=+
  SCN-specific regions: Sequence locations=1-160,182-349,371-558,580 -1125
atgcccggacattttaaaaattcaaccaaacgaatgagggagctgaaaggattttgtgaggaattggaggtgcggaattaagtaatgaaaaattctaagctgttaatttaggttgaatttgaacgcttgaatcgacatgggccgacaagatggacatcaatgaacagcgtcttgggcaaaattattcggatggaatctgtcttaatcgcctacttttcaaaacctgacaaatgtccggcacttctttacgcttttttttcgtttttttctgaacaatcatttgcgatcattcattttttacaccacgtgctaggcctatttaacaagacaattgacttttttcaggttgttttactaattttaaatgaaaattctgttcataaatttagaaagaaaaagccattttgcccgaacttttgctggaaatggacaaatttagagcgaaaattgagcgacgaaaacaagaacggttttatggtgccgatttggcaatggaaaaagtcgggaagtgcacacgcgaagcgttggaggaacaatttcaagtaaaaattaatcggttttttattaaatttccaatttttccagtctttttacacctcggttttggcatatttgaacaaatggcatcgcattgaccgatttccggaaaagttgcaatgggttgcgctggcatcccgcaaaattccccacgacgatgcattggctctggctcgacaaattgcgcccgagttaacaaatgacttgtttgacgatgttagcgaagcaaaccaaatactgaattcttttccaaatgatgaatttcaaaaattaacccccgaacagaagtggaagaagctatttgaagcaaatttgccgcatctgctcaagctggtcagcattgttctttccattccggtctcgaatgcatttgtcgagagagtgttttctctttgcggctcacaatggactgacacgcggaatttgttgcaagtcgaaacagtcaaggcgttggtccaaacgaaagccaattttgatctttcttgcccacaaatgtaccaaatgctaatttccaatcacaaattgttggagaaaatcggcggatgggaaaaatacttttgataatcactttcaattgtttttgagcta

SEQ ID NO: 63237 - DNA, 232 bp, Heterodera glycines
  Genomic contig location: Contig_ID=SeqID_6900; Location=2448..2679; Strand=-
  SCN-specific regions: Sequence locations=1-232
atgacggaagccgagctgagagaaatcttcatggcgggcacgacggcgaatgaacgtaacagtttttttttggcatttttgttgtagcaacatagataattaattgtcacgtttttcagcgacgaacagaccgttgggcggcgcggtgacgacgacgacgaatgccaacaacagaacgaccggtgggaatgcgaccagcagcagctcctcatcaatcagcgacagtgactga

SEQ ID NO: 63238 - DNA, 848 bp, Heterodera glycines
  misc_feature (75)..(75): n is a, c, g, or t
  Genomic contig location: Contig_ID=SeqID_33056; Location=74..921; Strand=-
  SCN-specific regions: Sequence locations=27-101,124-848
  Gene Ontology: Mol. function=carboxy-lyase activity; Biological process=dopamine biosynthesis from tyrosine
taattaaatttatttatttattttatcaatcactgagttttttttttggatcgacctagccccgcatttgtcatntaggtttaaaacggagacgaagcaatcgcattttcaacgtcgacgcggtgtaccttaagcatgaacaccaaagtgatgcgtacgattttcgggtgattcctccattttcccctccatcccaaatattcttttcgctttccttaattaattaagcatctccaagtcggacttagccgtcgcttcagggcactgaaaatttggtttgtgtttcgtgcgattggcattcagcgaattcaacaatttttgagaatggtgcgtcaaattgggaaagtcaaatttgcaacattttgcccattaattagcaaaacgaattggccaaaatgttcgccgatcttttgctcagagacgaccgtttcgagctgttcgtcccccagcgtttgggcttagtctgctttcggatgaaggtaatctttacaaaggaatcactctaagtgatcgttttatgtcaatttgctaatgccattcccaatgccattgtcgggcaaaaagtgccgtggtagtttactgtatgtctagtgataaccctgccgtggttactgtaggacccacagttttttatcgtacctttgttcattgtcccttatgttgagaccagcaatgaactgaacgagtcgctttatttggccattaacgacgatcgacgcgttcatttggtcgcttcattcactcactgcacttttttcctccgtttcgtcgtttgcagttcaaagacacgcgaaacgaacatcgaaaaagcggtcgaagtgatcagagaaatggctgacaaagtgacg

SEQ ID NO: 63239 - DNA, 100 bp, Heterodera glycines
  Genomic contig location: Contig_ID=SeqID_33058; Location=368..467; Strand=+
  SCN-specific regions: Sequence locations=1-100
ctgtgctcatctgaattggccccagcagcgcatttgcaaacattgcactattggcatacccaccgaagcgcaaatggcgattctgaaacaattgctttgg

SEQ ID NO: 63240 - DNA, 975 bp, Heterodera glycines
  Genomic contig location: Contig_ID=SeqID_6901; Location=250..1224; Strand=-
  SCN-specific regions: Sequence locations=1-685,715-721,764-803,927 -940,962-975
atgtcccaaaaatctatttctgatttcatttccaatgttacatttcaacaatcaccttcaactcaaatttcaagcgctgaggaagcaatttcagatttagccgtttcaatttcgagtgatgagtttggggtgaattttagcaaatgtacttttgtaattattaaattttaggtcacatctccaaaaaggaagaaatattctcacaaaaagcctggcggaggactatcaaaaaaagggtgaaaaagcagtcacggaccacatcagaaccaccaagcacaaaaaaaatttggcagaatttaacagaaacgtgcctttgaccgattttgttaaacaaaaatcggtaattcattttggactcattaaataatctaattcaattgattaaggcttctgaagaaaaacggtgtctcgcagcagaattaacactggcctaccattgcgctcgtcactgttcacaattattttctttcaatgccaaatttgctcaaacaggtgaaaagcggtgataaatatattgtttaaatgttattgaccttttttacagagaataattggcttaaaaaattgccgggttttttgccgggtttttgaaaatttttgccgggtttttgccgggtttttcaactcgcgcgcccggtttttgggttttggcgatcgcatccctgtcaatatcgtatttatatatttcaaaattatttattgtatacacttatatgttacaattaaataatttcaaaataagatttcatgcattttcttattaaattaatgatctttgaaaagaagcaattgtgtgtgaacagataaaaaaaaattttttttttttgtcatattatttattcacattatttttgtctatatattaattttgaaaaattttttagaaaaaattatattaaaaatcttaaaattgaaaaattaataatgaattcgaagaaatgactaaaatgaaaagaaaaaaccagcctaaataaa

SEQ ID NO: 63241 - DNA, 1137 bp, Heterodera glycines
  Genomic contig location: Contig_ID=SeqID_6901; Location=1543..2679; Strand=+
  SCN-specific regions: Sequence locations=1-195,233-368,393-534,557 -582,663-690,720-808,991-1137
atggataaaaaattgttttttgtataattttttttactgagtgtttttgtataaaaatgattgcttctaaatttgttatattttgtcttgaatttaattagttgttcttggtttttactattttttacttcctttccttaattttatattttttcaagttgccgccgaagaattctcatttcaattctattatagtttaaaattgttttctaaaatattgttaaaattttttcacttatatagaagaaatcacaatgaaagtttttagtgtattaaatatttttgattttaaactgaaaaaactattatagagataataattcatttttttagcgaaaaaggttatttttataatcacatttttttagtaaaaagctgccttagtttattttattaggtaatttatgttttattcttgtgcggacgtcggattataatttattgtttgtatgtacttagtaattaataaatgaatattttttgttgaattgaccataaatattcttttagaaattgtaaacaatttttcaaatttatcttctaaaatttttcaaatgttcaaatttttattatccgattgggtttttattttaattttttataaagaataattatatgtatatttacttatgtagaaattttaatagtaatttgttaaaattgctgaaacagaattgaaatttttgttcctttttttatatttttatcaaaaatattttgttaagccaatttatgttctatttttgaatgattcattctaaaaatttaaatagttcaattttaatcgaaattgaggcaatctttattcatttataattatttatatatatccgtttaaaaattttttattcattattatttttattttaatagctaaataactgacattaaagtaaatttcatttaaaatattttttaaatcaaataatttaatatttaaaataagttttttaaataatatataagtaagtttataaaaataatttaaatgtatccagtaaaatttgtccactattttggtttcatgaactaaaatgtaacatttggtattctgcggaagttgacgaaccattgcttatgtaaaaattatatttcctatatgcatggactgagaaaaaaaaaatgggctatccttaa

SEQ ID NO: 63242 - DNA, 84 bp, Heterodera glycines
  Genomic contig location: Contig_ID=SeqID_33066; Location=1..84; Strand=+
  SCN-specific regions: Sequence locations=1-84
tgtgtgatttggtgcttgcgctttgccaatttgtccgagtccgacttcttcattttgggcagaggcgccaacggaagctgtgcc

SEQ ID NO: 63243 - DNA, 105 bp, Heterodera glycines; identical to SEQ ID NO: 53698
  Genomic contig location: Contig_ID=SeqID_33067; Location=83..187; Strand=+
  SCN-specific regions: Sequence locations=1-105

SEQ ID NO: 63244 - DNA, 769 bp, Heterodera glycines
  Genomic contig location: Contig_ID=SeqID_33068; Location=10..778; Strand=+
  SCN-specific regions: Sequence locations=1-580,602-769
atggggtgtgacgcattggtcctagtgacggaagagagcgccgggccatcgaatggcacaaaagaaaatgccgaaatggacgaaacgagcgacgggaaagagaaagaaccaatggcaagtgcaaattcgaaggtaatgcaacggaatccgaaggtaaaatcaaaaatttaatcattgaaggacttcttcgagttggaggacgaactttcgaaggcggaaaatgtggcagaaaagcaaacgaaggcaacgcaacaaatggacaaaatgcggacaattttggcaatgagtgacgacggaggaaatcaaaaccaagggtttgccgtgaatcgggagaatctcctgcttattgccgtctttttcccagcgctctctccgaactccttccgattgccatcactttgagacgtctcaatcgcctctccaatctccaaattatggccgcgcgtgagaaaatggtcaaaatgcgcgaatgtgtcgagaaacggaccaacgaattgcgaaatgggcatgtcggagttgacttcgtaaagaaatgcgtcgacctttgcctcgactttccaaggcaattttcaagttgaataatttcaatgttttttcctttgattttcagcccttccgactccgacatcgatctcatccacgtggatcagtttttcactgaaaccaattctattgtgcttccggaatcaattcgtaacgatgcgcaccaattgcgagtggcacgactaaaacacgaattttggactcggaaaaggtcgaaaaaaactaa

SEQ ID NO: 63245 - DNA, 1134 bp, Heterodera glycines
  Genomic contig location: Contig_ID=SeqID_33069; Location=127..1260; Strand=+
  SCN-specific regions: Sequence locations=1-224,246-417,439-1047,1070 -1134
atgaacacccgcgttaattatgcgatgtataggctggacgaagccagaaagcaacaatatgatcagatatatattcaggcatgtgagagcaccaaatttcaaatgcaattggcaagggcaatcttacagataaatccaaatgagggggttagaaggatttttgatagagatgatttggtcgcgcattgggaaggtgataatttggaagttggattttgcgcaccactaacacctgaaaaaatattttgggataaaaaaattggtaatgagtgttacgaatggacgccagtttttgcagaaaacacaatattttttgttaaacccggcacaagggagttgagcattttggggaaaaagtcggaatgtgtggaaaatggcagtgtaaaggaaatgcataatgagactcaaaggggaataatccaaaaaatgggtgaaaatattgagaaaattcgacccaagtaccgaaatatacaaaaccctttaattttaaaagccggagcgctttttgaatcagacaatgtgcgaattgaggaaacaattcgtgaatatcgctcaaaaatgaataatttgcccacaccaacattacgtttagtcgaaaaaccaaatattacggaaattattaaattggttaaaagcgaggcaaatgaaacgcttggtgtgataattggtagatccggagattggttggaaatagtaaagaaaattccggagaaaaccaaggaagcattaaattatttgaaaggcctatcatatgtactgattgcgataccattattaattcttttggcattgattggatacattggaattaaatacagactgataatatttgccggggttcgtgctgggtcagtattggcaagagtgttaagagcaataatgggaatgaaaaaacgaagtactagagttttggcggtcccaacagctccggagttggatccaatcgatgaagaagcttatgttctggattatctgcctccgagacgggtagcagcaattacgaatgacccgcggagactcccatctattcgggtccgcctaaatgatttgttaacagcagccttggttgattcatgtgctagtgtatcctactgtagagaaagaacagcaagaaagcaggacttaaatttttga

SEQ ID NO: 63246 - DNA, 1652 bp, Heterodera glycines
  Genomic contig location: Contig_ID=SeqID_6903; Location=426..2077; Strand=-
  SCN-specific regions: Sequence locations=1-10,32-83,105-176,198 -1038,1060-1074,1096-1308,1335-1418,1440-1652
  Gene Ontology: Mol. function=chaperone activity; Cellular component =extracellular space; Biological process=protein folding
atgcggctccaaaatattttgtcaattttaatcattctacacatttgcgaagtcaaatcattcccggtaattttatcaattagctaaaattgaaaatatatacaatttttcaagattttgtcatcattattcccatcgaaaaatgatagcggcgatactgttacaatttttgacaacataaaagaacaagaagtgcaaatccgaaagaaaagacaggctataacgcttttaaacgatggaaaatcaataaccctcacaataacgggacaaagtgtgactgttacagaggaaacattgtcggacggaacgattgtattgagaattacgggacaaaatccgacagttttaacaggtaaaaatagcaaaaaaataaagcaaataaaaatatttaaacaatcaaggtactgacaatttatcatccgacgatcaagcatcaaccactgaagagtcgtctgcttcggctaatgaagaagtgtcaacatccgatgacccagcatcaaccactgaagagtcgtcagcatcggctaatgaagaagcatcaacatcagatgacccagcatcaaccactgaagtattgtctgcttcggctaatgaagaagtgtcaatatccgatgacccagcatcaaccactgaagagtcgtcagcatcggctaacgaagaagtgtcaatatccgatgacccagcatcaaccactgaagagtcgtcagcatcggctaatgaagaagtgtcaatatccgatgacccagcatcaaccactgaagagtcgtcagcatcggctaatgaagaagtgtcaatatccgatgacccagcatcaaccactgaagagtcgtcagcatcggctaacgaagaagtgtcaatatccgatgacccagcatcaaccactgaagagtcgtcagcatcggctaacgaagaagtgtcaatatccgatgacccagcatcaaccactgaagagtcgtcagcatcggctaacgaagaagtgtcaatatccgatgacccagcatcaaccactgaagagtcgtcagcatacgctgatacagtaacatcctcttcttcttcattgataacttcttcaatttcctcaaagtcctcaacaacgacaactattttacgaccgccttcacaacaaaaacctagaagtagcagtagttcatcttgcgaaagtgaagaaaataaatttggcaaacggcgcccttctcatcataaaaataagaagtccaaacaaacgaaaaataaacaagaaggaaaggacaaaaacgagaaagaaaacttcgccaagcgtgtgtatgaatggttccataatttgccaagacattttgggtaatttttgttttataaccccatgagcagatgcaattataattctatttctatattctgtgattcttgttattctttttttaaatgaatcctgtcatcttattctttgaattttattgaaaggaagttgtgcactttgtttgatatttctttttggttgtttttctttttaaactttgataaaatggttttgttgtgatgttcgataccgaaatttacccgagactgagggggtcacctgccgggaaaataacagattaagaaaataagaaaaattttgaactatccaattctgacgatttttattaacaaaagcaattaagttttaaaataaa

SEQ ID NO: 63247 - DNA, 897 bp, Heterodera glycines
  Genomic contig location: Contig_ID=SeqID_6904; Location=5..901; Strand=-
  SCN-specific regions: Sequence locations=1-112,156-556,578-897
atgattaattttattgaatctaaatgtataaaatcttatcaagatggatcattaaaaataaaaaatgactatagcgcagaagaggaggaaatagaaacgaaagttttaaaggtataaaacaaataaaaataattaaaaaatagaaattttattttctaagacaccaagacgaatttttacattgaacaaacggagcaaaacaaatgcaaatcctgtgccgaactatgaagttgatgcggaagtggaaataacgggacgaaaggtgagaaagcgaataccgaaataggacaaaacgtgtgctttgacgttaaaagactataaaaatgaacattactcaaaaaacacaattttagaaaattcattagcaaattaaggtcgaatgaatgtgatttgaagctttgggcatttcggaagctaaaaaatatctccaaatttcccaaaatttataaaaaattctcattaaaaaaaagaaaagttagcaaaaccaaagcattgattaaaaaaagccaaaaatgatgacaattcaaacaaaatacatataaagattatgcgaactttatttttgagacatttcttaattgaaaatctttataaaaagcgagcgataatggatgctcttctttattttctaaaattttttagagctttttatcttgtttcgctgatttttcagaattttaaaagtgggtcggggcagggttagcaaacatgcacgatggtcaaatactgttaactcaattatagggtaaccatcatagttatggtaatttaaccataacaattttgaaattggatattgaaagcaaattttttcaattaaactaataattctttattaatagagagtgaaaacaactgctcacaagaaggctcaaagagttaaaacaacagctaaag

SEQ ID NO: 63248 - DNA, 1324 bp, Heterodera glycines
  misc_feature (1324)..(1324): n is a, c, g, or t
  Genomic contig location: Contig_ID=SeqID_6905; Location=80..1403; Strand=-
  SCN-specific regions: Sequence locations=1-820,842-902,924-1022,1047 -1078,1100-1118,1141-1324
  Gene Ontology: Mol. function=ATP-binding cassette (ABC) transporter activity; Cellular component=membrane; Biological process=axon guidance
atgagccaaagagaaagagacaatttacgaatcactgatcagaaagtgattcaaaaaatacggctacaaaatttggtcaaggacaacaaattatcaagcacgccaaaacgattgaaaacttttggcattttcaaggaaaataacagttacaaaattcatgaaaatgagctggaaaacaataatgttttatggacatccagaaaaataactgctaatgctgccaatggacagtcaaaaattgagcaaaaatatttgaaaaagaagcaaaatgccaaaaattacaaagaaaagagtcagcgattggaaaaagaattgcgggaaagagacgttgaaatttcgaatttgaaaagaaacgaagtgcattataagattaaaagtgaacaattggaaaaggaattggccaaaaaggaaaaacaaattgacgaaattaaaaagaatatgcaaaaggagttggacaacaaagaaagtgtaaagatttttaaagaaaagagtcaaaagttggaaaaagagttaggccagagagaaacagaaatttatgagttgaaaagaaacgaagtgcgacacattgtaaaaagtgaacatttggaaaaggaattggagaaaaaggaaaaacaaatggaacagttgaaaaaggaattggaaaagaaagaaaaagaaattgcaaaactgaaaaaggaagtgcgaagaggaggaggaggagaaaacaaaacgaatgacagaggtaataaacaagcaattccaatgcctaaaaaatctcaaaatcggaattcagggactaaaaaaattcgtaatcgtaaatagattgaaatcagaggcttaagaaaattagaaaataggaatttataaagcttcaaaaactctttcgggaatatattggtcctagcttctagactcaaaatcacaaaacaaactttgtaagtttttatgtgttaaaaatgactaagtaatcaaaaaattgcgcggcaaaaggttaaaccggtatcgagcctgtttaaatccaaaaattgcatcatttttaacagattaaaaataatatttttttatatgattttgtgtctggaatattttctcatttccgttccaaagttttggaactcgaaaccatttataaatatgagaacatttatctttaggcgaaggtaatcgggccaaaactatcgactcgaagttgacagtaaaagagcgcgaactgtacaatttggaccgtaacatttctatgaaagttcgtcaactgcaaaactttgaatcattaattgatcagcagaacaagagcaccaattcagcgatccgaaatagtgagaaattcgaagctttatttatttan

SEQ ID NO: 63249 - DNA, 262 bp, Heterodera glycines
  Genomic contig location: Contig_ID=SeqID_6905; Location=1997..2258; Strand=-
  SCN-specific regions: Sequence locations=1-262
atgagcgtctggtgagttggagccgaacggagctgagcgaattggcaaatattatttcggaaaagcttttaaacgagccaaattttgcgaacaccgcatttatagagcaaagtgccacaaaatattatttggatgccgattcgctggatgccgtgtttaagcagctggaaagcgatggagttgcattgcgaacccgactttatgaggaaattaagcgtgctggactgcttgaagacaaaggtggacaaggatgattaataaa

SEQ ID NO: 63250 - DNA, 733 bp, Heterodera glycines
  Genomic contig location: Contig_ID=SeqID_33077; Location=16..748; Strand=-
  SCN-specific regions: Sequence locations=1-220,242-554,578-733
atgttactgaggcggcacgagttgagaaagccgaggttcagcagcagcgaagcggcaccagtgaatatgcacaaaaagaacattggcaagtcgcaactgagtaaaatgtcgaaaaataatggagaaacggtggagggagacaaaatgccaaaaagttagtggggaaaagtgccatttttaaaattcaaaaagggactatggcattttacagtcggcactgctgcttctcttgcagctgctaagcatcagttggcaccttccgccttcccatcgtcggcattttcgtacgctttgccaaatttctcaaagtcaaaacagcaaatttcgccaattcggcggcaaaggccaatcggcaaaagtgcaagttacgactcattgataggacaatcaagcggccaactcagttctttccatcagggcccgacaaagcacggaaaaagtagtgaattggacggtgtaagcaaagggatgagaaaagtgccgagttgggacggcggattggcaagccgacttatggacgaaatgccgaagataaacttttccaaactgaagggcaaaaataagcccctttttgactcttagttaaattttacaccaaaattaagtcgtagttcttacaaatatcaatgaaatgaatttaattaatcttttttttggtttttatgctttctgtcaaagattttgaaatggaaaaacaaatatgcattttaaaaaaagttaataatcgaataaa

SEQ ID NO: 63251 - DNA, 75 bp, Heterodera glycines
  Genomic contig location: Contig_ID=SeqID_33078; Location=265..339; Strand=+
  SCN-specific regions: Sequence locations=1-75
atggttcaaaaagccttccgacgacgtttcggccgacgacgttttggggtgcaccgcccccaaacaccagcagca

SEQ ID NO: 63252 - DNA, 499 bp, Heterodera glycines
  Genomic contig location: Contig_ID=SeqID_33081; Location=302..800; Strand=-
  SCN-specific regions: Sequence locations=1-130,152-328,357-477
atgccgaataatgaggcggaaatgttcagcgaaaactgggcaatttcagctggaaaatcaatttggacacaatttgtgccgaaatgcttcacagtagaatcccgtggagtgaacagattcggctaaaaagattttaaatttaaattttgaggaaataattacgacagttgaagtttcaactatgatacccgcgtccgggtacccgaccgtgtccagacccggatacccggcttcccgacttggtagatccgagtccaactgggtccaaaaatatacactagtaataatgtgagtcttggttaaattgttgagcaaagttggaggaaagaaaatttttttaatttacttaatatttactttctatggttcaattctttctcatgttgatctcatttacacttttattaaagatttttgttgaaaatcttatattttaccattacgtaaagaaagctcaaaaattttttagacaaaaataactaatgtttattttaataaa

SEQ ID NO: 63253 - DNA, 3559 bp, Heterodera glycines
  Genomic contig location: Contig_ID=SeqID_6906; Location=1..3559; Strand=+
  SCN-specific regions: Sequence locations=1-739,761-819,841-1039,1061 -1148,1170-1175,1198-1199,1222-1717,1739-1873,1895-2669,2691 -3011,3081-3559
  Gene Ontology: Mol. function=cyclic-nucleotide phosphodiesterase activity; Biological process=signal transduction
ttgattgattaattatttaatttgcaaatgctttttaaaggtggccgaagtgtttgaaaagaacggcacaagcgatgaatatttgacggagattcggatgccgttgaaccagggcattgttggccatgtggcaaccacaggacagatgatgaatgtgcgcgatgtgtacaggtaattaatgtattattagggaaattagtggaggaccaccagataattaattgggttgatcgaaacagttgtttccaggcatttataatcagacttcatttgaaattgatcaatgatcagtgtaggtatttctgatcactgatcaaaccatacacaagtgaattgagcattgattgacaacatccccgagattgattacatatttatgtatctctttggattccttatcatttagccatcccaatttctacccaaaagtggacgaacggaccggcttcatcactcgcaacattttgtgcttcccaattaaggactcctcaggtactgaattagccttctttttcacggcgaaaatattattaaaaaatcatacagtatcatcaaatctcacctatttactgttgcagctacagtagtttaacatcgtagtcccgtccctcattgtcaggcactttggtcggtgttgcggaactttgcaacaaaattgggcgtgacgcttttacgcggcacgacgaacaaattgcggcgacggtaggttgtaattacagtatttaaaaggctccttcgggcaaatgaaaaattagagtaaccgattaaacttttttacagtttgccgtctattgtgccatcagcatttctcacgtatgttgtcctttttgtgtcattgttctcctcatccaattaccgtttcctcccccttttacagtgccttctctaccgtaagctccaagaggcccaccgtcgttcgcacataacggccgaattgctggtccaaagttccaccctttcggtgagttttgcaatggcacaatcaatgccctgagaataaaattcaaatttggacaaacttacaagccaaggacgggttctatttcttgaattttcaaaatacgttttaaatccgcgatcttttccagcccccgagggcattcttctaattcccgattttaatttgtgatcagatccttttgtgatgattatcccatttcttttggccattaactctgtttattttttcctctccacagattgctcctgaggacattcttcggctgaccgtccgcgacattccttcgcccgattcgttccactccgagtcaaccaattccattttgtgccccgttccatcggaggtgccgacatttacgtggaggcatccttgtccatgttcaaaagcctgggcttcattgaccgatatcggatcagaagacggacattggcgcgctttttgttgatggtgcaaaagggttacagaggtgaggaaggggggggaagcaaaagtgtgggaatatttggatcaaaaatcgaaataatcttgttgaaagaattatatctttgttcgcctaattacggttttacctttccttccatcccacaagttcaatcagtactttccccctttcccaatctgttcagatgttccctaccacaattggagccatgcctttgccgttgctcatttttgctttttgttgctccgaatgccttcggtgaagtcatctttgcaggagttggagcggttcgccctgctggtcgcctgtctttgccatgacattggtgggaatatgggcatgtaattttcggctgattctagtctgatcaaaaggggcaaatcatttacttgtttcatatttgacacttttttagaccaccgtggcaccaccaatgcctttcagctccaatcggttaattgttttgatcaaactgatcattaactaattgattccactgtcccttcgttcagaaaactccgcttgcccaactatacagctctgaagggtccgtgctggaaaggcatcactttgcgcaggtgcgttgattaggcgtcgcttagccgatcaaagctaaacaaaccatcaacaaattatttattgtgccatgtttagacagtgagcattctcggcatggacgagtgcaatatttttgaccagttgaatcagaaacagtaccagcaggtacatacagtaccgctgtattttgattattgagactgatttccatcctctgtgctttgcattgaactttcgggtgatctgtccaatttccaaccatactctgatcagttcccacctggctaaagatgtggattactcaacttcagatcatggactgcattagggaagtgattctggccacagacattgcggcccatctgcgcaaagtggaacgaatcgctgaaatggctaaaggtgtttttttaaacagctgatcacttttcttactctcatcaatcaaatcccttccactaatcaagggtttgatcagtcctttccttgctttgcatccgctgatcacttcttctcacaattctctcggatcagtgatctttatcatgatcactctcatccaaattgttcatcaatcacttaatttatctgatcagtctattctctcctcgactgatcaccttaccccgttgcttctgatcaccattttcccctgtccttttgcagttggcttcgactcgcgatcagacgagcatcggtacctgttcacctgtctgctgatgactgcctctgatctgagtgatcagagcaaagatttccggcactcaaaagccatagcggagaacatttacaaggagttcttctcacaaggcgacctggagaaggaaatgggcaatcggccaattgagatgatggaccgggaaagggtgagttgatcgatcggagagaaagtgccaaaaaacgacacaatgccaatcccaccattttcccgttttaggcatgtgtgccgaaaattcaaatcgaattcatggacaccgttgcgctgccagtgtttaggtattatgacttggtcttgtcgactttctcgtatgttgtgacaaccgatcgcttcccagagagagagaaaagagagagagagaaagagagaaaaaaagaaagaaaagagagagagagagagagagaagcgatgtggagagacctaaatagatcacttcattttaataatggttaaacggcgtctccctcattgcttaaatatcttgccaatccgggattttgatggatgtccgttcccgcccctttcccttatctccctcttcgtttagactgcttgcgaaactccttcccgatttggtgccgacccatcagtgagtgccagtcccatcttgtctgattatctgatcactttccccctccccttaagggctttgctgcacaatcgccgctgttggatgaagcttgaccatattctgcaggagcagggactgccgctgacctcgggaggcttggaatatttgcgggaccaaaatttggaggagaaagtgacaaaacgggtgacagacgacgaacggaagggggaggacaatgtgtccaaaaatggacaaacggacgacgacgacactttgggcattccgatcaatgtgtggaggcgactgagcaac

SEQ ID NO: 63254 - DNA, 309 bp, Heterodera glycines
  Genomic contig location: Contig_ID=SeqID_6906; Location=4089..4397; Strand=-
  SCN-specific regions: Sequence locations=1-287
aaggctctttttactgcgcttgtcccccgggaatggtcgttgatccggcacatccgcgccaatgccttcccatcgacggcggactgaaaagggcggccgatcttttttcgtactgggcaaaaatgtcaaaaaagccggaaaggaggcgatgatgaacgtgtgtagagcgatggataaacgattgctcagacgtgtattgatcaaaacgaaaaattgatcagagtgatcagtcggccccattttatgtatttgcaaatcattactttacaacatttacgcaaaaataaaatttacagctgtttttgaaaa

SEQ ID NO: 63255 - DNA, 373 bp, Heterodera glycines
  Genomic contig location: Contig_ID=SeqID_33082; Location=582..954; Strand=+
  SCN-specific regions: Sequence locations=1-103,125-373
atgccttttccatttggtgagaaatagtaccctaaattaaagttgttccaagaatttttaagcgaataaaatttccaatcaaaaaaaaaaaattctttccggaaaaatgcatttttgatgcaaaaatttgatttgtttggtctcaattttcgggggaaaaaactgaattttccaaagattaccgtaaatgctctaggaatcgtgtgaaattttgaaattttagcgaaattcgctaacaaaatttgtgtaaatttttacaaaaatgtgcttttcagatgatgttctgcttgcgttcgaggacagcactgtttgtgtgttcaatttggccacaaaatcagttgtcgacgcggtcagaattcatttgtttaagtaa

SEQ ID NO: 63256 - DNA, 150 bp, Heterodera glycines
  Genomic contig location: Contig_ID=SeqID_33089; Location=477..626; Strand=+
  SCN-specific regions: Sequence locations=1-49,71-150
atgtcggattcagcagacgaatcagcagatccgttagatgctttggtttttatggaacaagccgaggagaacggcagtgatttcagcgacacaaaggaaggaaagggaatggcggaggaaaactcatccgacgagtccgaatacaacgaa

SEQ ID NO: 63257 - DNA, 219 bp, Heterodera glycines
  Genomic contig location: Contig_ID=SeqID_33089; Location=138..356; Strand=+
  SCN-specific regions: Sequence locations=1-33,60-79,103-219
gccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttttcgtgggctggacattttgtgggtaagcg

SEQ ID NO: 63258 - DNA, 522 bp, Heterodera glycines
  misc_feature (510)..(510): n is a, c, g, or t
  Genomic contig location: Contig_ID=SeqID_33094; Location=929..1450; Strand=+
  SCN-specific regions: Sequence locations=1-20,56-79,145-180,202 -286,329-389,411-522
atgaaaaggtgaggtgatcagaagaaaacaatgcgtttcagaaagtttggcttatcaaaacaaaaatatggcatgaaagatttaattttttaaactttagctttaaaaaattaaatttaaatgatggatttttataaaataattcaatgactcttaaaaggcaaaaaaaatttttagattttctaccctctccactcctccccgttgaattctatttaaaagcataaaacttgttttgttttttgacttcgaaaacagatgttcaaacttttttaaaagttttgccttttaaaaatttagttttattctaaataattgaaaattttttgccttttcgaaaaaatgttcaaaattttggaaaacttaaggcatattcgagcactgccaattgtgtgcttaatgggtcctggaaaaatgctgatgtcaaattttttcctggcgatgttgtcggatgcggcgttaatttggccacccaacaaattttcttcaccaaaaatggccatcgattgngttaggaaataa

SEQ ID NO: 63259 - DNA, 367 bp, Heterodera glycines
  Genomic contig location: Contig_ID=SeqID_33095; Location=36..402; Strand=-
  SCN-specific regions: Sequence locations=1-88,157-188,225-237,259 -312,334-367
atgctcataggaattgcggccattaaagcgcagaaaaaagcattgaccggagaagcaattgaaggaattagtagaaggtaagaatcagttaattttaaaataatattaagttttaaaaaatctttaaccaaaagtttaaaaaatatttttatatttgttattctggctttacactatttaacttttgcataataatttatttctattgtttaataaaaaaaaatcttatcagttttcactagctgatcaaatctgagcttttatagtttgacagatttcacatatacattttttgaatgcctataaatgttcaaatattaaaaattttttaagcatggaacttcgaaacaatttgactatcctataa

SEQ ID NO: 63260 - DNA, 359 bp, Heterodera glycines
  Genomic contig location: Contig_ID=SeqID_33096; Location=619..977; Strand=+
  SCN-specific regions: Sequence locations=1-359
atggccgtctctttcctccacttttcctccatcattctgtgctccgttttggcccttcttctgttggcaatgttttgtgaagtccgtgcggcccccgcggtttaccaaatggaccgaaatgcctttcgaatgagtttcggcaagcgatcgcagcccatggaaacggaaagcagcgaattgaatgtgcgttatttggagaggggggggggggagggaatgacaaattgtgccgatcaaaacaagtgtttttaaagggtgccaacatcgccattccgctgctgtacgatatggccgaggccgaaacagccgcgcaaaaacagcggcacagagtcagcgcaccgtgggccacccggtggaag

SEQ ID NO: 63261 - DNA, 410 bp, Heterodera glycines
  Genomic contig location: Contig_ID=SeqID_33098; Location=104..513; Strand=-
  SCN-specific regions: Sequence locations=1-119,154-410
atgggatctcgcaggtaattattaaaatggatttaacaaaaattatgaattttaattttaagtgtcgctggtggtgttggtgcttcgatcatgaacaaagtgaactaagaaaaagggggaaaatttaaaaaaataaataaaattaaaattttagcaagccagcaaatacaacgagagtgagggtgagctgttgctcaactggatcaagcaggtcaccggtgccacaatgacggtgaacggaacgcgcgaaaacttccaagcacaactgaaggacggcacattgttatgcaagtaaagaaaaataagcattaaaagaaaaaagttataattacatattaattcgaaatgctaggcattgaatgaatctgacaaagtcgtaaaaagccaaaaaagccccaaaatttaataaa

SEQ ID NO: 63262 - DNA, 409 bp, Heterodera glycines
  Genomic contig location: Contig_ID=SeqID_33101; Location=562..970; Strand=+
  SCN-specific regions: Sequence locations=1-144,166-242,264-298,320-409
atgtccgaccgtatgcaaatgtttttgcaattcatcactaagaagattcagggaaaagccactgtgccgaaaaaaatcaacaattggttggagcagatttaaagcagccgtttgaagaattatcgcttgtttaagttgtcgctgaaaaatattctattgttttaataatccattttaagctacaataaattaccaattcattttcgattttgtttaatttggcgtccgattcgttctaaatggtgaataaaattatttttgtttgttcaaatattagcgcattgattttacacaaaaataatttaaacattcatatttaatccttacattgtgcttttgcagttgggcaattttttgttcaatttcttcgtatttgacttggaaataatcaatgcccgctgaatggaaa

SEQ ID NO: 63263 - DNA, 884 bp, Heterodera glycines
  Genomic contig location: Contig_ID=SeqID_6910; Location=784..1667; Strand=-
  SCN-specific regions: Sequence locations=1-43,289-884
atgcttaaaacggacaacggaaacggacttggcgagacggaacagaaacagcagcagatgaacagggaagggaaaggccaaacggaagaggaagaagaagaagacggacaaagggaagagcaaaaaaagggaggaaaaaaggcaaaaggaaattgggagaacgaaaaagaggggaaaaaggaggaggaaaacaacaaaagcagcaacagcaggaggaggaacagctcgaaaaggacgagaaagcgcagcaagacaacgccaaccgcagaaggagggggaggaggaaaagcggcacagaatgagcgggacaaacggaggcttttgggcccgagtttgtcctgggacccgcaacagtgcgaacagcaacagcgcaaattgaggtgtgccgaagcgggacagactttaggggatagggtggaatggcacttggcggtggggctgatcacatacacagtcttggacaaaccaaaccggtggttaattgtgtctgatcagaatgatcagcttcatccctcccggacaaatcaaaccggtgggttaacttttttccccgattcagcagaccgcgctttcctttgttcaccaccaacggcacctgcggcactcagtgcgccaccgctgccgatctccgcggccgaatccattcggacggaagtgccgaacgattggcacacacaaacaagaaattgtcaatatttttgaccgcgaaaataatgccgaccaaaggaggacactcggagaagaagccgaaagggaaacggcgcaagaaaagcggtggtttgacgaaaggggccaacggaacagcggagaaaattggactggaattgaactggtcagttttgttggaaaattggcatttttatttgagttcggcaggagcttag

SEQ ID NO: 63264 - DNA, 508 bp, Heterodera glycines
  Genomic contig location: Contig_ID=SeqID_6910; Location=5685..6192; Strand=+
  SCN-specific regions: Sequence locations=1-63,85-90,124-300,372 -372,395-422,445-485
tttgccccattcggcgacaaaaccgcacattccgccgtccgatcgcgaagaaaaataatcccaaatgaaattccaaagtccaaaaggaagaaataaaaaataaataatttaaaaaataaaaaagggcaaaaattattctgaaaattcaatggacgaataaatttaaaaaaaagaaaagaaaaggacacactttaaaatcaaagcaaacaaaggggaaaagcagcacactttattctgaagagattgtgctcaattagcacaaattgttataagtgcaaacggaagaagacaaaattcacgtaatttaaatgaaaaattaaaaaatataattatataaattgtaaaaaaattattgaattaatgtaataaaacaaccaattagattgttaatttatcagcgtgcgaagacttaagcaaataaattgccaataaaataatgccaataaaaaaagtgttggattaatttgagaggcgacgattagcgaatgaaagaaagaaagagtgggtg

SEQ ID NO: 63265 - DNA, 477 bp, Heterodera glycines
  Genomic contig location: Contig_ID=SeqID_33102; Location=450..926; Strand=-
  SCN-specific regions: Sequence locations=1-182,219-346,395-477
gggggactgccccgaaaacaaaaaaatcgatttttcaagtgtccgtttggggtactcaaacaattatggggagcaaaaatccaacgcagaattaaagtacaggctatagggaagctattcccgaaggattcggtctccccataaatctgagcgcatcggtaggggggacggcccgagaagccaaaaaaaaattttttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatataaaaagcatcagagtgcctaaactaacatgtaaataaaatttggtgcgtttcagagcattttctgaaaaaaatatttatgaattaat

SEQ ID NO: 63266 - DNA, 206 bp, Heterodera glycines
  Genomic contig location: Contig_ID=SeqID_33102; Location=110..315; Strand=+
  SCN-specific regions: Sequence locations=1-130,163-206
gtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaataatgctggtgtgctaagtgtgaagaactgtgttcttccaggcaaaaa

SEQ ID NO: 63267 - DNA, 1060 bp, Heterodera glycines
  misc_feature (954)..(954): n is a, c, g, or t
  misc_feature (1025)..(1025): n is a, c, g, or t
  misc_feature (1035)..(1035): n is a, c, g, or t
  Genomic contig location: Contig_ID=SeqID_33109; Location=1..1060; Strand=-
  SCN-specific regions: Sequence locations=1-400,422-764,807-811,834 -851,873-996,1018-1060
  Gene Ontology: Mol. function=protein heterodimerization activity; Cellular component=nuclear matrix; Biological process=embryogenesis and morphogenesis
tttcctctttcaaggctgtgtgattgacttgttcagaatacgaaagtcagcacatcaaagcggttgaagtgactgccgagtcgcgcctcttttaccacgtggtcagcgacgaccgcgtggcgatgaaattattggagcgtatcaaccaacgagggctccccggggaagtgaacttttatccgcttaatcgtgtgcttgtgaaagatcgccgcccggtttctgacgcggtaaaaaatgtattaattccactgaaaaatgaattgtctctcttaggatgcaagtcccatcctggaccatcttcaatacgacccgaactttgagcccgtttttcgctcaatctttggtaattgtgtgttcgtccgtgatcttgcggcaggttctcgggttgcgaaacaagaacgatttgactgtgttactcttgacggtgatattcatgacttttttgaatcatatttaatttggtaaattgaaacataggtgatcaagtgagtcgtcgtggaccaatgacgggcggatacattgacagaaaacgttcaaagattgacttggcaaagaaattgcgcaattttgaacgggaaaggataaatttggaggtaaatgcaaaatatgtttaatattgcatggaacatatttcgtaataagacactttacgatatatgggggaaaacatttcccatcaccaataagaggttaaaaaatcttaagaaaatttttactaataataagtaagtttcaaggagaaataaaagtcaaaaaatcgttggaaatttttaaaaaatttatcatgaaattttatttaaaaaattcatgattgtcttttaatttcttaatttgaaaaaaaacattcggtttggggggaactgttttcataaaataccatttcgtttaataggaacaagcggatttgttgtcgttgagtgtgtcagatagtcttaaagaagtggaacggattanggctggagatttccaaattggccatggacattcaaatgttgagcaaagagcacaaagcccttctggagaanaagagatcangtttctgagttgctcagccaacatt

SEQ ID NO: 63268 - DNA, 461 bp, Heterodera glycines
  Genomic contig location: Contig_ID=SeqID_33110; Location=315..775; Strand=+
  SCN-specific regions: Sequence locations=1-156,179-247,279-302,324 -328,360-373,397-461
atgactttaaaaacaaatgctaaggttttctataacaacgcaaagaacaaaaccgaggaatttgtcatctgcgcggatgaagccgaatcggaggaatgtgcgggaaaatattggtaagcaaagaaaggcacaattggaaaacaatttcaaaaaatgtgccaaaactgttgttcaggttctacaatgttcgggaccatttgaattattttgggaaatcggtgtccgaatggggagagaagggatgtgccaactgacagaaaaggacaaaaaagaatgaatgaattgtgcaattaataattcactaattgtagtaacaaaataataatccaaaatatttttttattttttattattattatccgaagaatgaaacttaaaaaatatattaaattttaagggctctttttgatttgagtgggccattctcagctgaacatctgccaaatgatcccaaaaaatga

SEQ ID NO: 63269 - DNA, 114 bp, Heterodera glycines
  Genomic contig location: Contig_ID=SeqID_6911; Location=1655..1768; Strand=-
  SCN-specific regions: Sequence locations=1-114
atgacaacgacacaaaatgcgacggcactttcgctgctcacgatcagtgtcggcattgggtggggtgccaactacgagtgccgacgcgtcaccgatttgccgtgccgatacgaa

SEQ ID NO: 63270 - DNA, 636 bp, Heterodera glycines
  Genomic contig location: Contig_ID=SeqID_6912; Location=247..882; Strand=-
  SCN-specific regions: Sequence locations=1-176,198-470,499-636
atgtctgaccgtcttctcaaccgaactgtgagcgattcgactcgacattccaacaaaccgctggtgccatccagtacgaagggaattgatctctgcctgttattttatgtctacgttgtatgccaacagtaaccgtactgtaattcattttcatttccaaaaacctattttttacttttgtatgttttctgttctgtttaaactcgccctgaacattttggctggttctttttaccgttttcatcggatctacattttaattacagtaatgtctttaaatttgaatttagcatgcccccatacggaaaacccgacggacgaaaaatatatggcaagaaaaagaaaaaattcaacagattgttcaagcaggcagtagaagaaggagtgcagaacgacccgtcacctcgttgcacgaagccgcacacgctattgcaataagagaaggggacctcgtggcaccagcggtaacatacatattggaaattttttattaacattagtcatttgaatcttttgtttaaggtgttacagatgcgcggcttagaagtaaatgatgcgcaggtggcaaatctcgttgaacaagcagcaatggccgcgctggaattgcttcaacaaaatgagttggccctaatgaga

SEQ ID NO: 63271 - DNA, 225 bp, Heterodera glycines; identical to SEQ ID NO: 61696
  Genomic contig location: Contig_ID=SeqID_33112; Location=69..293; Strand=-
  SCN-specific regions: Sequence locations=1-93,115-225

SEQ ID NO: 63272 - DNA, 950 bp, Heterodera glycines
  Genomic contig location: Contig_ID=SeqID_33116; Location=102..1051; Strand=+
  SCN-specific regions: Sequence locations=1-375,400-400,422-424,446 -601,640-700,722-950
atggatggccagccaatttgggatgttttggcccgtgaaatttggccaatttttgcatcaaacattcgccatttgcgctttaacggtgatgatcatttggacaatttgcgtcgtcgcacttcgccgacaattctcaccgatctgaatcagttggattcaatcgattcatttgatctgttgcccgctgcgtttggtgatgattttgatgggccaaattcaacaatttctgctggccaaattctgtccaaatggttgcactctccgagaaaagatggccaacccaagcgattgagttgttataattacaacgaacaagggaacaccaattgggtcaacaatttcaaggaggtgtggcccaacattttcaacaatcactgatttttaattgccttaatttttgttttcaatcaaattgtttttagcattttcttcgtgccaatgccatttcttccgtcagttaccaaattcatttttctgttcatcggtcaattccaatgatgccatttgaattggtgaacgaatcgacaaaggaaaagctgacattggccaaagcaaaggaattgggcaacaattggataatgaaacaatgcaaaattattggggagaaagaggagaagcagcagaaaaatgaaaatttggacaacagttgtaacaatgtggtcttttggctttatatttgcaataattgcattgggtgagcaattaaaaaaggcatttaattttgtttaaataattcaaattgcgcctaattaaggccattgtctccgccaccagcagaagaagccggacaaaacatcaaaaaagtggcgttttctgctgacaatgaatgagtggtgggcccagcaaaacagtggttaacagaagaagaaataattatttaagaatgatcgatcgatttcaaatcagtgatcaaatgcaattttatgaaaaaaaccctctcaatttggtaa

SEQ ID NO: 63273 - DNA, 390 bp, Heterodera glycines
  Genomic contig location: Contig_ID=SeqID_33118; Location=59..448; Strand=+
  SCN-specific regions: Sequence locations=1-95,118-119,172-254,276 -336,386-390
atgtgtccgttaatgaagttaaggactgtgcctacagtacaccacttccgttatggacaatacaatacatttcggtatgtattttttaacgatagaatatataaaagttatatttctggaatatttattaaaatatattttgtaaataaatttaatttatatgttaaaaaactttttggtaattaaggttggttatgataatgcatcctttcatccgcctattatcacctgtcacccgtcaaaacgatgttttaagccaacatccaataattccaatatgtttatggaatttcccgagaagaaaggaaacaattgaataattgtgtaaaaaactactattataattattttattttactttatttataaaatttttactattttagaaaa

SEQ ID NO: 63274 - DNA, 349 bp, Heterodera glycines
  Genomic contig location: Contig_ID=SeqID_33121; Location=8..356; Strand=+
  SCN-specific regions: Sequence locations=1-349
  Gene Ontology: Cellular component=26S proteasome
tttatgaaattcgctaaaaagctaaaaaaggaaaaagtgagtgtcgattttgtcctatttggcgaggccaccgccgagaacaacaaaataattgccgattttgtggacattcttaacggcactgaagagggaggagcctcgcatttgttggtcgtgccggttggagacaccaaactgtacgatgcattgcttcgttcgcccatttgtgcgggtgcgggcgctgcggtaggcgcagtcggagaatttggcatcaacgacgaggacgacccggaattggccatggcattgcgcatttcgctggaggagcagcgtctgcgtcaacagcagcagcaaggcggcgaagggaggg

SEQ ID NO: 63275 - DNA, 1631 bp, Heterodera glycines
  Genomic contig location: Contig_ID=SeqID_882; Location=13..1643; Strand=-
  SCN-specific regions: Sequence locations=1-98,120-182,204-338,364 -1015,1039-1111,1136-1234,1260-1422,1445-1521,1562-1631
atgaacaaaattgacgaaatatctttaactttaacaaacaaaaatacagatttattactaatcacggaatcatggactaacgaaaatgaggaaattcctcttagtccatggactagagaaaattacaactgcatttttgcatcacgaaaatccaaaagttgttctcgtggtggcggttgtggtattttgatcaaaaaggaaataggatttttcataaaattttccggcacaaaatttaattgtgaaattttaattttccaattacaaaatttaaaatcaacaaaatttgcattggtatatagaccaccaaaaacaacgtacaaacaaactatggaacttttcaaatttttggaaaaattttcaagccaaaattacgttgttttaggtgattttaatttttcaaaaagagacctggtatggaaggaagggcatccattttctaagagtaaatttggtgaaattttttgccactttttcagtaagctttctctctttaatgccacgaatggaccaacgagggagaactcgtggttagatttagttctatcggcaaatgatcaaattgtaaagcagtgtaatattgaaggcggggttttttcatcagatcatttggcgcaatttttcactatgtctattccaaaaactactcaaaaacccaaatttattaatattcgacggttcaccccgtcgaatgtgtctcttttaaatacggttatttcatctagaattagcaccttatctcagggtcattttagtgtaaatgaaaaatataacgcctttaataaaacactgctagaaaccttaaacgagtgtattccgataaaaagacttaccaaaaatgagttagcccctaaatatccaacgcatttattggcatccattaaagaaaaggccaaactatataagctgtgtaaaatcgacccaacaaaaagggcactttatgatagcattagtttacacataaaaatacaaacaaaaaaatttcattctcaacttgaacaaaaggctatttcaaagggaaaaaattcaatttttaaatatatacaaaaatatgatgttaatccctttgaaatatcgaatttggtttctgaaaacaaatgctatcataatgaccaagaaaaatgtgaattatttgccaatttatttgtaaattcgtttaacaattctgaagttgatccaggctttctaagcttggacaacacttttgttaatcaaagctttatatcagatatagaatttaacatcattgagacccaaaaacttttaagaaaacttccgaataaaaatggaacttctccggataatattagctataaaacattgaaaaattgccatccttcattagcaactgttattactgaccttttcaggatttcattagactctggttctcttccagatatctggaaggaatcaattgtctttcctctttttaaaaagggggataaattcaatcctgaaaattatagacctatttctttaacctgctctctgtgcagagttatggaaagaattctcagcaaaaatatttacaattttttattaaaaaacaataaaatttcggaatatcaatttggttttgttagaaataggtctacaacaagtcaattaataacagttgtggaagattg

SEQ ID NO: 63276 - DNA, 598 bp, Heterodera glycines
  Genomic contig location: Contig_ID=SeqID_882; Location=1837..2434; Strand=-
  SCN-specific regions: Sequence locations=1-598
atggacaacaccgcaccaaaaaaattcttaacttcccttgaccagcttcaaattccccccgaaattgacaacgacagcgccattcccgactacgcaaaactgcttattaagcagttgcactcgctgttggccaccgcttcgtctctagttcaatctcaagtgacggcgaatgacgcgattgaggaagaccgcagacagcgaaccgttgtcatcaccaatgtgccggagttccaatccgggaaagcgtcggagcgtggggaggcggacagagcactggtcaatttgattttggacacagtggacctcgaccaaacgccagtggtgttccgtgtcggcatgcgaacgcccaacagagcgagaccgctcaaaatggaatttcccacgcgacatgcggctcggcatgtgctcagaatgaagggcaaagctttggcgttgaatgctctacatggtgcgcgcatcagggaaagcatgaccaaggagcaattggccgaacgccggaaattaattgagcagtgcgcaaagaaaagaaaagaagacgcgggagattggattatctacgcgaatcaggtcatcctgcgcagtgacattgacacaattc

SEQ ID NO: 63277 - DNA, 1188 bp, Heterodera glycines
  Genomic contig location: Contig_ID=SeqID_883; Location=2417..3604; Strand=+
  SCN-specific regions: Sequence locations=1-130,164-1113,1135-1188
atggcacttctttcgccacgtttcgatgcgttggtggacaaacatttcgatggcaaaagcgaattgacaatttggagaacgatcgaaattcgtcgcaaggacaaaggaccagaaccgaaactgtctgtgcggatggatagaaaatttatggaatttccattgcccgacgaccgtccgttgcccagtaaaagccgttttaagagccttgagattgtgtaattaaaaatcaaagctttatggcaataaaagcattccttccattttcacagttacattgatcactccgtcatcgcttttcttcgttcaaatcaccaaattttcgacaaaagaggcaccaatttacatttgtggattccttattcaaacaccacggatgggccgcggatttgggacatttttggtcgtgaaatttggccctttttttcgacaaacattcgccacttgcgcttttcccatcgtgatcatttggacaatttgcttcgtcgcacttcgtcgacaattctcactgatctcaaccaattgacttcaatctattcctgtggtttgtttcccgctgcgtttggtgatgattttgatgggccaatttctgctggccaagcattgtccaaatggttgcacacgccgagaaaagatggccaacccaaacgattgcgttgcgaagattacagcgaacaagggaacactgattgggtcaacaatttcaaggaggtgtggccataatttagacaaacgattgatttttgtttttccaatcaaattgtttagcattttctccgtgccaatgccatttcttccgtcagttaccaaattcatttttctgttcatgtgccgtcaatgccaatggtgccatttgaattgcttaacgaatggacaaaggaaaagctgacattggccaaagcaaatgaattggacaaccgatggataatgaaacgattcaaaattattggggagtccgcggcggttcagcagcagaagaaagatgataattgggacaacaattgtaacaatgtgttctttgggcttgttgctggcactaatagcattgggtgagcaataaaaaaaggcatttaatttttatccgaatttgaattttgcgcttaatttaggccattatctccgccaccaccagcagaagaagatgaagcgggacaaagcatcacaaaggggccgtcttctgctgacaaatga

SEQ ID NO: 63278 - DNA, 135 bp, Heterodera glycines
  Genomic contig location: Contig_ID=SeqID_883; Location=1..135; Strand=+
  SCN-specific regions: Sequence locations=1-135
ttgcggtgcgggcgccggtggcgggagcggcgcttttggcggtgccgcgcgcgtggactgcaaaatgctctgatggatggcaccggccgatcgattggatttccgtggctggctgactggtgatgatggtgatca

SEQ ID NO: 63279 - DNA, 489 bp, Heterodera glycines
  Genomic contig location: Contig_ID=SeqID_884; Location=73..561; Strand=-
  SCN-specific regions: Sequence locations=1-120,142-231,262-376,399-489
atgccaatggtgccatttgaattgcttaacgaatggacaaaggaaaagctgacattggccaaagcaaatgaaaatgaatgggacaacagttggataatgaaacgatgcaaaattattggggagaaagaggagaagcagaagaaagataaaaattgggacaacaattgtaacaatgtgttctttgggctttttgctggcactaatagcattgggtgagcaattcaaaaaggcatttaattttgtttaaataattaaaattttgcttaatttaggccattgtctccgccactggaagaagttgaagaacaaacgggacaaagcatcacaaaagggacgtcttctgctgacaaatgagtgacggacaaaagaacaaaatcaatgggcagacgcagaagaaatgaatattaattgaaaatgaccggacgatcataattcatcagtgatcaagtgcattttatgaagaaaaacctctcaatttcggtaaataaa

SEQ ID NO: 63280 - DNA, 458 bp, Heterodera glycines
  Genomic contig location: Contig_ID=SeqID_885; Location=574..1031; Strand=+
  SCN-specific regions: Sequence locations=1-28,50-458
  Gene Ontology: Mol. function=protein binding; Cellular component =nuclear speck; Biological process=protein amino acid phosphorylation
atggcctcctattggcgtctgaaaagcattgaggagtacgagttggaaatgtccacgaaaagcaaggagacgcgtcgctatgtgttcaactgtttggacgacattggccaagtgcaccttccgtccgacttggacgacatcgaccgaatgtgcgagcggaatgaccggcttgaatttgtcgacattctgaagcaaatgctgagcatggaccaggtacagcttgaactccttgttggactcaaacaccggcatcagaaaaaatctcaacctttttaatttaaggaccgtcgtctgacaccgacccgcgggttgcagcacaaatttgtaaaaatgacgcatatgatcgagatggggcgcactaaatactgccaggtaataaacagttaactgtaagcaacaaattgtaagcaacatctgcaatttagtcccataattcggcatttgacatgccaagtcta

SEQ ID NO: 63281 - DNA, 388 bp, Heterodera glycines
  Genomic contig location: Contig_ID=SeqID_885; Location=1922..2309; Strand=-
  SCN-specific regions: Sequence locations=1-276,310-388
atgaaccgacggtaaggcatttgaaaagtcacaaattcgtcatttatttagctaacaataaactgttttcccacttcagttggatttgcaacgacgtttggatggacattttcccctgttttgatcgtccccaactcggcctcaaaatggcacttctttcgccacgtttcgatgcgttggtggacaaacatttcgatggcaaaagcgaattgacaatttggagaacgatcgaaattcgtcgcaaggacaaaggaccagaaccgaaactgtctgtgcggatggatagaaaatttatggaatttccattgcccgaccgtccgctgcccagcaaaatccgttttaaagaccttcggattgagtaatttaaaatcagagttatggcaataaa

SEQ ID NO: 63282 - DNA, 690 bp, Heterodera glycines
  Genomic contig location: Contig_ID=SeqID_6913; Location=1890..2579; Strand=+
  SCN-specific regions: Sequence locations=1-82,212-241,271-381,431-690
atgctaacgattatgtatgcatttgaggtacgcatgttgcagtagcattaattaaaacggattaaagccacatgtaagtggataaatgattaattactttaataattattttatttcaaaaactttatttaattaattagataagattaattaattttttattgtatttcatttttaaacaaattataattattgatttataaaattattatcatctagaaaaggaaaaaatgcgacttacaaaaatatataaaaaatattttaattattggtttatgatgcgtgatgaaaataattgttcttttaaatgaatcacataaaatgtaatattgccttggtctttctttatttatattgcagttttttaatatctctatttgcttatattattatattttaatttttttaagttaatttttatattattttagagttgtcgtgatgctgctaaccaccacgttagagactttgggttgagcttgatggcattgagaaggaacagatagagcggcctggaattgtagacatatgattgaatatttggtttcagttttgcctttctttcgtttatttatgaattaacagatttctataattaaaaatgctttattatttaggtttttaaaatctctgccattccgcgccggcagtgcccgagtgaggaagataaattatttgtttatatgatta

SEQ ID NO: 63283 - DNA, 2587 bp, Heterodera glycines
  Genomic contig location: Contig_ID=SeqID_6914; Location=1..2587; Strand=-
  SCN-specific regions: Sequence locations=1-638,660-1482,1504 -1573,1605-2587
ccattcgcgtttgcttaccttgacgacatgattgtggttagtcgttcacacgaggagcatcgaaaacatttgaatgaagttttcaaacgaatcggaaacttgattccggatcaaaccatacaagtgctcgttcaatcagaagcagatcaaatatctcgggttcgtcatcgacaaaaatgcaaggtgaccggatccatccaagactaaggcgatttctgaaatgcccgtccctacaaatgtttcggagcttcgatcatttttgggaatgatcaatcaataccaacagtttgtgaagaacatgcgatttcttcgacaaccattggacgagctactgaaacaggacgcggcatgggtctggtcaacggactgtcaaaatgccttcgacaaagtgattgaagtgctgaagtcggaccaactcttgacccattatgacccggaaaaggacatcattgtttctgccgatgcctctgattacagaatcggagcagtgatttcccatcgttttccggatggcagcttaaaggcaattgcacatgcatcgtgctctttgtcgcctgccgaaatgaactactcccaaatcgaaaaagagggactagctcttgtctttgcagttcagaagttccacaaatatctttccggaagacacttcgtcctgcagaccgatcacaagcctttgttgaccatttttggtaacaaaaagggcattaaagcgtgtacagcaaatcgcttacagcgctgggcactcatacttttggcgtatgattttgagatcgaataccaaaacactgctgattttggtcaagccgatgctctttcgcgcttaattgcaaaagcgccagtgcccgaagatgaatttattgtggcaacaattacggaaagccctaatttggcaactgtgaatgcctttacgcacaatttccagttgtccacgaggacattgtcaaggccacggaagctgataaattgcttcaggaagtgaagggattcgtcctgaaccaatggccaaacaaatgaaaagtctcgcccgccagcatatgtactggccgggaattgatcaatggtgagaaaatgtgagccttgtgccaccgaagcgaaggcaccaaagaaaacggaactacattcttggccaaaagccgaagggccatggaaacgtgtccacatggactacgccggttccttctttggaaagatgtatctgatcatcgtcgacgcgcactccaaatggccggaagtgttcgaaatgcgttcgaccggatcagcagcaacaattgaacaattacgttcactttgcgctcgttttagattgcctgaaactttggtcaccgacaacggcacccagtttagctccaacgaatttaaggaattcgtcaaagaaaacggaataaaccatctcttctcagcgccattgttagagaggcaaataattcaaatatttgcaattccctctcttgggctttttgaccccatattgattttttcccattcattcatgcccttcccttcgtccatcctgattcattctgttattttccttgctattttgtgctcccccaatttgctccgtccctccgacaaatatttatttgtttatttattttccatttgtgttaataaatttatttggtgttctacttccacaaataattgttgagcaatcaaccggctcaacattggcgacgcccgttcttcaggacttcacttcgaatattttctcgtgttgaaattgttcgaattgtggaaattcaaaaatctcgtgttgatttttggatttcgcagaaatcttcaaaaaaccaatcactaatcttgtgtgcggttctgctatgtgcagtttcttcgtctaagtcaatcctccaaatcaacaatggacaaaacgctcgcggaaattttggaaaaattaacgcaagcgatcaaacagcagagcgcgccgacatccacaacaactccaccggcacaaaacatcacattgccggatattcatccgttttcaacagaaaatgcggaggaattcgaggagtggttggagcgattccaattcgcattggattgcgcagcggccaatatggcggatgaagcgaaagtcaaattgttgatgacaaagctcaatccggccgccttcggcgaatacaagcgctactgcctgccggaggaattcaccaaattcaacttcgcggacaccaaatctcgtcttattaaattgttctcacatccgccatctttagcgattgatcgctatgaatgcctgcgagtgtgccgagagaacggcgaaagttttgaagtttttgtgaaccgactaaaggcagccctccgcaaattccgtttttcggaattaaacgaagaggaattcaaatgcctggttctcctcacgtcgctgaagtcatcaagcgacgccaaattacgccagcacatcctcgcacgtctcacagcggaggactcaaagacgacgaaaacgtccaaattattcgacaaagtcgttgaggacttaaatacacagctaaaaacggaggcggaagcaaaaattttggaggcgccaaagcccaaaatcaatgcaattcaacacggcaaaacatcgccaaataagcaccaaaat

SEQ ID NO: 63284 - DNA, 1266 bp, Heterodera glycines
  Genomic contig location: Contig_ID=SeqID_6914; Location=2703..3968; Strand=-
  SCN-specific regions: Sequence locations=1-1,34-64,105-147,176 -350,372-375,397-462,485-511,533-547,582-645,667-735,809-812,854 -890,923-967,989-1094,1123-1266
atgggacgagattattttttaaagaagtatttaaataaaaccaatagtgagtcacagaactgccatttttattttaaaaatatcaaaaagaataaatttaaattgcaaatttgatcattcaatatcaattgcacgaaaaatgtcacgtaaaaatagttataataaataataaattgaagcaaattgttgtgtccgcaaggaacaacagaattaaatttattttagaaagacaaatgataacaaagaaataaataataaaacaaaacaaataaaataatgatgacgacggagtcagaggaaggcaaaaatggaaggagcaaaacagaaataatttagaactgaaaatgatgataaaataataaaataataatgaatgaaacaaaacagcgggggagaatattgactgaagaatatggcgtccaaaaacaacaggaacatcatttctactgtattggcgctgattcaaataataattaaaatccatcatatccaacacaaatctgagatttacataaaatacacaacaaagattgatataataaattcctaatattataataaataaaaagattaaataaaatgatatcaaagaaacaaatcaaagaaagtaaaaattttttgaaaattaatcataaaattctaattgtactttattttttcaattaaactttgattaaaacttcgttcatcacacacagctcattacaagatcatatattcagagttttgataaacaataaatatgaatttttaattacaaaatttattttaagttaagttataattaaagctataataataaaaaattcaggatttaatcagtaaaaatataagattttaaaaagtcaaccatggcgtcttgttaataaattataataaacataaacaccataataaaaaatttaatttaatgttaaataaactagttaatatactaacgaagctaaactcgatttaaaggtgacaattttcttaaaaattgtaaatataaaaatcattggatttataaagaataaacttgcaagtaatttaaaaaatccgaatttgggtaagaaatattgcttatatatcttctcatatgtagaaaagaaaacaatattaaataaaataaaaataattttaggagtacacaaaccccatcaagcctcaagctttttcaacacgaaaaatatcaaaaaccgcgaggttcgagcatcacctttatataatgcattaatgaaagctgcttaaatataactaaaaatttaatttggcttttaaaataaa

SEQ ID NO: 63285 - DNA, 988 bp, Heterodera glycines; identical to SEQ ID NO: 33124
  Genomic contig location: Contig_ID=SeqID_33124; Location=1..988; Strand=+
  SCN-specific regions: Sequence locations=1-850,872-988
  Gene Ontology: Mol. function=GABA-B receptor activity; Cellular component=integral to plasma membrane; Biological process=negative regulation of adenylate cyclase activity

SEQ ID NO: 63286 - DNA, 946 bp, Heterodera glycines; identical to SEQ ID NO: 33125
  Genomic contig location: Contig_ID=SeqID_33125; Location=1..946; Strand=+
  SCN-specific regions: Sequence locations=1-80,105-118,140-946
  Gene Ontology: Mol. function=cation-transporting ATPase activity; Cellular component=integral to membrane; Biological process=mitotic spindle orientation

SEQ ID NO: 63287 - DNA, 702 bp, Heterodera glycines
  Genomic contig location: Contig_ID=SeqID_33126; Location=35..736; Strand=-
  SCN-specific regions: Sequence locations=1-140,162-177,199-211,233 -300,323-702
atgagtggaaagcgcgcattggcaaccattataaaaatttacatcgatgaaaagcgagataaaaaacagaaaagtgaccagcaatggagcaaatccaagtggcagcgattcttgcaactttttcttaaggtggtggaggacgaaaacggcacaaatggcaacttggcattggaatgtaagtgaaaacaaataaatttatgtttatcgagagacattttttctgtaatttaaattttagaaaggtagaaaattatttttctgtcttatccatcaaaaacaattattttcgtaaaatataagttttaaaaaactggtggttttaaaatcggtagaacttttttgttttttgaaaaaatcactaaagattcatttttgaaaattcttagctggtgatttttttgtattgttaagagcttttgagaaagcctaaatttgccaaaaatgtaaaaagataaaatatgtttttaagttgacaataaaaagatgaagaaaaaacgaaggggaaagcgatttgccgacattgttttcagcgccgttttgttgattttattggcctttgcctttagcgccatttttcataaattaaaaagacaaattggcaaatgttttggatcacagcagccaaatgcaaatggccaaaacatatgggcacaaaatggagaagggtggacaagcggagaagaacaaataataaggggtaag

SEQ ID NO: 63288 - DNA, 932 bp, Heterodera glycines; identical to SEQ ID NO: 33127
  Genomic contig location: Contig_ID=SeqID_33127; Location=1..932; Strand=+
  SCN-specific regions: Sequence locations=1-267,299-798,820-932

SEQ ID NO: 63289 - DNA, 58 bp, Heterodera glycines
  Genomic contig location: Contig_ID=SeqID_33128; Location=47..104; Strand=+
  SCN-specific regions: Sequence locations=1-58
atggatttaaaactaaaaatgcaaattttgtattgtcgtccgttgaaaacacctccaa

SEQ ID NO: 63290 - DNA, 789 bp, Heterodera glycines
  Genomic contig location: Contig_ID=SeqID_33129; Location=18..806; Strand=+
  SCN-specific regions: Sequence locations=1-789
atgtgcaatgccgtaaacggaagcgacacccgcgcactcctcatgaccgcaacttcaacggccttcaatccagcacaaccgcatctcagcatgactgcggcaattttcatcgatccaggcagccacagatcattcatttcgttaaaggcagcacagctactggatcttccgttggtccacactgaagaatgccacttgaccagtttcggagaacgcgaaccaaaaagatacatcagcgacctggtcaagctcggatttctctgcacgagcggggaaaaactcatcttcaacctcaacgccatgaaattcttggtcaacgacatgccaatgattcaactgtcagagctggacaagacagagttgaggcaacaaaagctcaatcctccgcatgaacaacgacaacctgacatcatgctcggaattgatgtctggcacgaactgcaggttcaaccaatcgaaaagttgccaagcggcttcacactgtgccgatccaaaatcggcaaaatcttcagtggatcaggacgcatcgaaatgcatcaaacgccaaacgtgacatttgtcatgtcagtccacggcactgagcaagaagaagccaatcaatcagtcacgttcgaatcaaccaaagaagagacggaagtcttcacaaccgaagatgatttcaaaaaggacgaacaactcaacaacttcttcggattaaatctgattggcatggacgacacatcaacaccaatcgatcaggattatgtgatgatccatttcaaaaagaacctcacgttcatcaacaactga

SEQ ID NO: 63291 - DNA, 469 bp, Heterodera glycines
  Genomic contig location: Contig_ID=SeqID_33131; Location=3..471; Strand=-
  SCN-specific regions: Sequence locations=1-469
atggaggggacggcattgacacgtgcgttttgcaatgggatcagcgggaggggcttgtttataaagttttctattgaacgcattcaaaaagcggatgggatgttcaatttcctaaattccatcgctttaatccggaacgtttttttgttcagaatttcgtacggtccgtcgcgggggcggcacacgtcgacaatcggcagaatatgaggacggaaaggagacgaagcaaaaggaagaaggggacgaacaccgacaccaaagttcatcttcatccgccaatttcggccgctcttccgactccgagcaaatcctacgcgaattcaacaaagaattcagcggatttatgcgccaattcgttatgtcccgtgacaaaaagccgggcgaattcgacgagcgaatgaaagcattcatccgcgacttcaacaagaaaatgccgcccgaattcgaagttgaaaggagtgcgttttaa

SEQ ID NO: 63292 - DNA, 403 bp, Heterodera glycines
  Genomic contig location: Contig_ID=SeqID_33132; Location=128..530; Strand=-
  SCN-specific regions: Sequence locations=1-251,273-335
atattggtcagacattcaaatcccggacgatcatggacaatttcattacatttgtccgttctgcaaagagacgctcgttgaagcaaagaaattcatcaaattgttcatcaccaccgatgaacaggaagaagccgaaacatccgccgccggaaaagggaaatccgtcgttcattattaaattggcgagaaaaacaatcgtgccgaaatttatttaaaatgcattgggtttcatgcaattagcgaaagtatttaaaaatgggtccaagaagaaaacagtttatccgtatatatcgcatccatgtccatgtccaatgctcctcatcattagggtgaggattttattttttttaaatatttcgggaaaattttaaaaattgctaaattaaaaaatatttaaaataaa

SEQ ID NO: 63293 - DNA, 313 bp, Heterodera glycines
  Genomic contig location: Contig_ID=SeqID_33135; Location=238..550; Strand=-
  SCN-specific regions: Sequence locations=1-215,239-313
atgtctattattaatgttccaaatgtccaaattcgccagtgtttaggaaattgcactggatacagtaagtcaccggaaatcccacagaaattcggattggtatggtattgttcaatgccgaccacttcttctgttgttaaaatgccggatggaactgtaaataagagaaaggctgtgaatatactaatttaaatagtcagaaaaagatttgacccaaaaataaatattattttttttaccaatattttcagaaaattcctcttttgagaaaagcggaaagcgaattttgaacaatgccgggccaagcatttga

SEQ ID NO: 63294 - DNA, 337 bp, Heterodera glycines
  Genomic contig location: Contig_ID=SeqID_33137; Location=474..810; Strand=-
  SCN-specific regions: Sequence locations=1-337
aagcacttctctgaaagaagcggacggaagcgacggcgccgttgagaatgtccaaacgaaggaaaatatgcggccaattttggaagcggagagacaccaacagaacgacgatggcacaggggaaagtacggcattgggcgagaacgtttagcagtcacccaaaaatgctcaatttgtaatgctttttttagtccgttcgcctccgtcgtcttctcccactccgtggcatccttcgcatgcgctcgctgaaccgacgtggcagaaactgttgaggaaggaattccaaatgaaatacatgacgaacatttgttgctttttggaggaacaagccaaacag

SEQ ID NO: 63295 - DNA, 751 bp, Heterodera glycines
  Genomic contig location: Contig_ID=SeqID_33139; Location=146..896; Strand=-
  SCN-specific regions: Sequence locations=1-424,447-656,699-751
gtggattttagctccccataattgtttgagtaccccaaacggacacttgaaaaaatcgattttttttgtattcgggcagtccccccgaaccgatgcgcccagatttatggggagaccgaatccttcgggaatagcttccctatagcctgtactttaattctgcgttggatttttgctccccataattgtttgagtaccccaaacggatacttgaaaaaatcgatttttttgttttcgggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgtattcgggcagtccccccgaaatattatgaaaaatggtgaagaataaaaatttttaattcatttttaaacaggcaaaaaagtttaggcttaacttttttttcagaaacttatcagaagcgccccaaactttacagggatactgaaaggaaaagaattaacctgttttatcacattagctcgtcatcagtttttataaaaaattttcaaaattctgagtgtgagtaccttgggcgcaggaaaattattaaggaggagggttcattatttatttatttttgcaaaattaattcataattttttttcataaactgctctgaaacgcaccaaaatttatttacaagttgaataaggcact

SEQ ID NO: 63296 - DNA, 1589 bp, Heterodera glycines
  Genomic contig location: Contig_ID=SeqID_6917; Location=1638..3226; Strand=-
  SCN-specific regions: Sequence locations=1-67,89-380,402-441,464 -636,658-729,751-1454,1476-1589
aggctgctgttcacagtcacttggtcccgaccagctccatccccaacttcaaattggaatcggaccacgccggcccctcctccttcacgccggtcgcggctcaaggcaaaacgatgtcctctcccgacctgcacctccaggcaaacatttcctcgggttggtttggcaaaagcgacgctctgtcccccccatcactcatttttcccaatttgcctttgctcagctgcgtctgctcataagcaactccattcgcccatttttccctccgaagctcttctcgcccttcaccacgcttcctgctccgccactttgtccgtgcccgccaatctccccggcgggggacaaagcaatccttcgttcagtgcgcagagcagtcccggggggtcgggcgggtcgctgcttagttcggcactttctccgtcatcccaactcaacggcaatggactgacagagtgagtgaacgatggcttatggagagactttttaggcactatgaatttgataaataaaaaaacatttttagtcttagcgccccgtcaaaaatatcgccaatgcttaacggcaaatcaggcgatgaccaatggaaagccggcgaaggcataaagcagtcggtctgcccgccccaaatttcaattgtaagtggggaaagggcaaaaaccaatcacgtctaccgatttgacaaatggggactgatttacgaaattgttttttaatggctctgttcattctttattctaaacaccaaaaattggttcaaacttgaagtcccagcaaagtccgtacgcgaaagggcccgattcggtcacttccaaagcatccagcgacatgagcaaggacagtttccataatgcggcaccgacggggggaaaggagaaaactcgcaaatacaccaaattttatggtggaaggtaatgaaaaggcggggatttagcaattgaaaatgcgactatttaagtgcggatagccaagtgagttcaacgcggggaggccgaggccgaaggtcgattataaagtgagaaagaacgcacaaacgccaacgataataaaaaaaacatagcgaactgctcccggacgaacggcgacagacaattttggaacggaacaaagccgcggcggtacggtaccgaaagaggaagaagtgagtcacggggcagcaggggaatttgaaattaacaattggtacatttgttaccttctgattgtgagtggggtgttttagtctcaaatttgattttcgatcattgcttaattcgtaattttttcaatttttctccagggaagagcatgacgatatgatcacccgggtgacctctatggagcaagaaaagaacgctctggaggtgggcaagttcgggttgggttcgccttgtcattgtccgtccttttcagacccaaaattccgtcctccgtcgcgagttggagcgactcaactttttgctgcaggttcccctttctcttttttccctctgttcttttcaattctccttttcaggagcgtgaaagtcgttgcgtttgcaaggccaaccaattgcaagtgggcgtcagtgtgctggacgaaagccgaagtccgtcggttggctttatgaacg

SEQ ID NO: 63297 - DNA, 133 bp, Heterodera glycines
  Genomic contig location: Contig_ID=SeqID_6917; Location=283..415; Strand=-
  SCN-specific regions: Sequence locations=1-133
gacggaacgggccaactccgtctgagccaactttgagtcaatataactcttgaagttattgaccgaatcaaacaatcttgatatcattcgaaagctcttcacaggctctattagcctactaaaaattacagaa

SEQ ID NO: 63298 - DNA, 117 bp, Heterodera glycines
  Genomic contig location: Contig_ID=SeqID_33143; Location=134..250; Strand=-
  SCN-specific regions: Sequence locations=1-57,79-117
atgttcaaaaatgcggaagaaagggcaaaagagaatgaagcatggagagccaattcaataaatgatgacaagcataatataattgtgtattcgaaattcgatgattatttaaattgg

SEQ ID NO: 63299 - DNA, 60 bp, Heterodera glycines; identical to SEQ ID NO: 52045
  Genomic contig location: Contig_ID=SeqID_33145; Location=652..711; Strand=+
  SCN-specific regions: Sequence locations=1-60

SEQ ID NO: 63300 - DNA, 906 bp, Heterodera glycines
  Genomic contig location: Contig_ID=SeqID_33147; Location=2..907; Strand=+
  SCN-specific regions: Sequence locations=1-320,342-498,520-906
atggccaagttcagtcagttcaaattggaaaatgaggcgctgcaattggattttaagagcggaaaaagtgccaaacaaaaaaataaaaggctgaaaacagatggaaaggcaaatggaatagaatttgagcaaaaaatggaaaaaatgttcaggaagataataatagagaatgctaaattggcaaatggaagctcatcatcggcattttcatcgtcgacatttccatcatctgcgtttccgttaccgatttccatgtgcaccgtacctatttatgatgccgctttgcgcgtgccaatatatgacatgagcgatgctgtaagtttctcgaaaaaacaaatattcgggttagggctgccattcgacaaaattactcggaaaggcttccggaaaaaatgcgtcagcaatattaatttccataccaattcaggattagttttcaaattataaaactactgtatctctttttaaattcactgactcattttccggtcaagcttggaaaaataaagaattacagaagtagccaaaccagattgaatttttgaaattcctgccggaaatgccaaaagatttaaatggttgttttttcgtgccatttttgataaaaaatctcaacacttgcagattgaagaagaattatttcctaaatttgtgaacggaagtgccgatttttccacacattttgctgctgtaccatcaaataaaattaaaaagtacgaaactcatcttggcctactgtatgcgatgaaaacaaattggcgttgtgccaatgccaaaaataaaattgacaacagctgcaccaaatatcgccgatacattgacattttgtatgaatatttgttcatgatgcgctatgggattaagtctgtgaaagccgatgtcgagactcttgtagggccacggtaa

SEQ ID NO: 63301 - DNA, 403 bp, Heterodera glycines
  misc_feature (15)..(15): n is a, c, g, or t
  misc_feature (20)..(20): n is a, c, g, or t
  Genomic contig location: Contig_ID=SeqID_33150; Location=36..438; Strand=+
  SCN-specific regions: Sequence locations=1-403
atccgaattcgccgntttgncatccgaattcgccgttttgtcctccgaattcgccgttttgtcatccgaattcgccgttttgtcatccgaattcgccgttttgtcatccgaattcgccgttttgtcatccgaattcgccgttttgtcctccgaattcgccgttttgtcatccgaattcgccgttttgtcctccgaattcgccgttttgtcatccgaattcgccgttttgtcatccgaattcgccgttttgtcatccgaattcgccgttttgtcatccgaattcgccgttttgtcatccgaattcgccgttttgtcatccgaattcgccgttttgtcctccgaattcgccgttttgtcatccgaattcgccgttttgtcctccgaattcgccgttttgttctct

SEQ ID NO: 63302 - DNA, 368 bp, Heterodera glycines
  Genomic contig location: Contig_ID=SeqID_6919; Location=2986..3353; Strand=-
  SCN-specific regions: Sequence locations=1-187,209-368
ctgtttgccgggctcccagaaaattggatgagttaccaagctgaaatatgcatgccaaaaatagaaaccacgcaaaacaaatgaacatgaacgaacattgacgaagttggacgcaacgcagcgttaagccgaagcattgaagcgatcagtgaacgcgctgtgtgatcagaatctgtaattggtcaacttaagtcagacattttatgtaatataatgactagacatggaaaaaagccatcaaacgatcagataaaaagtaatgagtaatggtccgatcaagatgggttccaattcagtaatctaaaccaccgatcctgatcacgggtatgatgatgcaccgatcagtaatcaaaaccatcaagtcagat

SEQ ID NO: 63303 - DNA, 5189 bp, Heterodera glycines
  misc_feature (316)..(316): n is a, c, g, or t
  Genomic contig location: Contig_ID=SeqID_6919; Location=428..5616; Strand=+
  SCN-specific regions: Sequence locations=1-66,88-218,240-745,923 -1039,1083-1108,1133-1333,1355-1664,1689-1863,1885-2125,2158 -2718,2740-3699,3723-4115,4137-4213,4238-4244,4266-5113,5135-5189
  Gene Ontology: Mol. function=protein serine/threonine kinase activity; Cellular component=endoplasmic reticulum membrane; Biological process=response to stress
cgcgcgcggtgcttggccgcggctgcgacggcacttttgtgtaccggtgcgttgcttgcgcggatggcatcatggaaattgtgtttgctcgagagtcgagaccgaaggattgtttttggcattttgagcccgaataagttttcttcggcctcggcaactcggcatgctgtttattgagcctagctctcgacactgtcagggaaccgaaaatttcaacactttttccaaaaaacatttgggaacctccactcggaattctgtggccaaaaaaaattgagaatcgggaacgagaatcggtatgccatgtcccaaacangggaattttgggaatccgggatctgggaattgccatttttcgcattgtttttggttatcaccggtactcaagactgggaatctcttctcaaggttttgatcttgccaaaaaagttgagtatttttcactggacaataatgctgaaacccgagactctcgagcattacgcactaattgcttttccactaattggtgttatgtcgcccaggggccaattcgacgggcgcgacgtggccgtgaagcgggtgcaggcgctgctgagcgcggacaacaattggcaccggatcatcgaccgggaggtgacccatctgcgcgagagcgactcccatccgaacgtgatccgctacttttgctcggtaaaagacgatgcttgcaactcactgattgatcaattaaataaatacgattataacataatcatctgtctacaaattttttttttaaattctataaatttatttaaagaaagtttccttaaaatgtatgaaattttttggcattttttttttgtaaattataaaattcataaaaaataattactttacaatattcctaaatttaatctttaaaaactattatatcttttgattttacaaaaattttataggtggcacaagtgccaaattgatttgttaacaattttttattttggaagttaaagtttggaatttttcaaaaatctaaaaaattatagggaaaaaataatcaaattatttcacatagttatttttttttatattttattaaaaagtaatttaatataattcttttccgaatgaaaagttgttaaagaattatttttaaaaattttttttactctactcaaattttttttttgaaattttttccaaaattttttcaggaatccgactcctacttcagctacattgcgctcgagctgtgcgaccacacgctggaggacttcatcaaccaccagcggggcaaaatggagcgacggctcaagctggaactgctgcgccaggccacggacggcatcgcgcacttgcacagcatcaaaattgtacaattcatttgtttaattttcagacttggaaatttttacaaaaaaacatgaaatttttgcttaagaaatttcaagaaaggattttttaaaattttctagcgttttttggaaattttttttgaaaaaactgaaattttcttatgaaaaattttcttaaattttttttatgaaaaatttcgcacattgatcaaacccattttcatgactccgatcaatccaatcggttttcccattttcaatttgtcatcttttcaggtacaccgggatgtgaagccgaaggtcaatcacacaacattaaatgatgcggctgcaatttccaatttcattttttgttgtagaacattttgatcaacggcgtggccaagggccccccgcgggtcaaaatttccgactttggcctctgcaaaacggtgaagctgggccacaactccatctccaaagtgtccggcgttgtcggcaccgaggcaagggagaaaaacactatctgatcagagctgatctgagcaggctttgtcggtctgatcagtgccaacagccattgttgatagatcatttgtctttgaattttataagtgaacaattaattaggctcacatttttgtcttttagaaaggttctgaatgcccaaattttactttaaaaataatcactgatcaaatcaattttttagccaatcaatcaataattttgccacaaaaatctaacaataatcccatctttagggttggatggcgccggagctgtgggactcgacggcatctgtggtagaaaaaatcccaatcaaaatttcagaaattttaaaattttacaaagacctatgccattgacgtgttctcgctgggctgtgtgttctattatgtgttgacggagggtgaacacccatttggtgactcaaatgtgcgcctgtacaacatctccatgaacaagttcaacctgagcaaattggatggtgagcggctaactaaaaatggatgaaaaaatcacataaaaacgttatcagcaactgtgatcatgatcactgatcagtgttcggtatgataattgatcgggaaatgtttactgatcgctaaacatttcatacccgtgttttgatcagtgttcagaacccagatggatgaaatggtcacttgaaaaattaatcagcatccgtggtcatgatcagtgaacaaaatgatctttgctcagaacccatttcatatccgtggtttggggtcagtgatctgacttgatggttttgattactgatcggtgcatcatcatacccgtgatcaggatcggtggtttagattactgaattggaacccatcttgatcggaccattactcattactttttatctgatcgtttgatggcttttttccatgtctagtcattatattacataaaatgtctgacttaagttgaccaattacagattctgatcacacagcgcgttcactgatcgcttcaatgcttcggcttaacgctgcgttgcgtccaacttcgtcaatgttcgttcatgttcatttgttttgcgtggtttctatttttggcatgcatatttcagcttggtaactcatccaattttctgggagcccggcaaacagttgcaatttttgctggtacgttatggcatttttttgctgttgtattagcctatttggttcagtcttcgttttaagccaaactaaataatttttggaaattcttggtagctttcggctgatcgctttgttgagatccgataacccataggctggctgatcagactaaaaattacccgggcattaatttttctataaatttcattatcatcaggcatggtttttctttatatcaggtttttcggtcattttaagcaagaaactaatgaatgatcaatagagttaagccaccgatcaatttttttttgccattctaggtctcttctgcttgactttttttaatgaattgatcaaattggcatttttgggtgggctgaccaaactatcaatgctcatggcattaaatctggttagatcagactgaattaagccactgatcagttttggcttccttgatcaaatttcccaatggcaatttttctgtaggaagtgagtgatcggattgagaaattggaatcgcacgatctgatcatgcgccggttggagtggcgtcgtgccgtcgtggttggcacttggctgaaccgaattgacgaaccgttgaaaattggtacatttttaatcttggcttttcgtccgccaaaaattgacattttgtcccacccaaacacaaaacagatctcttgaagcagcgctcctaccagaacaatgtgcgcgatttgttgcgtgcaatccgcaacaaaaagcatcattaccaagtctggcaccaatttgcactcaaattttaattttttggcattttgtcactatttaaaaaaattttgccaggaactttctctggagctgcgcactctgcttggccgcttgcctgacgagtacattgcctatttcacttcaagattcccagaggcaagtttttttaaaaaaaagttctatttgacaatctgttgaaatttgaatattcgactcgaaaaccgtttttggggttaggggttcgttttctttgatcgagtctcgttctcgaactctgcgagaatctcgagtagcattaccattttattgtcttcatcgcatttgttggcatgatgttcatcaattgtcccacacttggcaaaacttttgtcaaattgtcccacatttggtgacattttgtctgccagtccttagtgactttgttcgacatctgtccaacaacttaaaaatgtttgtacaattatcccttagtaatattttattcccatttgtctcagctttggtggcattttatccaattcttcccctaatccataatgacattttgtccaattctttcttcaatctttggtgacattttgtcccattctcccccaacatttggtgacattttgtccaattcttccccccaacatttgatgacctttgtttggcacagttgctgatgcacgccttcatggcgttgacgctgtgggcccatgagaatgtgttccgccgcgacttctaccccaccgatcagctcgtcgagttcttcgagcgcgagcgcgacacgatcttcaaaacggaccaatcgccgcacgaccgtcgccgccgcagttcgagcccgtccaactggcgcagcgccagtgccgtaagaatggcaatcgattggaggcggaaaagcatgcccttgcttgatcccgaatcaatgggtcatggtgatggtctcgggaatttctctttcccgggactatttgacaaaggcacatggtgccggggaaggacgtccagggaaaggacgtacttggatttcggatttatagtaccagcctcaatggtgaagattttgtcgcatccaaattttcgacctccccccggatgagggctttattagaggggggcactaatagaggggctgggatctctattagaagaaaagtggtaccgcagtccgagtttggatatcccatttctttttagcatgggttcaattttcaacccaccctcccacttttaggtgggctttatttgagagggcggcactaatagaggggttgtgtggctctattaaaaggatcccttcctgatgcttttgttcaacacagtccctccccatccatcagcagttgtcccgagcgggaacaccgacacggaatggcgtcggcgccggcacaattgtgccaacaaattatgccattggcaacatcacggccgatggcatgcatcacccggttcgcaatcagttgcagcagcagcagaaacttcccttgcagttgcccgccttcaacccgttcatgccaccgccacttccaccggt

SEQ ID NO: 63304 - DNA, 499 bp, Heterodera glycines; identical to SEQ ID NO: 60789
  Genomic contig location: Contig_ID=SeqID_33154; Location=293..791; Strand=+
  SCN-specific regions: Sequence locations=1-107,134-263,292-499

SEQ ID NO: 63305 - DNA, 566 bp, Heterodera glycines
  Genomic contig location: Contig_ID=SeqID_33155; Location=24..589; Strand=+
  SCN-specific regions: Sequence locations=1-215,237-566
atgtccgctgggagcgtactccgcacaagtgtcctctacaaaattggtgttgatcattttttgctacgactaaccgtattccgtgtacaagtgagcaaaaattgccaactcgaaaaccggaatttcgtttttcgggaataactctgcgggatttgcttatatccagtgcacatagaaatgattatgtgtaattttttgagctctatccaaccgtgtttttggatttttaaaattttcagaaattttcgagctaggcctaaaaaacggttttttggttttttaattttctgattttttaacgaattttccaggaaaaacggagaccacttccaaaacatagtttttcgagctctatcgattggtgacattttcagaaaaattttggtttttttccggaaatagaaaaattttttgctctgaccgggacatttcagtcccgggcctataactcgtcgggagttgattttagccaaaaatcttgcaagagcatttttgtagagaattttaagctctatccaatgtgttttatcccatatttttaacatgagtataaaaaaagttataaa

SEQ ID NO: 63306 - DNA, 158 bp, Heterodera glycines
  Genomic contig location: Contig_ID=SeqID_33157; Location=1..158; Strand=-
  SCN-specific regions: Sequence locations=1-158
aaaattccctcaaaaataaaaggtctattgcgcaccgccctccctatcgtgctcgagagcatttgtatgtgtataaaatttatcaaaaaaagagatagccgtttttctgcgatgacctctaaatataaaaatccctctgtgaaataaaatggcgattg

SEQ ID NO: 63307 - DNA, 304 bp, Heterodera glycines; identical to SEQ ID NO: 51570
  Genomic contig location: Contig_ID=SeqID_33157; Location=362..665; Strand=-
  SCN-specific regions: Sequence locations=1-304

SEQ ID NO: 63308 - DNA, 108 bp, Heterodera glycines; identical to SEQ ID NO: 61460
  Genomic contig location: Contig_ID=SeqID_33157; Location=742..849; Strand=-
  SCN-specific regions: Sequence locations=1-108

SEQ ID NO: 63309 - DNA, 1333 bp, Heterodera glycines
  Genomic contig location: Contig_ID=SeqID_6921; Location=4..1336; Strand=+
  SCN-specific regions: Sequence locations=1-492,514-707,730-933,993 -1200,1222-1225,1278-1333
atgatttcgtccaccgccgtgcctcgcccccttcgctcttcgaatcaacaaaaacagcagccaaacgcactgaccaaacagaacggtgctcatcagcagaagacgcctatcaaagccagggaagacagcagaaacagtcagaaaatccaaattgggggataaatcaaaaatgaattgttatttaaagggagcgacgcattgggcgcacagaaaccaaacggtcattcgccgcgtacgccgagcgttccgccggtgaataagcgatacgctcacgtaaaaaggcaattaatcactttcatatccattgactcgttggttattcttcagcaaagtcgggtcaatcactgagtacactccgtcgcccagtcgcgtgaagattttccacgagtctgtccgagtcagcgccactcccaaagtcggctcactgcaaaatgcgtcccatgtgcccggttcggagggaggggagggggcgttaattggctgtttttccaaataaataaactatttacatttagccggtggaaatgtgacgatcgagaacaaaaaactcaacttccgggaggcagcaaagccacgggtggaggacaaatcggaagtgccaattccaaagagtgagaaaaaggtaagaaaatgggggatggcatcgccaacaaaagggaaggaatgttttgacagattgcgactcaaaagttggaatggaaagcccagcccaaagtcggttcgttggacaatgtgaagcacaaacccgcggggggcaacctcaaagttttaacagtttcactttcatccctttaaagagtgggccgatgtttcagatattccacgagtcggtgcgggtgaaatgcgagtccaaagttgggtcccttgacaacatcggacacgtgcccggcgggggcaatgttaaggtggcattaattagtccaaacaatggcactttccctcccccttcgctttccttctcttacccccttcccccccccccccccgtcctcattagatttcggattacgcacgcagtgtttccggcagcggtgatggctccagacgtgacacttttgattcgggccgcagttcatcttccgccgacctccctaaaacaaaaaacgttgtgctcagtccgcaacgttcgccgcgacccgtggaaatgattctgacaccgaaggaaattccgccgacggacgacgacgaacaaaatgacgcgaacagaggacacattggacaagcggaagaagggggaggagagaaaaggaacggagagagggcgacggaagaggaaaccccgcaggggacgaaggaagcggaaacggggcaactgatcaattttggggactga

SEQ ID NO: 63310 - DNA, 761 bp, Heterodera glycines
  Genomic contig location: Contig_ID=SeqID_33162; Location=1..761; Strand=-
  SCN-specific regions: Sequence locations=1-492,515-522,546-761
atgtcactcaacacaccaacatttcaatcactggcactcaacccaccaacatttcaatcactgggactcaacccaacagcattacaatcactggcactcaacccaccaacatttcaatcactggcactcaacccaccaacatttcaatcactgggactcaacccaccaacatttcaatcactgggactcaacccaccaacatttcaatcactggtactcaacccaagagcattacaatcactggcactcaacccaccaacatttcaatcactggtactcaacccaagagcattacaatcactgggactcaacccaccaacatttcaatcactgggactcaacccaccaacatttcaatcactggcactcaacccaccaacatttcaatcactggcactcaacccaccaacatttcaatcactggtactcaacccaagagcattacaatcactggcactcaacccaccaacatttcaatcactgggactcaacccaccagcattccaatcactgggactcaacccaccagcattccaatcactggcactcaacccaccaacatttcaatcactggcactcaacccaccaacatttcaatcactggcactcaacccaccaacatttcaatcactggcactcaacccaccagcatttcaatcactgggactcaacccaccaacatttcaatcactggcactcaactcaccagcatttcaatcactgggactcaacccaccaacatttcaatcactgggactcaa

SEQ ID NO: 63311 - DNA, 641 bp, Heterodera glycines; identical to SEQ ID NO: 33163
  Genomic contig location: Contig_ID=SeqID_33163; Location=1..641; Strand=+
  SCN-specific regions: Sequence locations=1-641

SEQ ID NO: 63312 - DNA, 681 bp, Heterodera glycines
  Genomic contig location: Contig_ID=SeqID_33164; Location=235..915; Strand=+
  SCN-specific regions: Sequence locations=1-60,83-98,120-223,254 -622,644-681
atgatatttgaaaatgaaagggcatgggatgtggtcgatcgttggctaaatgcccattatttttctttggaatacggcaacacaagaggtgaacttgaaaaaattgaacaaatgctgctcattgcgaaaggggcgattgtggaagacgcatatttcgacattcataaaattttaagtgtgccccaattttttgacgcaccccaaagggtggaaagcgatgaagatattttaaaaagtaaatatttattaaattctttcaaccccttcaaaaggggggtttattcgagggagggttctattcgaggatggggctctattccaggaagtgcggtatgtgagtcttacaattagcccatccccactcgcaacagaaaacagaaaatgaaatgctctagctttttaattgtataaaaacaatgcttttttaaagaaaattaattaatgatgcaaacattttattataataaatttcatgtttttgagcatttttttcatttttatgaaactttgaaaaacgtaaaaaatgggataatccctaattttcctaattagaggcgaaaagtcaaaatatggatttctgcggagtaatatctcatcgaaatagaaccgcagaagaaattaatactaatacttaaaaattcattcccgaatataattagccaaaggaaatcagttaaatca

SEQ ID NO: 63313 - DNA, 317 bp, Heterodera glycines
  Genomic contig location: Contig_ID=SeqID_33165; Location=30..346; Strand=-
  SCN-specific regions: Sequence locations=1-34,59-132,154-317
atgcatgcaacacagctaacaaatttggtcggaagttattatcattattattttaattcattgtttgtaaatgtaaatttatatgaatgcctctatctacctatccgaattttgcaatttacggaaatagatctacttcataattctgaatttcactcagaaatttcgcgtttaaatttttttttcataattagtaattttatgcgcctccgagatttcgcttttcataaatttttgccgggttcagaaattcatggatgtgccatctgcataaattgtaaaccccaaaattcgtttaattttaggaagattgttga

SEQ ID NO: 63314 - DNA, 388 bp, Heterodera glycines
  Genomic contig location: Contig_ID=SeqID_33169; Location=78..465; Strand=-
  SCN-specific regions: Sequence locations=1-388
atggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattctgtttcggtccaacaccatgcgttcagatgtcaaagtccaacagtatttctacatgaagcaccggatccgcctactgtaccctcagctcaagtgcattgttgagtaccacaacaagggccattgcaaatactacccattgg

SEQ ID NO: 63315 - DNA, 2994 bp, Heterodera glycines
  misc_feature (871)..(872): n is a, c, g, or t
  Genomic contig location: Contig_ID=SeqID_6924; Location=779..3772; Strand=+
  SCN-specific regions: Sequence locations=1-518,554-841,866-1891,1915 -2013,2036-2058,2080-2148,2177-2466,2503-2994
aagagaatttggaagattggtcaatcacaggcaaacggagtttgactcagaaggcgcttttccattacacggaccgtcgggcgggcaaaggctattccgactttggtttcgtttcctccccattaattcccaaccgaattcgactctttcagccaccaccctttactacggtcgcccttacatttggccgcccgttcgcgaaattaaccgatggcactttttcatttgtgtgacctttgccctggttattctcgtcgactgcaaatggtgagcagaattggttgttttacaaacatgcggatttttgtaaaaaaatttttttgtacgtaatcgaaaaattctgaaattttgcagacaaatagcacattaaagtattatctgcaaaatttcaagtctttctaagaactacatactgacaacgaataagaaaatcagctttttcaaatttcttgataggctaatgacttaaattcccatccctattcataagatttcctaaaattttcctgcgcgccgggtcttattttaccatttattttttgaaaatttgaacccaaaatgtcgaaaactaaaattccggctttcactgtttcatgtttcttcgcccttttaggtttgtttcgtccttcgaattgtttcgtccgcccaaatcggaagccgcgactttggaaggcgacgcggtcgaatttgaggatcggaaaaaacttcagcttcgacgaatggtcaaatttagtttaattcccttggaaataatcagtcaaaatgatttatttcttaattaggagaggcgaaataataaaatatttgcaacaaatcaaaacacaaaaaatgaatgtttttcgggttttgtttaaattttaagtgtgtgtanncacaatctaaatatactgtttttcattttatggagtcaatgtcaactcgtacaataattattagtttttcaattatttccgttggagaaggaaagatggggattgggatgcaaattaaaatgatttgttaagagattttgtccaaaaattgttcgatttttcactttcgtcgtacaaaataatacgaaaagcccctctcgttgcctatgtttttcgtacttcgccttttaagcccaaaatgcgtcagaaagaggcggcggtgacgaggcgaccgatcgctgtgccattgggcaatccccgcacaaaaagaaacggaaagtcggctttcgcgaacagcgcgtcgtccaatacgaagttagacgccgaatgttcgaactttcgcatggacgcgtttcagaatcggattcgtgcctattcctcgcccgacaaaatctttcgatatttcgcgacgattaaggcattgccgaccattcattttcgttgcatttagtagattcggtttagcttcactacgaagacggctctttcgacattttcatgacgccggaggatttcgttcggtcactgaccccgggggtaattcagccgaggaaatacgggttggacaagtacaaagtgtacaacgtagaagaggtggtgaaccgatggggggggggagtggacgagtgagactttcgtcaggtcaaagagcatttgccctcgggggacggcgttttcaattggatgagcgactctggcggactgatcaatttcggcgactatctttttctgatgacccttttgtccagttcgttttttcgtcggaatgccatttcttctccctcttttgccgttgtcagcttcacccagcgaattcaaattggccttccatgtttttgatcagaacggcgacggagtgttggaccagcaggtgaaaagggaagaaaatagaggaaaaaagggatggaaaataataggaaaaaacgaatgatttgaatgtttacgggccacttattactcactgctgaataatgacccccaaaataaaatgagttttgttttgaaggagttcgctcgggtgcaggaattggtgctgagtcagtctaacattggccaaaggcaccgcgaccacaaaacgggcgccggcgcatttgtgaagacgaaaaattcagtgaatttttaaaggaaaagcgaaaaaataaccgagtttaaacccaatcagatgctttccaagcatttcttcggcgaaaatggacaaaataagttggacattggcactttcctccaattccaggcgaataaattattttctttttatatattttgcattattttagcagaatttccacggggacattttgaaaatcgaattcgaaagacgcgaccccgagacggggccccgagggaatcatttccgaagtgtgccgaacgaagccctccccctttttttctttaccctccgcccctttttagctgtcctttgccgaattgctgatgatccactcggacttgccagagaagcggcaaaagcgaatgctgaagagagtgcggagacggcaaaaggaattggcggacaaaagggtcaattaaaggggcagcattcacaattatgtttaattaattaatgagtaattaattaattgtttcttatttgttttgccattgtttccttttgagggcgtttcctttgaggaggtggacagtttcttcgccttcatttaccacattgacaaagtcgacttggccctccatttttacaaattggccgggaaaccgttgtccaaacaacttttgcaggcaaagtcaaatgattttaattgattaatattgtgaattatctcttttcagagggtcgcccgcaaagtgacgggcgtcgacctttcggaaacggtcgtcgacgtcgtggtcactctgttcgacgaaaatgcggtgggcaaaggcaacggacggacagacgacgcgacgcattcaatcggtcgaattttaggacggcgaactgtcgcagggcgaattcgtggccataatgaaaaagcgaatgcaacgaggcctggagaggccgaaggacaccggccttttccgactgatggacgcgtactggcaatgcgcgacgcgattcgcaagggacgacggacaaagttgggga

SEQ ID NO: 63316 - DNA, 800 bp, Heterodera glycines
  misc_feature (94)..(94): n is a, c, g, or t
  Genomic contig location: Contig_ID=SeqID_6924; Location=4057..4856; Strand=-
  SCN-specific regions: Sequence locations=1-405,476-800
gttcaggtcgaaattcagttcagcgccaaaaaggcgcccattatggttttatgaggggggagggcacgcttccgacttcacgggaaaatggatntggtgagtaaaaaagcgatggcaaatgccgaaaatgtgccgttctgtgaatttatttgccgcgttcagttcgtccgacccgaaaatgcgacccaacggagggaattggtgctgcgctcggaaacgacaatgacctccaatgtgaacctttggatcgaagtcagtcggaccaacgcaatcttcggcaccattcattcaaatgtttttagcgaagtcaaatcctcggaaatgccaccgttgagaatttggacttcaaattggtgagcacgaatgtgcgcgatgttgaccaggtgggcaaatgaatgagaagacggaggggagagggggaggggaggaaaggatgaaggagaatggaagaggatgaactgggggaggggggaggaccatcggcttttcgccccggcacttccaacacgaattccatttgaagagcagcttcgccgacctcggcttatttggggcggaatttctcgagaaattgctgaccgaaattctccaaattggccttctgttgccctcaatgcgtggcgttgtgctgcgcagtccaaagtttgttggcctctgtttcggcatttttgccaatccgccggtttagactgactgtccacgaccgatacatccgagtgcaaacgtatttcaaattggacgaacaatacgcggagaaactggtgcagggggcggtacggcaaacgctgctgaacatcgga

SEQ ID NO: 63317 - DNA, 1994 bp, Heterodera glycines
  Genomic contig location: Contig_ID=SeqID_6925; Location=1..1994; Strand=-
  SCN-specific regions: Sequence locations=1-829,877-1126,1159 -1201,1223-1280,1357-1994
atgcccacggggttggcttatctgcgcgaaattggcatgaaagtggtcaacgatgaaatactcaaaatcaggtgccgaaaccactctttggcaatttttgcaaatgtcctttcagtttgccaaccatcactgagtccatcgacgcgggccaagtaattattgcaaattcacttggcaaactttcccccccttttttggtgtccattttcaatgcttacgtgtcaaagtattggcccccggtggagtacactttggaccttctcactcccgacactttcacgtggcgaatgtccaaaatgcatttgaggtgactgataattcatttttcaatttcattgtgccaatttgtctttttctgatcgaatggcaatttcgacgcccgtctcaacggtgcccttcttctgccgacagtgccaatccaaggtgaactaaccaacgaacgatcaaaccattgaatggccctttgtcttcaggcgaattcgaagctttgctcggccatctcggcctcacaatttctgtccgaatgcttaggtaagtgattgctgctaattggacaattagcaacggattagcactcattttgcaagtggtgattttgaattttttacattttgcattctgcccatagtgaagaagcgcgatcggagcgcctcaggtgcaaatgattttttgccgtgccgcggttggttacgtcgatttgagcgtacggaacagcggagtgatcaccgactttttcataagtgacctttttcttccgtcggatgcttctttattttcaatttcaattcagacgtcttcaaagcctttctcatcgcccattttaaagtgatttttcatttttttcattttttttcttttttcatttatttttgttttaagccgacggtggaacagcgaatttgccaaatgattgagggcgtaataaacggcgatatgaatgccgttttggcgacgatgccactgaaagtgagcaacagaaagaattcgaaaggaccccaattttcgaacattcgtccctaatttgtaaggtgcgcatcaatgaggacaatttggacttaatcggcagaaacttcggaattagccccgaccaaagcaaaaattcggagataaaaatgtgccaaaagacttttaattttatttaaaaaaataaataaattacagatcaaaaaaactgcaagcgccacgcaatttcacactgctcaactttgtctctcagctgagggacagaaatttggtgctcgacttttcactgatcgacgaccctttcgttagtcaggtaaagacagagggagagagaggggcgaagatggagagcagagagaaagaaagaagagatgagagagtagagagagagagggcgggcagggaaggagagaaaatactattaccgtatttacggtatttgaaccccccccccctgaattacaacgccccttttgaggggaggttaaaaataaaacccccggtggttctaataccgtaaatacggtaatttggtgccaatgaagtcattgccatttcaaggggacagttctgatgaaatcgcacggcgaaatttcgtacgatggcctcggggaaacgccatttgcccctccgaatgttatcattccgcaagcgcagggcaatgaaaaaaaacatttattcttcacaattttcaattttaggcgtttttatggccgagttttttgggactgattttgtcgccaattcgatgctttaccacgcattcaaacaaaaatatatggacgtggtggttggccctgaagtaatttccccctaattggctaccgtatccctccttctcttacggtaattaagccctaattgccctccccctcattttctcagtcatcgccacaactgaaggatgttctgcttacgacttgctcctcgggcttttgcatcggcgaatatttgggctctctcggccaacaattccccggccgtcaggaagcagtttgctaatcacttgaactatttttgaatttgcgaaa

SEQ ID NO: 63318 - DNA, 118 bp, Heterodera glycines
  Genomic contig location: Contig_ID=SeqID_33172; Location=238..355; Strand=-
  SCN-specific regions: Sequence locations=1-118
atggctgaaaatatctttgaccaatttattgttattgacgagaaagcattcactgattttataagcgagatggacgaaatggattgttaccgtcattataataacagttgtgctgact

SEQ ID NO: 63319 - DNA, 701 bp, Heterodera glycines
  Genomic contig location: Contig_ID=SeqID_33173; Location=1..701; Strand=-
  SCN-specific regions: Sequence locations=1-192,216-701
tatttaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatattaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtccaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaaccaattatg

SEQ ID NO: 63320 - DNA, 323 bp, Heterodera glycines
  misc_feature (271)..(271): n is a, c, g, or t
  Genomic contig location: Contig_ID=SeqID_33174; Location=490..812; Strand=+
  SCN-specific regions: Sequence locations=1-14,36-196,227-323
atgtttttgtgtttattccttttaattgccatttcaattattccaaccacaaatggctacaaaatgctcgtctacagtccgtcagtaagcaattcccatctgatttcaaatgcccgggtggccgatgtgttggccaatgatggccatgacgtggtaagaaattggcattttgattataatggcattttctgcgcacaaataattcaaaaaaataaataataaatttgcggtattttcaaatcgtaaattattttaatttcaattttcttanaaatgactatccttttcagactctgctcgaaagtcgaatgatggctccgctg

SEQ ID NO: 63321 - DNA, 150 bp, Heterodera glycines
  Genomic contig location: Contig_ID=SeqID_33176; Location=278..427; Strand=+
  SCN-specific regions: Sequence locations=1-150
gtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacga

SEQ ID NO: 63322 - DNA, 722 bp, Heterodera glycines
  Genomic contig location: Contig_ID=SeqID_33181; Location=127..848; Strand=+
  SCN-specific regions: Sequence locations=1-722
atgggcgaaacgtctgctggacaggaagaaaagccatctagcgaactggatgatatgcaaaaataccttgaacaattgccaaggacaattgagcaagtgccagaaacgccaagagaaatggacggtatgccaaaagacccgaaacaaatgccaagagagttgaatgagaaagttgcccaaacgccaagagacgcgtacgatattcaacaataccttgaccagttgccgaggaccattgaagatgtgccagaaacgccaagagaaatggacggtatgccagaaacgctaaaagaaacgggcgaaacgccaaaagacccgaaacaaatgccaatagatttggacaatgctcaacaagagctgaaccaattggcaattgaaaatgcgccagaaacgcgacgagaattggacggaatgacaagagctgaaactatgggaatgcttggcattatgccaaaagaactgccgaaaaagccaaaaaagacaagaaagatgagtttgccagagcagttggccatccctccaaaagatttagaaggaatgcaaagcgaacacgtcgatacgccaagaccagaccaaaaatatataccggacatggaatttatgaaataccgtattccatacggtacagagacaccaaaagtagatgataataagcaggaagagaaggcagaaaaggtggaagagaaggaagaaatggaagaaatggcggaaaagcacaaaga

SEQ ID NO: 63323 - DNA, 1253 bp, Heterodera glycines
  Genomic contig location: Contig_ID=SeqID_6927; Location=51..1303; Strand=-
  SCN-specific regions: Sequence locations=1-263,285-388,410-466,510 -726,764-1253
atggaaaattataaattaattgacgaatggtcgacgatttgcgaaaaatttggatttacgaagaacattacggaatttcggatcaattcggatgtgagacgccctgacgaagcgatgagggacgcaatcgacacaatgattaaggcggcttttaagactacggaagaaaggatgaagcggaaagtgcggatgtttggagtggcaataacgggtgccgggcttgcttccccggtttgggtaccgtacagggcgtacccgcagaacaatgcggatgttattatgcaggagattaataagttggggcagagcggggacggagatgaaaataagaaaacgcttttgttgtcggagcctattatgatgaaaattacttgcgtcacactgcccagtggagacgggccgaggaatgtacataaatttgatttcggatttaaggaacaccaacggataaggtaagttttttgagaaaaaaaaaagaaaaaaaggaaaatagaaaaaaaaagaaaaaattataattatttattaaggatttcgaatgtggataaattttgtttgttttacgcactggcgtcgtcgatgaattatttaattatggaccgttttgcatttaatcgatttatgaacaatattatgagacagagggacgcagctactgagcttttacgtaattgtggaattgatattaacgaatatagctatggagtggagcacttatcgagggttcagaattatttggtgggttaaatgaaaaagtgataaattaatggatttttcaggatgagatttaccccggaaagtaccgagtggtggcatttgaaaagtcagctgatccacggaaatcaatccgtgttttgtggaagggccctatgggacgcgaaaatgtagtgccgatatttttggagaatggtcactgggatggattaaagaaatatgtttgctttttcaaccgtgggaggaagttctgcgttgaatgtgaatgtttttacgatcaggatgtttatcatacgatggattgccgggcgagatgttattactgcaatagagctggaggaatgccgtgtcaaaaggagagtggagtgaagattgaatgcccgaagtgtcgacgttacttttataattgggaatgctacacctatcatcagggacatcagacttgtaaattatggaggcgttgcgttatctgtgacaagacttatcgatttaacccgaagaaggaccatgaatgtggagagacttattgccaactctgtagt

SEQ ID NO: 63324 - DNA, 373 bp, Heterodera glycines
  Genomic contig location: Contig_ID=SeqID_6928; Location=2167..2539; Strand=+
  SCN-specific regions: Sequence locations=1-257,279-373
atgcacactttcactggttgtacaaggcgttttgcactagtatcgtctgccggttgcggagggaagctcagcagcgagcagttcaacatgacgagatacccggcgagtgcacatcaatcagcgaccggtggtgctgaacccgttgaagccgttccattgccaacgccggctgtggtggcgactatccgtggtcgtcaacacgttcatggacccggaggatgggccagcctcacgtctcgccctttcggcacatgccattggcaacctcagcaactttttggtgccattgcaaggcgacaaccggatggagggtgtaccgttggagaacggcgagtacagcttccggctgcacgcccgggaccggatgggccag

SEQ ID NO: 63325 - DNA, 497 bp, Heterodera glycines
  Genomic contig location: Contig_ID=SeqID_33182; Location=82..578; Strand=+
  SCN-specific regions: Sequence locations=1-22,63-139,161-475
atgtttgcaagggtgagtgacgaaaaaaaataataaaaaaaaaatttttcaatttttttattgctttccagacttaccatgaagagttgaccaaccggtttggaggcgactattcacactcggtgctgctgaacaaaacaggaggtaattatgcaaatgtgaaaatagggctcgcgattttctggaaaaagtgtgcctttttgaagagttggttaattttttaacctatcccgctaaaattttgcaattttttccccggcaacgcataccattggtccttcaaaaacaagtttttttttttttaaatcgggtttgtttttgtgtataatggatgattctttaaaaaaaatttccatttattttttgcagtgtgcagctttgccatccgacttttgcaattccggaagcaaatggacaaactgaaaaccgtacaagcaaaggacttaatcttttcggtgggctatttttttggcaattctaatatattttttctttaa

SEQ ID NO: 63326 - DNA, 234 bp, Heterodera glycines
  Genomic contig location: Contig_ID=SeqID_33184; Location=820..1053; Strand=+
  SCN-specific regions: Sequence locations=1-181,230-234
atgctcttataccattggcaactacaacaagttgaagcagttcgacgccttcttctgtccgctggttggtgcctccgttcttcttccgttgccgtcggtggtggtcaatgcgttcgaccatttgcaacacgcggcggtggccaaaaacgcgtcagtgatgatgaatggaaaacggagagggagcagtatcagaagtacgagcaacacaaccagcaacagcagcagcagccgagg

SEQ ID NO: 63327 - DNA, 198 bp, Heterodera glycines
  Genomic contig location: Contig_ID=SeqID_33184; Location=191..388; Strand=+
  SCN-specific regions: Sequence locations=1-47,69-198
attctgctctaccaactccaatgctcggagaccatcggcaactacaacaagttgaagcagttcggcgactcctttctggtggaggcctccgttctgttgccgggccatgggctcgagcacttgcaacaggcagccaaatcggtgaaggaatttgcggaccaactgcacccgttgtgcaagctgagctacgtggactat

SEQ ID NO: 63328 - DNA, 656 bp, Heterodera glycines
  Genomic contig location: Contig_ID=SeqID_33186; Location=304..959; Strand=-
  SCN-specific regions: Sequence locations=1-272,296-309,341-484,543 -574,597-656
atgggtaaaagaaaggcaaatcagacaaaacggacacaatttttgggatttacctatttatctttttatggctatatggaaatagcaactatttttccattttggctatttggtccaattttatgctttgaagtttgtccaaccatcgcattcccttgagccatccgatccgaatttgcaattcgccttttcgttgtgcaaaccaaatcctacggaagaagaatatgaacggtatttgaatatgacattttttgtgacggtctcaatttaagtcttttaaaattatattttatcgttttcaaaattattccaggcttttccccaaaaaagttgacaaatatgtgttcccgactggcggttcatgtgcaggattgggcaatcaaatggtactctacagtataatgtattgtaatttacagtagagttgggcccccgaccccgcccccgaccccgaaccccgacatttttggccattttcggggaaaaccccgaccccgaaccccgacgcttccaaccccgaaccccgacccttaaccccgatcggggtcggggttaaatatacacccctaagaatggaatttttgtgggggaaaaggcaaaaaagttataagaaatttgaatttttttaaccattttgccaaattttattaaataaa

SEQ ID NO: 63329 - DNA, 154 bp, Heterodera glycines
  Genomic contig location: Contig_ID=SeqID_33188; Location=805..958; Strand=+
  SCN-specific regions: Sequence locations=1-154
atggcgcgtttgttccacgcacaccgattgtatgaatggtaagttttgcaatttattattggcaaaaaaattttaaattttcaaagttttcaggcgattatcacaacgtggcactgcacacgcgctattttcagaacgcaaaggaattgcttaa

SEQ ID NO: 63330 - DNA, 58 bp, Heterodera glycines
  Genomic contig location: Contig_ID=SeqID_33188; Location=623..680; Strand=+
  SCN-specific regions: Sequence locations=1-7,29-58
aggtcaaacaaatttctgtctctgaaattctgccccgcacttccgacctgatcttcct

SEQ ID NO: 63331 - DNA, 768 bp, Heterodera glycines
  Genomic contig location: Contig_ID=SeqID_6929; Location=425..1192; Strand=+
  SCN-specific regions: Sequence locations=1-223,274-544,566-768
atggaccatccattcgttgtacagcttccgaattgcttctttgaagggcgcgttccaaccagggctgcacgcaattgcggattgcggattgcggattacggaaattgcgggctttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatgtcaaacttaaatcctggtaattggtggtattattttgagcgtcaaggcaaagcaactgctaaatgtaacccccagtccatctgccttggagacaagacaaaaagccgaagttgaagtaaatgaatatttgctggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaa

SEQ ID NO: 63332 - DNA, 925 bp, Heterodera glycines
  Genomic contig location: Contig_ID=SeqID_6931; Location=169..1093; Strand=+
  SCN-specific regions: Sequence locations=1-57,79-178,249-582,606 -749,775-925
agtacggactataagaacactttgtttgtcggcggttccggcattttgaacggcgcgtgtgatgtgaacaatgacaaactgaaatatttgatgacattgaagaatggcgtgaccatcaaaaatgccattcttgacacgcccggtttgggcatttactgcgagggcaattgtgtgctggaaaatatttagtaaaaatttaaaaaattccttactattttctttaaattcaaattatttttttaataattctagctacaagcgattgtgttaccatgctactgggttcgggtataagagcaccagcacttcatacacttaccaagtgattggcggtgctggccaaggttcacctgacaaagtatgacaaatcagaaccaattagcaataaattcaaaaataattttgatagatttaattcataataatggtttccttgttttaagtatttcacccaatcgggcaaaggcactaccatcatcaagaatttttgcgctgaaggtttaaccccctctctctctaaaaataaatcgaaaaaatttaaataattcatgttttaatttcattacaccgttcaaaacgtctaattattttttaaaaacatttttcgttttaattaattaaggcaaatacggcaaattgtggtgttcatgcgggaattgtccgttccaaacggctcgtaccgtacaaatttccaacaccgtccttaaggggcccggactttcggttgtctgtgagttgaaaatcttatgaaaaatatttattttaaaaaaaatagaaaatgctaataaattcatttttagcgcttaattccaactacggtgacaaaatgtcactttcgggactgactttgcatggccaaaaatcagcgagcacaaaaacgtcatacatttgccaagtaaaacattcaaaaatgttaattatttaa

SEQ ID NO: 63333 - DNA, 129 bp, Heterodera glycines
  Genomic contig location: Contig_ID=SeqID_33193; Location=435..563; Strand=-
  SCN-specific regions: Sequence locations=1-129
acgccatttctctgttcactccgctgaacacgccctcaaaatgggcgccaggtcatccacgacatgtggccgtttgccaacggcagttacgtttcgggccgggccgtcacaaagtcgcgggaagtccag

SEQ ID NO: 63334 - DNA, 411 bp, Heterodera glycines
  Genomic contig location: Contig_ID=SeqID_33201; Location=405..815; Strand=+
  SCN-specific regions: Sequence locations=1-179,211-226,250-251,300 -327,350-355,377-383,405-411
atggggttagatgtggaacattgggctcagtgtgaactgctcaaaaaagctgagaaagtttgccgccgtgtgcctaattcaattcatttcagagggcttttgatgaagtaattgtgcaagagtaatagcgaagtgtagatggaattaattacttttaaaaattcgttaaagaacagtaaaaaattaaaatttgtttgtttaactttgtttgtctttttttgttagattgtattttagaaattaaaaatgggtataaatttaattaaaatttataaattatgaatttatttagaaaatatggatttacaaaaaagatttaaaatgcttgggttttaatcaaaccaaattttcccattaatattatcataatttaattgggtaggtaaaaagtaaaatgattttttacagtaa

SEQ ID NO: 63335 - DNA, 786 bp, Heterodera glycines
  misc_feature (32)..(32): n is a, c, g, or t
  Genomic contig location: Contig_ID=SeqID_6934; Location=118..903; Strand=+
  SCN-specific regions: Sequence locations=1-42,73-286,309-426,470 -648,690-786
atgattaaggtgaaaaaattcaaattttactntaagataaactcttaatattttatttttgcacagaaaacaaaggaagatgacaattgcaaaaaattactgtgtgctttgcattgtcggtacaattgctttggttatttgaagaaaattgttgtgctttttgaacgtgtttgtctaaaatacgaacaaaggaagttggagccgtcctttctttttgaactttgtgttgagtctgttctgccgacaaagaaccaacaacagattttgtcttgtgagtgccattggcaaatattaaaacaataaatcttctgtttcagctctcagtttacgccaactttgtcttctcaattgcttggtcaagttggaatcatcggggtataaacaacgcatcgatttcacttaccaagaaatcgcaaaaggtgtctcatattattttttgtattagtattttattatttaaaaaatttttcagggtatattaaattcacaaatgactatgagaaatcgatgcgagtgtgcagttttgtgctgtatagagacttggacgaattggccgctagtggcgcactgagtttggcgaagggatcggattttggacaaatccaattcaagtgagaaatgttggcaattgtgaagatcattggtcccaaaattttttaatttaatttttttatcttaaaattttttaacacttttctgggggtgttttgaggagctgagcacgaatccggcctccatttcgaccaattccgaatccctaacccgaactcgaacatttttcgagaa

SEQ ID NO: 63336 - DNA, 56 bp, Heterodera glycines
  Genomic contig location: Contig_ID=SeqID_33202; Location=11..66; Strand=+
  SCN-specific regions: Sequence locations=1-56
gctatagggaagctattctcgaaggattcggtctccccataaatctgggcgcatcg

SEQ ID NO: 63337 - DNA, 57 bp, Heterodera glycines
  Genomic contig location: Contig_ID=SeqID_33203; Location=62..118; Strand=-
  SCN-specific regions: Sequence locations=1-57
atgggcgacagaattccgcccgcaaacggtgcagataaagagccggtgacaagtcgg

SEQ ID NO: 63338 - DNA, 183 bp, Heterodera glycines
  Genomic contig location: Contig_ID=SeqID_33204; Location=534..716; Strand=+
  SCN-specific regions: Sequence locations=1-183
cgagagggctttctgagggcactgaacgaaagcggacttttgctggaggagcccgaggccatcccccacactcaccttaacgaccccaatttggtatgggaaacgtttccaattcagcacaaccgagctgacaaattggacgagttggacttgagtctggaaccgggcaaaggcgtttgctga

SEQ ID NO: 63339 - DNA, 383 bp, Heterodera glycines
  Genomic contig location: Contig_ID=SeqID_33209; Location=219..601; Strand=+
  SCN-specific regions: Sequence locations=1-275,297-383
atgccaaaacaaaacgaaatcgttctaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 63340 - DNA, 383 bp, Heterodera glycines
  Genomic contig location: Contig_ID=SeqID_33209; Location=751..1133; Strand=+
  SCN-specific regions: Sequence locations=1-20,42-275,297-383
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccggcataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 63341 - DNA, 778 bp, Heterodera glycines
  Genomic contig location: Contig_ID=SeqID_6935; Location=3489..4266; Strand=+
  SCN-specific regions: Sequence locations=1-487,509-618,641-736,766-778
atgccattccgtgggccattagcgacgaatgggacggaactgacacagcaacgcaaccaccaccaacaacagcatcaaatgttcatgcaggtgaacaaaatcggatgggaatgaataatatggcaaaggacaaaaaattatagcaaaatttgctgaacgatcgtcaccaaaaccaccaacagcaacagtacgtgcttcgactggaacaagttccggtgtacaacccgcgccttttcgccaccttagaacagtcaaaaccgttggagccaccgccgccgtatgaacaggtcgaattcgaatttttctgggtccattcaaaagcgtaacagggaatcaagaaaaggggaaagcgaattgtaagggtcaaaaattcgacaaaatgtaatgttttcaaaaaatcaccgacaacgcctttcaggtgtcattttactttcagtttgccaaaaaaaacttagatgtaatgggtttaatcaaccgctgttttcttatccaattggtgttgcttatttcactccttttttaggcaattcggtgtccacaacaccaacaacaacacaaccaacaatgcccaccaatttattctcctgtacaaatgaacgaggccaacaatgaaaatggaagggagacaaatgggaacgaaatgagaaatgctgacggaatggacagagcaacacaacggcaaagtgatgacgaactccttgaacttcttcggttgaggaggcaaccgacggatggcgacggagaaagaagaggaggagggacagatggaggaccatga

SEQ ID NO: 63342 - DNA, 1286 bp, Heterodera glycines
  Genomic contig location: Contig_ID=SeqID_6935; Location=2036..3321; Strand=+
  SCN-specific regions: Sequence locations=1-92,115-878,900-1087,1111 -1286
atgtcgaaagaatttcgtcgattcgatgatgtacaacttcgacttcgttcatttgatgaacgaatgtccaaagtcggcaccttgggtgctgctttattattttaaaattaatttcgaattttaattcccttctttgttaagatgtacctcccgcacaaattgtctcctccactgtccgtccaatctctgccaaatcgacaaatggcgacagtgccgttttggtgccctccacaacgatggcaccaccgtttgtctccagcacagccgcaacatccgttgagagacactcggcggaatcatcggaagaagaggagacggacaaacgtcacagaaagggcaaaacgccattgagaggtacggacttccaagccaattaaatcacaaattgcgaaaaagcaatttcaggcaatggcggactgagcatcagtgccgtttgggagggagtgaagcgaatgatgggcttcaccgccgactgccataacggtttgtacatttttccaaccaaaaacgatatatatgcatttttatattataaaatgaaaatcgactgggacctgctctaggacatggagttttcctggaccaagaggccagacaattggccattttggtttttctttcgaggggctggcttctctgggttttttcctaaattgccgttctccagtaaacgccccttttctcaattgtcaggcggttacaaaaccatcggcggcgattgcatttgcccccaatttttcgagggccatgcctgcgagcgcattgtctgcgccaacaacggcacgcgcgtgcgagtggccgcgttcggcggggaggaggtgtgcaagtgcactcatccccagtacatttcgggcaaacactgcgaagtggtgcactgccaaaacggtgggaaaagctcatcatcactgggaaaagcgattttgcagtggacgtattttctctttctttgccaggggggcgccttctcaacgacggcacgtgccattgcgtggacggatggtacacgggccaattctgccaggtccgttgttcagctagggccttttgatgggttctttttattagggaaggttttcctcatttcttttccattttgtcttttccctcttttaaagccaccctttctttttcagttttacacttcctcgtggctaatcgcctttggcattccgttgttggtcatcgccgccatcgtcttttgctgtgtgatttgtcgcttggatttgtgcgcattgcgccgtccttcaccgcctccgtcaagccgtcacaatcgaagttcgagctaa

SEQ ID NO: 63343 - DNA, 756 bp, Heterodera glycines
  Genomic contig location: Contig_ID=SeqID_6936; Location=1205..1960; Strand=+
  SCN-specific regions: Sequence locations=1-192,215-248,270-681,703-756
atgaaacgtcaaaaatcattagcacaccgacgaagatcacaaaaggtttccgtttcaacggtgctgcaaaaaccgttgaaggtttctttctctttggcactcactaagccggactcatccagctccgaaaattgttcttccgatgagccttccatttgcaagaaaaaacgacggagtcgccgggtcaaagtgttgacttttgtattattaatttcgtttgttttctttacaattttaaaacttttaagctaccagtaaagcaggttgtcattccgtcctctgtcaaaaaggagacaaaaattcaatcgcttccaaaggaaacaacaaaaagtcaaaaacccaaaaaggaaagccaaacgcagccaaaaagtcagaagaaatctcaaaaggaacatcaacaacctcaaaagaaaagtcaatcgcctcaaaaagaaagtcaaacgcctcatccgcctccgatggaggggccgtcggtctccgctttggtgccgaacactgcggactgcaaaaggcgcgttaattttggcaacgtggaagtgttcagatttgaatttgcgcaagggcacgacactgtgccggccaaaggaggcgtctctttgggtatttttaccttttactggatactccttaataattgatgttcatacgcaattcccatagccaaaaaaattttggtgaggattttattcttaattttattatttgttcccgaaaccttttacaagaattagtagccgcttttcgccaaaaaagaga

SEQ ID NO: 63344 - DNA, 868 bp, Heterodera glycines
  Genomic contig location: Contig_ID=SeqID_33212; Location=11..878; Strand=+
  SCN-specific regions: Sequence locations=1-131,167-753,776-868
atgcttcacaacacggtgattgaggtcatctaccgagtgtgcaaagagatggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaattgggctcggagaaaccggagagcacttctggattcctcggcagttcctcgttaagagcaaggaagagctgatagactatgtctatcctaacttccaacaactccttggcaatgacaaggagctgctcaatcgtttgattctcgctccgcacattgacacgtgcgacgaagtcaacgacatcatgatggcgaatgtgccaggtcatatgcgggaatacttgtccacggataagccccttgacgaccgcccactggacatcgatgagatcgagtccgaagtggctgcgttgaaccggcgcacagactcgggcatgcccccacacagtctccggcttaaagtcggatgcgtcgtcgtccttcttatcaataaaagtgataaggaaggactgatcaatggcacccgcatagttctggaagaacttggcgatgatcgcctcattggtcgtgttatcaatagcaatgctattggcggccaagtgaagttctttcttgaaagaacacgaaatgtctatgaagacaaatcgcctggcggcataaaatatgagcgtttgcagttcccaataaagcctgcattcgctatgaccattcaaaaag

SEQ ID NO: 63345 - DNA, 802 bp, Heterodera glycines
  Genomic contig location: Contig_ID=SeqID_33213; Location=1..802; Strand=-
  SCN-specific regions: Sequence locations=1-755,778-802
  Gene Ontology: Cellular component=small nuclear ribonucleoprotein complex; Biological process=mRNA splicing
cccaccagcatttcaatcactggggactcaacccaccagcatttcaatctctgggactcaacccaccagcatttcaatcactgggactcaacccaccagcatttcaatcactgggactcaatccaccagcatttcaatcactggggactcaacccaccagcatttcaatcactggggaactcaactcaccagcatttcaatcactgggactcaacccaccagcatttcaatcactgggactcaaaccaccagcatttcaatcactgggactcaacccaccagcatttcaatcactgggactcaacccaccagcatttcaatcactgggactcaacccaacagcatttcaatcactgggactcaacccaccagcatttcaatcactgggactcaacccaccagcatttcaatcactgggactcaaaccaccagcatttcaatcactgggactcaacccaccagcatttcaatcactgggactcaacccaccagcatttcaatcactgggactcaacccaacagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaaaccaccagcatttcaatcactgggactcaacccaccagcatttcaatcactgggactcaacccaccagcattccaatcactgggactcaacccaccagcatttcaatc

SEQ ID NO: 63346 - DNA, 336 bp, Heterodera glycines
  Genomic contig location: Contig_ID=SeqID_33217; Location=120..455; Strand=-
  SCN-specific regions: Sequence locations=1-76,244-277,300-336
  Gene Ontology: Biological process=protein biosynthesis
atgtacaagaaggagtaccgattggcggaaatcgatcgccaaattcaattgataatcgatgcgaaggccaaaatccaagaagaggaagaagaagaacaaataaaggagcgaagagcatattcggagaagatcaaacgcgagcggaagagaaaggaaaaagagcaaatggaagcgaagtccgaggccaagcgaaaggaagcggaagagaaggccaaagaaaatgccaaagcagaaaaagaagaatggaaacgggcactccgacgaccggcagccacaccggaagaaaaggcgaggaaagaagcggaaaatgaggcgaggaaggaagcggaagaggca

SEQ ID NO: 63347 - DNA, 940 bp, Heterodera glycines; identical to SEQ ID NO: 33218
  Genomic contig location: Contig_ID=SeqID_33218; Location=1..940; Strand=+
  SCN-specific regions: Sequence locations=1-258,294-854,879-940
  Gene Ontology: Cellular component=cytoplasm; Biological process =protein-nucleus import, docking

SEQ ID NO: 63348 - DNA, 49 bp, Heterodera glycines; identical to SEQ ID NO: 51181
  Genomic contig location: Contig_ID=SeqID_33219; Location=517..565; Strand=-
  SCN-specific regions: Sequence locations=1-49

SEQ ID NO: 63349 - DNA, 163 bp, Heterodera glycines
  Genomic contig location: Contig_ID=SeqID_33221; Location=12..174; Strand=+
  SCN-specific regions: Sequence locations=1-163
ttgtcacaccaaaatgccgatgatgacgagcagcagcagaaggtcacgctgggcgttgaacgctttgcactgcccgaactgctgattcggcctggcgatgttgaagtgcagcaaatgggcatcccagaagcattgtgtgcggccattgaacggctgccaaagg

SEQ ID NO: 63350 - DNA, 3050 bp, Heterodera glycines
  Genomic contig location: Contig_ID=SeqID_886; Location=2047..5096; Strand=-
  SCN-specific regions: Sequence locations=1-62,84-1280,1302-1526,1548 -1744,1767-2436,2469-2730,2753-3022,3045-3050
  Gene Ontology: Mol. function=Rap GTPase activator activity; Cellular component=nucleus; Biological process=negative regulation of cell adhesion
aattctcgactttttgggcacccgcgtgcgtctgaagggcttcgagtcgtacaaaggcgggttggacacgcgcggagacaccaccggactgtacagcatttacacggagcatcactctgcccagataatgttccacgtgtccacaatgctgccattcactccgaacaacaaacagcagctgtaccggaagcgacacattggaaatgacatggcaatcggacggggaagggaaggcaaggcattgaaatgattggactctcttcaggtgaccatcatcttccaagagcccgacgccttgcccttctcgcccatcaccgtccgttcccacttccaacacgtgttcatcgtcatccgcgcttgcaacccgctaaccgagggtgtcacctatcgggtcgctgtctctcgtgccaaggacgtgccaacgtttggccccccaatccccgcaagtgccacttttcaggtagtgccaacaaacaaaacgaacaaagtatcacattcttatgcattcaaattttcgcagaaaagtgccgagttccatgactttcttatcaccaaaataatcaacgccgaaaatgccgtccatcggtgcgccgtttcttcccactattttttgtatttcctcccctctttttctaggtcccgcaaatttgcttcgatggcggcgcgtacccggcgcgaggcgctgaaggatttggtggagaactacgcgggtactgcccattcaaacgaaggcgcgtcgcgcattgcgtcgcggctgttgggcggttcggttaagcgcaaagagcgcgtggtgccgaggcccgtgctcgatgccgcagtccgtgctgcgctctcctggtaatttattagtcgggaaatatataaggtttcgacttacccttccccccttaggcaagtcgacgtgtttgaccattccaccggccaacgtgcacctgccgtgctcggtttgtccgccgacacgctcgtcctcctctccgtaccctccgggctggccgtgttctccacgcccacccattccatcctgggatggatccaagccgccgatggagggttagcaatttcaaagggctcaaaagattaaattacctccaaatccccaaaaacctgaatcctggattggtcactgattcatttctacggatggttaatcattttcatctcgccacctaagttttaagtctcaaaatttccacatttaagtgtcaaaattttctttgaccatggcgatttgctgctgttgtggtgcgcttcccccgatggcagtgagcgcgagttgggactgttgttgaagcgacttgcgtccgtcacaaatggggaggaggcgaaggaggtcagtgaaattccatttccacgttaattaatttccgtttcatatttctaggtcattttgcataagaataaagcacttggcgagtcgttcggtttccatgtccaggaggagggcatcgtcacggacgtggacatgaacaaagtgccaatcctctttaatgactagccaaaaaattatgaatttcaaaataatccccgttttccttaagagtgcctggcgcgttggccttcggcagggctctcgcattgtcgaggtttttttcattaaggcccttttagtttaataaatacgtttggattttcagttggaaaatgcggcttttttcacgttcagcgccgaacacatcgccgttttgttggcggaacggtcgcaaattaaggcattcattcggcagctttttgcttatcatttttcattttcttcagctcacaatgatcgccccggcctctgatggtaatccgagacggggatgtgaaggtaaaacatggaaaagagaggggggggggggaaattccgaaatttttcaattaaaacaaatgacacagattttcaaaattgtctctccgacatggcccggccccgaagagcctcctttttctttaaaaaaaggctaaaacccaactgcattcattcccctgtttacagacccgaattgtcccgccgtccgtggcctcgaatgccaacaattgctctcccccgactcattcgctcgccaaccgttggcctaccagcaaatgtttgctctgcgtgaccagcagcgtcgggtcggctccaaactcagttccaatttgtccggcgattcctggggcaacagcacaccgtcgcccacgtcgctgacggcggtgacagaacgcaaaaaatattcgtaagttaaaaacaaaatggcatttctatttcacattttgcgtttaagggcaccggcgttcggttcggcagtcagtcgcatttaccaattggagagcaatgcgtccgttgactccatccaaacacggcgcggcgccaatcggccacagcacacgtcactcacggggacgggtgaacaacagccacaggtgggactgtctaaatcaattggcgattccattttactcctccccacagaatcagtcggcctgctcctccgcctccacctttagccgtgcccgttccgacgacgtggccaccaaaccgcccgctccgtccgcctccgcaaaagtgtcagtgtccaacttggcaatgtcgctggaggagtcgcttctctcctccaattcggcacccttcgtgcagtcgacttctttttgcgacggcattgcgctgccctccaccacaaaaacagcggcgacactttttgccgaaacgaacagcggcagggaacagcagcaaaggaggcgagtgtcgacggacggcgagctgagcaggtaccagtggtgcctgcagaaagtggtcgcagagaaacgggagctggaagccgagttggaacactgccgtaatcaactcgtggcggtcagtccccccaaaacagtcgatgatcatcaaataaccctccccaattcaggaacagcgtgcccacgagagcacgaggcggcaactccacatgctcacggagtactgcgaacgcttctcaattgtcccacctccgttcgaggagggggacgaggaattgtgatcaaaaagaaagcctgcccttccccaggcccttccaatctcttgacctttgttctcccatgcacaatattctatt

SEQ ID NO: 63351 - DNA, 138 bp, Heterodera glycines
  Genomic contig location: Contig_ID=SeqID_886; Location=4082..4219; Strand=+
  SCN-specific regions: Sequence locations=1-138
atgggtgggcgtggagaacacggccagcccggagggtacggagaggaggacgagcgtgtcggcggacaaaccgagcacggcaggtgcacgttggccggtggaatggtcaaacacgtcgacttgcctaaggggggaagg

SEQ ID NO: 63352 - DNA, 1369 bp, Heterodera glycines
  Genomic contig location: Contig_ID=SeqID_887; Location=1307..2675; Strand=-
  SCN-specific regions: Sequence locations=1-68,91-322,349-422,460 -571,598-1008,1031-1369
tcacaaatgctttaccaaggccgtgaaagaagcggccaatgaaccgtaaaaacggtgacaacatcagcagaaaaagaacaacaaaaatttcagcaaaaagcgaacgaaaagtgccgaatttggaggaagcgaaagccaaaaacgaagcgaaggaagcggaaacattgcggggcattggccttcgtttgggcaccccaacagcaaacaaatgatccctcctgttgcggtgccatcagccgacgttgagcactcgaagatagcacagacgacgaatgcaaaagtgtgaccatacaacggcagggacaattccaaggggagggaaataaaccccaaaggggaaaaaattaatggaaaatcgaaaattaactggccatctctttataattatggtatctccgaaccgtgtcataacagttcgacagttttttattttatttttttttttaaataattttattagaaattccaaatttgattttctaccaagttcttttttgaaatcattgtaaaaactgccattgacccctccgaacattaccctaagctaagaccctgaaattgtctctgcatgccagaaatgtaaacaatgaaaacttttgaaattgaaatcactttttgctctccgcttcagtccaatgtctgcgctgaattggccatcgatgtgaccgccgccgatgcaccgcaacagcacagaaacttgcctcctctccctccccacccaccgccgccgtcctcggcttccgccaattcctccgctgccgttgtttcctcttcaaatttgctccaatgttcgctttcccagccgaccatccacgacagtgtcgtcgtcggcggtgcgttcgcttcgtccatcagtagcggcaacggcggtcaactcgcgcacagcgaatggcacccgacctcggcacatctgtgcgcttaccacgactgccggtcgttagcctacgcgtggggtcttggcacgtcgacgtcgagtctggagacgacacggcctaccggcgcttcacaggtggggggaggggagggcacagagttgaacaagcgaaatgtttgttgcttctgtttgaaggcccaaagtccgtcggaggatgaccccggcgatgggaaatgcaacgatttgttggcaaattgtcccgcatttcgcaacgaactcggcgaagagcccatccgacgcattgcattgtcacggcaaacctttccgaccaccagcagtgggcagtgccaacaacacaacgttaagcaacaacaccacacaaatggacggagacggacaccgccggaggaattggcggagacatggcacagagaacacatggcagcagaagtaccggccgaagaccgttcaattgtcatgtatgtgtcgttttag

SEQ ID NO: 63353 - DNA, 3389 bp, Heterodera glycines
  Genomic contig location: Contig_ID=SeqID_889; Location=154..3542; Strand=-
  SCN-specific regions: Sequence locations=1-49,71-649,671-975,997 -1005,1027-1380,1402-1430,1452-2601,2623-3389
  Gene Ontology: Mol. function=chaperone activator activity; Cellular component=cytoplasm; Biological process=protein folding
gattctcgatgtgaaagactcggactatgaggtagtgatgctgaaaattgttgtaaattggcatggcaaagatttggttgctttttagttggtcatcaaaattgaggagctgttcgaggaatataatttgttcgaccgggcgatcgtctgctccttctttccgtggatcatctattggattaagcggaggaacagtcacattctcacaggttggaaatggtaggggatgaccgaaaatacaaaccacaatccctgtttttaggattcacttttcgtcgtcggtcagttcttcgtttctcgctttaaataccataataaaacatacctattttccttttaggaacatttcatataccgatctgaagatgacaatccctcgtttctcttctccgttttaccattgctcggcggttgcgctcgatgctttgtacagatggtaaatggagttgattgaccactcaactcactgacaaacctttaaacaatgttttatcatctcttcaggagtatcaaagtctgtcttcctcacttcctcggtgttgacatgttgctcattgaggttggctattttaaattctcataccactgacaaaaaagaaaaatttttttaagcgtggcgaaatttgcgagtgagttgaacgactttcgccatttaatttatgtaaaatgcgatgcgctttcctttttcctttgtcagaaattttgtgagtgaaatggttgaccagggatttcacatgtgcgtgtggactgttaacgacaaaaatgaaatggtccgaattgatggctaattaattacctatttacaagtataaaacgcgttttaggcttggatcgcacataagttgaaaatcccatttcttacggactttccacataaggctcggggggttctggacggagcaaacggagtgcccacggaattgaccttcgaattgaattaggaacataaaatcaagtttttgtatgaagtgtatgtttgtttcattgtatagtaatattgatgtctttaccggtatttatttatttacttcttggaaataaacgcaaaacctaattcttcgaaattattaaaaacgtacgcacgcctaatggatcatttggagatttcatttaatgaactatattagttagatacctacctaagtattttttaaatatgtaaagatttctatcctttttgaggaacggacatgctctagatttttagattatacgtatttttaaaattggcattatgttttactacgagaaaaatcaggaccaaatttcaaaatagcaatgtaggtaattaacattcttgctttccgttatccgactagatatatataatttttgtcatagatacctgaacaagttacctgaaactttgtaaacataaattaatatttttgtaaaagaagaggattgaaacctatttattgcgtcatggcgaagtggggagaaggtttgggattttaaaaaattcattttgtggattgcatacttattaaatttctcccgaaatttaggggaccctcgttggattgtcgaagaggtaaaagcttcatttagacacatttatttggatattggagttagctattaaaaattcgctgctattttgcgcttactgattttttttaaaacgataccttgaacattttttacgatattaatttcggtgcactttccattataatacttttccccattatcataaaaagagagagttcctaaataagtgccattgctttgactttggttgtttcagaggccggatgccacaaatgtgaacaattggcattggttggtctcacacacacatttcatatgcacttctaaacaattgaagggttgagaagaatgccactccttggtctcgggaaaggcttcgcgtgcttttgttgggtcaaaccttggaaaaagggccggtgcgaattgaattttccgacttcaaaaaattggagggcgaagcgacggcgaacaatcggaaggcgaaactgattttcttcttcgagtggtccatcgacgtcaatttcattggtttgtaatttccttttttttgtaataaacgagtgattttaatttgctttttttagcaactgtttctggttccgaaactgagtacaaaggaagtgtggaaattctgaatttgagcgatgagaacgaggcgcacgaaattgaggtagcaattacagatttgtggttcaaatggcaccaaaaaaaacaaaaaatttatgccacagatttccgtgcacattgaaacggcgggcccacatgaaaacgaaattcggcacattctctccaccgatgggctctcattcgtccgttccaaagtgggcacttacgtgcgcgagttgaaggaggagttcagcaaagggattattttgccggtggacagcaaaggcgccattcgtccgcaggcggtggcaacgcaagggaaaacggtggtggacaagaagcgctttcagaatgatatcattcagaagacggaggagaaagtgaccacggcggaaagtgagggggggggggggaataaacgaagttggcgaggggagggaattcggcacggatttgatttatgggtatttaaatctaataattttcgttttagctcaaaacgctctcaaaactggtggtttcgaactgaccgaaacattcaaagtgccgcccgaacgcctttttgagattttgactgcgtctgaggtgtttttttggataaacatttcatcttgaaacctctgattttaagccacaatttgattttaaatcgcatttcattccctccacaaactttcagttggtcagtgtttggtctccgaattcgtcaattgatgcgcgagaaggtggccagttttcgttgcttggcggagtgatgtcgggtcatttcaccaaattggtaaatggatgaaacatcattggcttaatctacattcaaaaatatgaaataagcgcgtgaccgggtcccgagtcggattttgggggatctcaattcacaatcccgcctttttgaaattgcgggattagccgaattaacaccgcaaattgattttaggcaaatgcggcgcttatttcaatggcatggcgtttgaagagttacccatcaggtaaacctaaaagtctgaatccgtttcgcattttccttcatttttaggacattttgcggatgtgacatttacgcttaaggacaaagtaagaagggagaagcggagcttatctttcttttttttgtttctggaggtttcgttttttattttttcttcatttttttgtagggcgacagcaccgatctcgagcttaaggctgaccaagtgccggagcagctgattgaggacacgaagaccggcttttcccgttactatttccaaaacattggcaagaagttcggcatcagtctcaaccttttctga

SEQ ID NO: 63354 - DNA, 714 bp, Heterodera glycines
  misc_feature (65)..(65): n is a, c, g, or t
  Genomic contig location: Contig_ID=SeqID_890; Location=2780..3493; Strand=-
  SCN-specific regions: Sequence locations=1-70,92-714
  Gene Ontology: Mol. function=NADH dehydrogenase (ubiquinone) activity; Cellular component=mitochondrion; Biological process =mitochondrial electron transport, NADH to ubiquinone
ggcgaagtgaaaattgatgaccacaaagttgtgccgcctaatcgagcggaaatgaaggtaatttntgggatggcaaaacaaactaaaaacatgaaattgtaagaccataagtggattcgtatttttatacaaatttcgaagcaatttagtaaaattcggaaaaaataaattctgaaaaattagaaaactaacgaaactgccgaccctcgaccacctttcttctctctaaaaattttgttttattacttgaaacactcaaagtttggtaggaaatgggcaaagtgattaatctttctttattccaatcgaaaaaaaatcacatctctagtaattacttcaggatagcatggaatcgttgatccaccacttcaaattcttcaccgagggctaccaagtgcccccgggggcggtgtatgtgccaaccgaggcaccaaagggcgaattcggcgtttatttggtggccgatgggaccagcaaaccgtaccgatgttacatccgagcaccaggcgaggcatcacatgagtgtcaattaaattcaaaattgttcaggatttgcacacctttccaaaatccacgacatcagctatatgcatttgatcccgggtaatcgcaacttccccccccccattaattttacatgtttaatctttattttctgcagatattgtggccattatcggcactttggatttggtgttcggagaagtggaccga

SEQ ID NO: 63355 - DNA, 271 bp, Heterodera glycines
  Genomic contig location: Contig_ID=SeqID_6938; Location=68..338; Strand=-
  SCN-specific regions: Sequence locations=1-271
atggcgctgggtgaactgcgaaagtacgttaatcatcttgaactgttcgccgacggtgggtgaatcgctgtttttatttagtattgcaattttttcagatcgtcaaaaaattttcttcaaaatcgacattgacatttcttctgtgcccgagtcaacgcctgaagctaggcccgcgttgcgaggatggttcgttttacctttgattttattggctctagtacagtttatgcgtccaatggacttttatgcgtccaatcaattgacaatcccg

SEQ ID NO: 63356 - DNA, 95 bp, Heterodera glycines
  Genomic contig location: Contig_ID=SeqID_33225; Location=786..880; Strand=+
  SCN-specific regions: Sequence locations=1-95
ctcaaatttccaattgtttcttaaattaagctgctaactaaattcgttaatcgaagcgacaaaatgaagtggacttacaaagaggagaactcttt

SEQ ID NO: 63357 - DNA, 852 bp, Heterodera glycines
  Genomic contig location: Contig_ID=SeqID_33228; Location=609..1460; Strand=+
  SCN-specific regions: Sequence locations=1-20,89-107,155-172,377 -418,453-501,561-674,698-729,786-786
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacatccaacgcttggcgaattctgcttcgcaatgataggaagagccgacatcgaaggatcaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 63358 - DNA, 752 bp, Heterodera glycines
  misc_feature (691)..(691): n is a, c, g, or t
  misc_feature (713)..(713): n is a, c, g, or t
  misc_feature (721)..(721): n is a, c, g, or t
  Genomic contig location: Contig_ID=SeqID_33231; Location=2..753; Strand=-
  SCN-specific regions: Sequence locations=1-163,188-257,280-457,512 -622,659-752
atgggcttttctggccgtgtctggacaactcatcatcagttggacaaaggacaaaggattaaatttctttaaagactgaaaattacagtaggacaaccctcagggcaaacggtaacagtcatttaccattggttttttgccatttttattgaatcaaccgagcaaaaaggattttaaaaaattggcaagttaaagaaaaactcaaattaattgagcaataattgacgcaattacagtgataaatttttattttcaggattaaagcaatttttcaatattctaatttatcacacaaaactagagttgagcggtaccggtaccggtaccgaccggtaattaccggtttttttggtaccggtaccggtaccggtaccggtttgtctagtaccggtaccgccggtaaaaatttgtactggtaagaatgggggtctgggtgagaaaagagtagggaatggtgaagaaggagaaattttttgagaaaaaaaaattaaattatttattttcatttaaagcatttgttcatatgcataagtggtcaagtggctaaagcttcttattttattatttctcgcttgggttcaattccccactgggatagaatattcttcatattttctttaccattattttaattgaaattttaatttaaaaaaatattccaactttttttctttcattttaagcatcctanaaacccaaaaattaatcaattnggtctttntttacaaattctgttaaacaatcgcattaaa

SEQ ID NO: 63359 - DNA, 543 bp, Heterodera glycines
  Genomic contig location: Contig_ID=SeqID_6942; Location=655..1197; Strand=-
  SCN-specific regions: Sequence locations=1-543
atgattgcgtcaacgctcgagcaattcaattcgctggatgatcaggaattggacagacgaattctgaatgccggactgccaattggacttggggaagagcaaacggcgaaaggggagaccagtcaagaagagatggaaatactttaccagcaactgatgggcgaggaaaagaaaaaatttactgaattagccgacggaatatttcacgacgaattggcaaatcaaatgaattgttttgtgaagaaaaaataaatggaatgcaggcataaatgcttacatttgttagtactcaaaatattggttaaatcagcaaatcattgtcagcacatttggacagcataatggccaaccgtcgggtcgaagaacaaaggcagacgcttacaaaggagcccaaaaaaaaggtgagctgatgttttttgcatgttttgcagatagcattttacgagataagcaggaaatgtagattttatacaatttcacagaacgtctaatacaaaaatgattttttttagctacccaattcaatttttactagtaaataaa

SEQ ID NO: 63360 - DNA, 72 bp, Heterodera glycines
  Genomic contig location: Contig_ID=SeqID_6943; Location=148..219; Strand=+
  SCN-specific regions: Sequence locations=1-72
accattctcaaacttctgaatatgatggtcgtggacgtgggatgtattcttttcaccaacaggacgtgaaag

SEQ ID NO: 63361 - DNA, 807 bp, Heterodera glycines
  Genomic contig location: Contig_ID=SeqID_6944; Location=1..807; Strand=+
  SCN-specific regions: Sequence locations=1-509,531-807
atgcaagtgagtttcaaccattttaaagaaaaaaatatcaattttcgatttttttagtggattttgactatcatctggagaatgatgtccaaatgtcgccgaatttggacattgacgatcaacaaccgccggcctgggccgcaacagcagaagcgggagtccaatgcgcgacacaaacaacggaagcctcaacccaaaccgactggaacatccatgcttttgggaacagtgcactttgcgaggccaatttcaagctacaacgtcgtgttgcacagctgcggcaacaattggctgagcattttaagcggtggcgggcctatgcatgtcactgagtttttgccacaatcaccacgccgcgacaacattttcatggctcttgaactcctggcaaaactccaatcatttgccgtcgctgatttgctttctgctgatcaaatcgctgatttccgcgccactgctgatcaattccgtgttcacatgttggagcacttacgccgccactgttcgacttcaaaatttcatcatttggtccaccatgcccctgaatttgctgaaaaccatggattttggtgccttctcagtgagcagcctgtggagaaatttcacgcgttgttcaatgacgatctcgcgcgcaaagcaaacaccaaagatctccatgatattttgatgttctgtgctagagaatctgccattcgaaacgccatttttgattcaaatgaactctgatcagtcttttgtagtttttttataagcttattatttatttttgttgttatttttcatacatttttcaattttttatattta

SEQ ID NO: 63362 - DNA, 526 bp, Heterodera glycines
  misc_feature (521)..(521): n is a, c, g, or t
  Genomic contig location: Contig_ID=SeqID_6944; Location=1822..2347; Strand=+
  SCN-specific regions: Sequence locations=1-381,404-526
atgtccaggaatattgcgcattcggctacgctgaacaacggtgtttttttgagcagggacattgagcaattgcgtatgtcgatgagcagtgtcgaagatgagggaagcgacggaagggctgatgaaatggcaaagttgcaaaaatggctctgtgagtttgttttttgctgctatttataacgaaatttatgcgaccgaaaaaatagaaaataataagccgaaaattgagtatataaggcggtcttttcaacgttaaggacacatttcataacggacggacggctgctagcaacgcgcgatggcagtgcccttcagccttcaagtggacggccttatctacagagtcagaaactccacttacgggcaatttcccttagatgtaattgttttttgcttttcaaaatcgtcattattcttcccttccctttttacaggtgacggagcacgacttacgccagctttgcgatgccacgatggacgtcttccggcagcagcagacactcgtcaggattcaccgcccngtcac

SEQ ID NO: 63363 - DNA, 767 bp, Heterodera glycines
  Genomic contig location: Contig_ID=SeqID_33234; Location=1..767; Strand=-
  SCN-specific regions: Sequence locations=1-500,522-767
aagtttcattgctcttttagggaattggacgatggcatcgccgaggcagtgagcagtttgttgtgggtggcgcctcgcatcggacacgaaattgcggaattcaaggcatactttgggcaatggcaaaatcagaaaaacaatgccgtggtgtgaaaagcttttgtccacccaagaaataaaatttggtgccaccaaaattacttttgtgtggtataaattggccgattccaatcctaaagaatttaatggaatttttccattttccctaaaaattccttaaacattatcacgcttaactaaataatttaattaaaccaaactgaaaagcatcgtccaaatgtaggtgatcaacgacgaactgacccacaaatacggcaaacaattcgcggaggccgcccgtatgaaccaattgccggagccgagccgagtgtcgcccaaattggtgcagaaattgtccgtcagcgcaccgtccaaattgctcgtcgaaaagtttgtcaccatttatttggggggtgtgacttttttgacaatttatcggttattgcttaaatatttttttaatcagtgccatttttgtttgctttttaaattccaattttttctctaggtatttggtcactattgcgcaatcggcgggcgtcgatttcgcgccggacgccaaagtgatgcgtgaagacgacgacgaaattgcgcgggcggaacgcaatctgatcaacttcatgaacgaggtgtgatgccatggggtggggatgggcaccgcttaatca

SEQ ID NO: 63364 - DNA, 491 bp, Heterodera glycines
  Genomic contig location: Contig_ID=SeqID_33239; Location=328..818; Strand=+
  SCN-specific regions: Sequence locations=1-3,25-314,337-491
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgagtacctcaaggcgaagagacatgattggctctataaagaaagacgtacggtaaaggggatacttgaaaataggccacagaaggtcgtgattgagaatcatgtacccggtccaaatgttgcaccatatctgggcctcaataaccaatccaaaccacaggagaccgaagaaccacggaaaataattattcctaggaaaagacttaaagagcgaactcctgatcctgaatcaaataatgatacccttgaggagttaactccggaaccccaaacaacatccacacacaaaacacccgttccaatcaaaactattatacacccgacccttttaaacggtctttttag

SEQ ID NO: 63365 - DNA, 405 bp, Heterodera glycines
  Genomic contig location: Contig_ID=SeqID_33240; Location=209..613; Strand=+
  SCN-specific regions: Sequence locations=1-296,318-405
atgtccggttgtaccaatgcccacaatatgggatgtgatattcacacaaaccctatgactgagctctcaatttgcgatgaaccagctagcgatggtgcggtgtccgctaatattttatcaatttcccattgattagctaatttttcagaatccgtcaattccaaattttcaaacagactcatgaaatcatccgaattttcaacatttggctttgacttaggcgacttcttgcaggcaatgatgacgctactacattcgattctcacttcttcatatccggaccccgcagggttttcattggattcagtcccttcaataacgatttcaaccccaacattagtgtacccctcgaggtttgaagctacttttgagctatcaatgctcaacgcctcgaatgattcataa

SEQ ID NO: 63366 - DNA, 2781 bp, Heterodera glycines
  Genomic contig location: Contig_ID=SeqID_6945; Location=982..3762; Strand=+
  SCN-specific regions: Sequence locations=1-84,107-165,187-964,1002 -1017,1039-1315,1337-1460,1486-1691,1726-1776,1798-1811,1852-2781
  Gene Ontology: Mol. function=cytoskeletal anchoring activity; Cellular component=adherens junction; Biological process =cytoskeletal anchoring
aagggactcagccagcggattcaagcagtcaagcatcagcctctgacatggagaaccaacagcaaatcatgaggcaactgccggaagagtccaaaagagaaattcaaaaacaaattgacgtgtttaaagtgagtgaattgataatgacaaatgataatgtgcatttggtgttaatttttcttttagattacacaacgcaaatttgagtacgaagtcggaaaatgggacgaaacgggcaatgacataattgcattggccaagaaaatgtgtcagataatgatgaacatgaccgacttcacgaagtctgtttgggccattgaaaatatatgttaaataaaaaaatttgtttgatcagaggtcgaggcccatacaaaacgacgatggatgtgattaaggcggcacaagaaatttcggaaaacggaggaaaactgaacgaattggcacgtcaaattgggaatgagtcggtggagagcaacaccaagaaggacctttgcgcctatttggaaagggtcactctgttttgtcatcaattgaatgtcacaagcaaagtgcttaatcgaacaatttcttttgcgacccatcctctgctggttcaggtcaaagcggacatccaagtggtcggagacgaattacgagtcagcggattggaggcggccacttctttgatccaaaatgccaaaaatctgctgaatgccgtcattttgactgttaaatcagcttacatcgcaagcacaaaggtcagttttgttaaggcgaaaggatttacgacgaatgaaccgctcaaaaactttttcagtaccgacgaaaagagaacaccaatcccaacgtggtcgaatggcgaatggtggcgcctcagaaacagccgcttgtcagtgcatctgctacaaaagcgcacggagtgatccgccgtgcctccgtatggaaaggggcggcaaataagggttcactacgttccactcattgaaaaacttttcattagaaaaaacaatatttcataaaatgtaaaaaaaatgcggggtgggggaacagctcccggcaaaaaatgtaaaaatgaggcttattttaactgtatcaaattttaaaggaacggcgccaacctccgccgatgcaaacattaaaacaatttcacatatcgacgtgaatgaacggcaaaacactgagaaattccataatttaataatttatcaataggaatgcaataattcgtgctgatttgggataccctcttaaaaccttcggcataacaaagcacaataaacgagtcaattattgtaagtatttaaaaatttaaattcacggatcttaaaacccctcaggatttaaaacctatcttttttgaacaaggttgactcgttgtgtgcagtcaatgctcatttttcacttaaaaagaattcactccataagataattattatttttttgaagacccaaactctgaataatctgatatccaattgccttttgtaatttgttttttatttcaattcaaaatttatttaaatcgcagtaaaataattatgtgcgtcaagggcatatattgatattatttattcgaaaaaggttacattccctgcttattctctcttgtatgcttttattgagattattttcgttttagggaatggggggggggaggaaaggaaaatgtgtatttatttggttggggtggcgagtgttgggaagtgccgggtgagagaaggggaaaagggaaggaaagaaagaggacaaattcggttcattgggttcgagagagaaagagtacggacgaatggaggggaagagaagtcattccttctcgtttctcttcccttttctctcccccaccctcgctccgctgccgccgccgccagcgattggctgtgtcgctgacgtggaccaatgggcttgtgccccggcagagtaacgccggcgtgcgtttccgcggtgtgcacttcgcgacgctgcaccacatccaagccacacttttcgttctgattgctcaaatcactttgtgtgattgcgattggaaaagactcgctcttgacaaccaaaaaaacattacaatattatcaattttcagatttacaatctcttagggatgctcagttctttccccttattattgtccttggtcggcctcatcgccgtccacgccgaagtcttcttcaaggaggagttttctgatgacagttggactgatcgatgggtcacgtcgaaggtgattctgggcattagtgcttcgttttggtttttagtttggaacattcagagcaaggatgattccgggaagttcgatctgtccgccgggaagttattcggggacaaagtgcgggaccaggacgcgatgggcaatcagcgacggtacggttgtgcctcatctctaactagttaaggacgtcggacggcattatcatcgcaacatctgcaacgacactgattgctgtgttcattttgtgtttgaggccaaaatatagcaactcccgatcaccgcaaaaataatagcggatgaaacagcaaaataccaaattttacaacaaatcagtgcctttaccaaacaaggatggccgcaaaaatttgacgacattaaattgtctccttttcttccaaaaagggcacaaatacccgaaatcgaaggatgcctcgcctacggtgaacgaattatcatcccttcgtcactccggaacaacatcctcaaatcattgcgttttgcacatcccggcattgtgcgaatgaaagcaattgccaggaaccacgtttacttgcccggaattgactccgaaatcgaacgagtggtgaagcaat

SEQ ID NO: 63367 - DNA, 1159 bp, Heterodera glycines
  Genomic contig location: Contig_ID=SeqID_6946; Location=2861..4019; Strand=-
  SCN-specific regions: Sequence locations=1-493,516-651,673-1094,1116 -1159
atgccgtcctcctgctgtgttccgagtgcgtctgcgtcgccctttccctccgcgtttacctcttacgcttcgcaaccgttcggcgccggtccgcaacagtcgctgtttccatcgccgatttcttcctcctaccaaattgggatgcccgaatattcgcggactgcgcctttgcccggtttttccttttgccattttcgcctttgatttgttacttttttaaattcagtgccaatttcggccaaagaaagatttcctgcaaatgaaattgggaaagaaaagtcggtagaagcggtgaaagacccatttgaaaaagagtcgaaagcgtcgagggatgagccatttttgtcgtcgaaatacgcgacagcgccgggagggagtgccgtgcttcccccggttatttacccgacttccgcggcactccgtcagtcgttcgtgccccagcagcagagtccctccgcctacaacttccaaccgcccttccaacagcaacaattccaacaaccccagcagcagcaggaccggttcccattcccttcccaatcgtacggccaatgccaatgccctcaaatccaatcgtcccgccctttcgccacgccgcaaatgcccgtgcaaaactgctgcattggccgttcccaaaggcaatgtcggctgggaatggagaggaagaaagtgttcggactgaggacattgttggacaaaggcacagaaaagggaaaaagggacggagaaaagggaaaatgcgacgcgaaattgggcaaaataatggaagaggtaattaacggagggagaagacacggaaaccaattaagaagaccaaatgaaataaaccccttcagaattcgcacttggaaatggcagaggcaaaagaagtgaaaaggggggggggcaaatgaaagcattttaacaaaatatttaggccattctgaaacgagcggacgaatcggcaatgggcccctggggggtcggcgttttttgcgcccccaaaaaattggaatttgcggtgaggacggaacgcttttgcacgggcgaagtgacggacggtttttgcgtcgcatttcagacaaatgcggaatgaaagtgacaattcaatttgtttaattgacattaaacattataaaattaaagtgaaaattgcaaaggctttcgaatttccaataaa

SEQ ID NO: 63368 - DNA, 577 bp, Heterodera glycines
  Genomic contig location: Contig_ID=SeqID_33242; Location=694..1270; Strand=-
  SCN-specific regions: Sequence locations=1-265,287-318,340-417,444 -526,569-577
tacagagctatagaggaagctattcccgaaggattcgagtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 63369 - DNA, 499 bp, Heterodera glycines
  Genomic contig location: Contig_ID=SeqID_33249; Location=469..967; Strand=+
  SCN-specific regions: Sequence locations=1-322,422-449,471-499
  Gene Ontology: Mol. function=ATP binding; Cellular component =extracellular space; Biological process=growth
atgcagcttgaatttgtcgcacttttggcacgccgattaaacatttcatcggatggcacacatttagcggtgattcaatttgctgaatcggctcaacttgaaatcacgcttaaccaatacgcatgtgaaagtcaagtaaatgttatggactaatttaattattccttaattaattactaattattaattcattacttttagttggaatgggccattcaacgcattcgctatttgggcggtgccacaaacaccggcaaagcactgaattttgcgctggagaatggctaccaaaatgcacgcggcggaattgtgccaaaaggtgaaataaaatttttaaaattattcatttaataaatttatttttaaaatattcatttaaaaatttacttttaaaattattccaattaaaatatttatttaagtggctattgtggtcacggatggacagtcgcaggatgaagtggaagaaactggtcatatttttttatttttcatataa

SEQ ID NO: 63370 - DNA, 816 bp, Heterodera glycines
  misc_feature (43)..(43): n is a, c, g, or t
  Genomic contig location: Contig_ID=SeqID_33250; Location=45..860; Strand=-
  SCN-specific regions: Sequence locations=1-160,215-784,806-816
atggaagaagcaaaaagcaattttaacattctctggacaaatntaagactccgtttgatcatggcaaaaagtaccaaggaaattgttgacaaatacacgcaaaaggagaacaacgaaatggagaagagaaaagggtgagcaaataaatgaaaatgtgccgaaataaatcaaaaaaaaaataattatttaaaaaataattaaaaacaatttaataccttcatataattcaaaaatgaaaatgtaataaactgcaactcaaataagtcgagctttttagcaaaacataaaaaggaatattgtaggaaactgataccaattgtgtgtttttaagcaatccaatcccaatcatttgttttcctttaagccttctgccgcccctttccgtgccaaagtgtccttctccccaattgacgcttggcaaatggactttgtggggctacgaatgtggcgactttcccgtgcacattaatgccaaagaacagtgcccattttgtgtaagagaaagaaaataaatatgcaatttcatagtccaatttcagttggtattgtgcaaatttcgtatccttttcaaaaatgctgtcttcgaaggcaaagatcggtgggagaattatttgcgaaaggggcaaagttttgtgggcaattcgcacgcattgccaacggagaacgaattgggcgaccttttgccaagcaaattggccacggaaatttgtgagttccgctgctgaaactgaatgagggtcgatttttggcaatccaaggataggattttctaaatttaaaccaacaatttttgtctttttccatggtcacattaaa

SEQ ID NO: 63371 - DNA, 2348 bp, Heterodera glycines
  Genomic contig location: Contig_ID=SeqID_6947; Location=927..3274; Strand=-
  SCN-specific regions: Sequence locations=1-66,88-302,337-349,373 -776,798-1298,1320-1690,1712-1713,1735-1860,1882-2215,2242-2348
atgcttgtgatcagcgggtggcagacgctggtacaagggcgacaggacggagaggagtcagtctggtcaactgatcgctgtccaccgccgcggagcggatcttcacaagcaacaagggatcagcctggtcaactgatcacctcacagattttacgattaaccaaaatcaaccgcccgcctttctcagcacagacaacccggaatgaggcataagaaataaaacaacaacatacaggcagacttgcagcaactgaaccccccgacaactttgctgtggggagtgtcgcgactcacgtcacgagaaataaaatggaaatgataaattttataagcatgatgcaatttcattaaaaatgggaaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatgggttcagtcggaataaaacatcattcccctgcttgtctactgtttgtcccaatttctattttgccaaaatttttgccgggccgaatttgcctctgtttggtcccgacatcccccaagctaaaatcagtcaaaatgtccccgcgtcataatgtcccccaagctaaaatcagtcaaaatgtccccaattaaaattagcgaaaaaaccgaaataaacgatgccgaaattcattccctcttagtcatcatatcgagggacacccagaaaaaataaaggaccatgaaaaaattagtttcaaccatgcatgtcctttaaaatttgtccatttctgttttttgttatcttttcaattaattggaagtatttcattgtctttttagcagcttttattgtttttttatgattgataaattttctaaggtatttcgtatttttaaaccttaggggacattatgacgcagggacattttgacagcgcgccgcccccacaaagtgtccaagccacgaattgtccaaagccacgaattgtccaagccacgaattgtccaaaagagtaaaaacccacgaattgtccaaagtctaaaaagctcataaaaagccggaaaatgggtctattttagggttttcggggtcgctgaataccaatacgacatttatatagccccttgcctaaccctagccccacccgaataagaaaaatctccaaatttgattaaaaatatgtgctttttttgtcttcagattttgctattcattaattgaacaaatgattcgtaataaatagggttgtaaattatatggactaaaaaacgcgaaatatggacttaatatttgcttaaataaacctaaaaagtacaataaacaactaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagtaataaacttgaaagtctacaaaaaagtcggaagaagctttgtttgtcagcatttcaaacccaactgaggaggccgtaaattttggagtggagattgacgaactgcatgccgtgataacttccggcaatgttgaataacagactttgaacgaggctgaactttcaacaatgacctttgagcgcggaaaaaccaattttgggtgagatcttctcctggaatgccaatgttcttcctttacttctctcgaacatatatcggcttgacacagcgccagatgttggatggtgttgacgcattttgagataatccactcaattttcacccacccgcaaccattgtttgttagatttatgcatttatttcaaaaattaaaatttttagctacactcgggacaataatttcgactatcaactcggaacaagctatgcggctacccctagagttcggcaccggctcaccggcaccatcaactcttacatggccaaccact

SEQ ID NO: 63372 - DNA, 189 bp, Heterodera glycines
  Genomic contig location: Contig_ID=SeqID_6947; Location=3461..3649; Strand=-
  SCN-specific regions: Sequence locations=1-21,56-68,92-189
tgtcgcgactcacgtcacgagaaataaaatggaaatgataaattttataagcatgatgcaatttcattaaaaatgggaaaaaccttaatttaattggaaatgttccccctcttcgtcgttctattcaaaaaatatttgtttgtttacattcaattcttattcatttctcacacaaaaatgtattaatca

SEQ ID NO: 63373 - DNA, 79 bp, Heterodera glycines
  Genomic contig location: Contig_ID=SeqID_6947; Location=3694..3772; Strand=+
  SCN-specific regions: Sequence locations=1-79
tagagaaaaaaagataatgtttttctctggcactctctatttattggtacacatctcgttttttgaaacggtgtgttta

SEQ ID NO: 63374 - DNA, 534 bp, Heterodera glycines
  Genomic contig location: Contig_ID=SeqID_33256; Location=129..662; Strand=-
  SCN-specific regions: Sequence locations=1-2,530-534
  Gene Ontology: Biological process=protein biosynthesis
atggaagaggaacagaaagagaaagcggaagaggaacagaaaggggaacagaaagtggaagagaaatggaagagaaagtggaagagaaagtggaagagaaatggaagaggaacagaaagagaaagcggaagaggaacagaaaggggaacagaaagtggaagagaaatggaagaggaacagaaagagaaagcggaagaggaacagaaaggggaagaggaagtggaagaggaacagaaaggggaacaggaagaggaacagaaagaggaagagaaatggaagagaaagtggaagagaaagtggaagagaaagtggaagagaaatggaagaggaacagaaagagaaagcggaagaggaacagaaaggggaacagaaagtggaagagaaatggaagagaaagtggaagagaaatggaagaggaacagaaagagaaagcggaagaggaacagaaaggggaacagaaagtggaagagaaatggaagaggaacagaaagagaaagcggaagaggaacagaaaggggaacagaggagggttaa

SEQ ID NO: 63375 - DNA, 230 bp, Heterodera glycines
  Genomic contig location: Contig_ID=SeqID_33257; Location=1252..1481; Strand=-
  SCN-specific regions: Sequence locations=1-160,192-230
gtggcctccgtctgcgatggattcgcaagcccatgtggtccaactactgatcaaaatggcaaaaaaagaatgattaaaacgcataaaattcattcatcagcaatatattattttagaccgtatttttgcacggaaaacgagggggtggaaaatttgttggttttttcggaaaaatttaaatccaaaaaattgcgccaaaatgcggtgccgtctgtccccaactcttccgc

SEQ ID NO: 63376 - DNA, 543 bp, Heterodera glycines
  misc_feature (14)..(14): n is a, c, g, or t
  Genomic contig location: Contig_ID=SeqID_33260; Location=262..804; Strand=-
  SCN-specific regions: Sequence locations=1-377,401-449,471-543
acttcttcataacnccgagggcttcatccatcggcacatccaataaagcgaacaaagttcgatcaaaatcaacgccaagaagacggcctcgatttaaagtcatcggaaatggcaattgtgcacaatctcgacaaatgataattgatgcaggacaaaagaaaattggtctagaacaatgcataaaagtgattaataatcatatttgaatatgagtttttgaattgtttcagtgcggcatggtgtacagtttgaatgacccgaaggatgttgaacaacacgccaagtttcatcaccgctttacagaaacgaggagtttccaagtttcaatcagccaactttctgcttggaaagagtgagttttcattcccgtcttgaaatgttttttaaaaatcaaaaacaatattagcatttcaatattttttttttgttaaattaagagttcttttcactgagcacgtggaaattccaatcggcggatgtctctttttggttgatgccttctccacctcaacactcagaagaaagatggagtccgttataagc

SEQ ID NO: 63377 - DNA, 121 bp, Heterodera glycines
  Genomic contig location: Contig_ID=SeqID_33261; Location=38..158; Strand=+
  SCN-specific regions: Sequence locations=1-121
ggagaccactcccaacgtaatgtgcctggcacgaacagtgtgatttccatgcccggattgaccggctcacacaaacactgaatgatgagttgatgagtgactgaatagaatgaaatgattg

SEQ ID NO: 63378 - DNA, 184 bp, Heterodera glycines
  Genomic contig location: Contig_ID=SeqID_6948; Location=122..305; Strand=+
  SCN-specific regions: Sequence locations=1-48,85-184
atgaagtacccaccggcgcttggtcatttagaaaatttgcacatttacaaataatttaatattattttgctaaatataaatattcaggaaatccaagttacccgcactactcaagcaattgttcagttgtccaaacaaaactaacatgcaaattccccgaattccaagcccggaactatattaa

SEQ ID NO: 63379 - DNA, 1289 bp, Heterodera glycines
  Genomic contig location: Contig_ID=SeqID_6949; Location=2317..3605; Strand=+
  SCN-specific regions: Sequence locations=1-232,299-317,339-353,375 -375,425-548,571-610,641-762,793-896,957-1147,1178-1289
atgtctggtatacaaacgcttgtatgcgttcaacagcgggaactggatcaggcactggatcaggcactggatcaggcactggatcaggcactggatcaggcactggatcaggcactggatcaggaactagatcaggcactggatcaggaactggatcgagtacgttatttaaattgtaaaattttggaaaaaacatccctaaaattaaaaaaatttgccaaaaattcattccataaaatatattttttaaattcgtctgatttaaaataataaaattttaattcaaatttgttaaaatgcattcaatttttagcaacaccacctcaaacatgcacagatgaggcgactgtttttgcaaatgaaaacaatggggtgaaaattatttcaaaattgtttaattgaaattttttttgattttaaaattcaattcagtgtgatctgatcacttgtcctgctggaagaacgtgtggcattctgattggatttgctaggcttggcaccggtccatttgaaccatttctttacccaaaatgtgtgtccaacccgttggaattaactcgtaacacggaacaaaatggcaacgagaaaatccttacaaatggcccaggagtaattaaaatcttaaaataaaaataaatatgtgtggtttaacgcccttgggcatttttgcattagtcattttgcctatgcccaaaattaagttttaaaatttatgcttttccaatccaaaatagcttaaacaatttctgcgatttaatgattatgccatttaaattgaaaaaatatataaatctgaagaaaattttgggtttgacgcaaatgtccggggctcttcccaatattttgaacaagactgtccgagattttttttgtatcattgcttttttcgaagactcaattttatttcattttttatctttattttaaatattttaaattatataaattattttattcttatgaatttttagtgtaactgtggcacgacacaatgtgccgctgggttccagtgccaagttcggagttccatcgttaggcttggcaatcgaccatttgcacaaataattggaggtgcgaatgaaaaaaagattttttaaagagaaaattgggcatttttttttgcgacaaaaatctggcgatatgtctcttaaaaaatttaaaattttgaaattattttccatttgtatttatttgactttttttttgtaattttttcaggattccctcaatgtgttggcaattatagcatataccaaaaccccttcacaatagttccttacggaccaggg

SEQ ID NO: 63380 - DNA, 625 bp, Heterodera glycines
  Genomic contig location: Contig_ID=SeqID_6950; Location=164..788; Strand=+
  SCN-specific regions: Sequence locations=1-117,140-176,207-322,390 -413,439-440,462-532,584-625
tgtaactgtggcacgacacaatgtgccgctgggttccagtgccaagttcggagttccattgttaagcttggcaatcgaccatttgcacaaataattggaggtgcgaatgaaaaaaagattttttaaagagaaaattgtgcaattttttttgcgacaaaaatctggcggtatgtctcttaaaaaatttaaaattttgaaattattttccatttgtatttatttgactttcttttgtaatttttttaggattccctcaatgtgttggcaattatagcatataccaaaaccccttcacaatagttccttacggaccaggggtacgtttatttattaaaattaaaaataactaaaatgattattatttttttataaaaatacaaaaattattacattttcgattttcataattcccgatttatatttaaatttaaattaatagtgtgctgaaattccggcatgtttggaagggataacatgcgtgactgctgttggcatcgcaaaatattgaaatctgcagtgggctcaagtaaagaaaaatttttcaaaaatcttattttactaattttttttttttagtttttttggcccttttgtgcttgaacctggcgctttatcaaatatataa

SEQ ID NO: 63381 - DNA, 736 bp, Heterodera glycines
  Genomic contig location: Contig_ID=SeqID_6950; Location=816..1551; Strand=-
  SCN-specific regions: Sequence locations=1-8,32-33,86-172,262-369,398- 589,611-736
atgaaatgtattttttattaaaataaatatagttttatatttttatttttatattttaaatgcattttttttttacattttatttcatggttgttctttttcaacggattgatgcaattgcgcgtcccgcgacatccaatcgaaatattttgaagaataacagttttgagggtataataatttcaaaattcaaaaattattttaaataattatttaattttaaattttttaataatttaataaattattttttattttatagcaaaattgtcatccattctccacaatcatccagataaggaaggaacattgagtaaaaaagaagtcttttcaaacggtgttatcagaaaatgcctgaatatttttccgattttttattcaattttaattaattttagaatttcaaccaccatttaaaattggaaatttgtcggatgcaaaaaatgtggaaaaacttgaaaagaaaggatttattgtggacattttgcctaaaagtgatggaaatcgtgccggagttatgaatgaattgaaaaatatgaagctgaagccgacaaagcaaatttcaatcttttagatgataatatccggaattgaaagacactgacatttttaattgggcatgacagaaaagctaattagttgaacatatttattaattattcggtatcataaaatataattagtgaatccattgatataatctatatatattatataacaagaaactgctattaaa

SEQ ID NO: 63382 - DNA, 840 bp, Heterodera glycines
  misc_feature (13)..(13): n is a, c, g, or t
  Genomic contig location: Contig_ID=SeqID_33265; Location=384..1223; Strand=-
  SCN-specific regions: Sequence locations=1-194,216-840
cttgatcaaaaantcaatcaaagcgtaaggggaaataagcgacaaaatcaaaattgctttgaggttgtcgacaatttaaagacattaatgggagctatatgttaatgggtttgtcacagaatccacgcaacattcaaggacaaatcctctgaagggctgagataagcaccaacacttttaaagttttttgatgcaaataatttaaaaacattaaaggacagtaattagtttaccaaatattcctaatgaattaaaccgaaagtttttgaagatggctttaaggaatatttatcattgtatttttaatgacattaatggccgtaaacccaattggaatgggttattaaatcgagattgtatgtaaagcattaatagttttaaggacataatgacagaagagattaaacaaaaataggaccccgaatccgagctctccgatccgaagcacctaccgtagcagatccttccccgcgtccgcatcttcaaacctagattttactaaaaaaaattcttagaaattttttttataagaaaatcaagcaaaaaaattttgaaaaattgaaaagaaaaataaaataaattcgtctttaggtgaacccgtccggtggatggtgtgacggtgccgatacattgcacaaggcccagcgcgccaaggcccagggtatggccataatgatcgatttccactacagcgactcgtgggccgacccgggccaacagaacattccagcggcatggaaaagccattcattggcacaacttaacactgatgtgtacgagcacacttatggcatattaaactacttgaaaagcaatggcatttcagtggcatgggttcag

SEQ ID NO: 63383 - DNA, 677 bp, Heterodera glycines
  Genomic contig location: Contig_ID=SeqID_33267; Location=208..884; Strand=-
  SCN-specific regions: Sequence locations=1-60,82-677
tgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 63384 - DNA, 772 bp, Heterodera glycines
  Genomic contig location: Contig_ID=SeqID_33270; Location=32..803; Strand=+
  SCN-specific regions: Sequence locations=1-772
atgtcgatgtctaaatcgtcctacacctacaatcggaagacatttgaggatgcggtgagatggccttaaacatttccgcctcaaaatttatttctaatatttaaggaattccctattttgtgtgagacatgcctcggcccgaacccgtacctacgcatggtataacaatgggaggggtggtcttacatcacacaatttcccgtaaaactgtttttagagcaaagacacacatggaggcgaatgcaaaatttgtgagcgtccattcacaacatttcgttggatgccgggcagaggggcgcgctacaaaaagaccgagatttgtcagacatgtgccaagttgaagaatgtgtgccagacctgtctgttggacttggaatacggttcttatgaattcgccgagcaaaattaacggatataatgaaatttaggccttcccgtccaagtgcgtgacacggcactccaagtcaaggagaccatcccaaaagtgggggccaatcgcgactatttcatccaggttttttggtggcatattttttcctattatttacgaattaaacaaaaatcccgctgggtttcagaatgttgaccgtgctttggaacaaacggatggcacagtgccgtacggcgagttggccaaactgaccgatgcgggcaccaacgaaatgttgcgcaagctggcccgaaatcagccatactacaaccgaaatttgccacacatttgctcattctttgtgaagggcgaatgcacccgtggtgaagagtgtccgtacag

SEQ ID NO: 63385 - DNA, 801 bp, Heterodera glycines
  Genomic contig location: Contig_ID=SeqID_6952; Location=1364..2164; Strand=-
  SCN-specific regions: Sequence locations=1-140,162-248,271-400,446 -447,470-727,749-801
atgagctcccagcaacgccaagcggaacgtgcccaacttcgcgcaaggctgaatttacttgtcgacgatgtcgactttgtggttcaagggctgatcaacaattaccaggccgatgggttgatcaacgcggtaagttttcattttgctgtctttggttttttgcttatttttttttttgaattttaatcttgattgaacaggcgccggatgatggacagctaatggtaatggaccatggacaaggtctacagcatgagcagcagcagcagccgtgggaactggacccgcctctgcccgagcagcatttggaaattgacccacagctcccggatgcgtgggaactggttccctaccagccgacaccacaatgggaccaagttgtgcatgtggaacaacaaccgcagcagcagcaacactaccaccaccagcaacaacagcagcagcaaggcgtgggatgaggaatgggaggggccgctttcgccaaatgcgcttgctcaactccaggacgaggcggacgggctgcgtcaggatttgagtaaggattttgggtcagggttccataaaaaaaaattaagtggttgagagatttgttcgtgtggggcagccgcagcctacgtggcccggttaccaaagatattgacgcggaaattcaaatttgaatttagcgccaaaaattgtaacaaaagtacacgggtcactactcatgagaattaaaaatattgtataaatttaatacaacaacttaaatcaattaacgaaaatgagttaataattaatatttatacaaaaacaagcaataaa

SEQ ID NO: 63386 - DNA, 746 bp, Heterodera glycines
  Genomic contig location: Contig_ID=SeqID_6953; Location=61..806; Strand=+
  SCN-specific regions: Sequence locations=1-394,416-746
atggccgaagcagcaattcgccaactgtccgacgtgttccagcagttcttgactgctcagcaagcaaatgtggcagcaccagcacaaccgattccaatgcaaatttggcaaatttcgactgttttggtcttggtgaccatggcgaaagcgacatcgagggttggctggaacgctttgcccttgccttgactgctcaacaccgaaccttcaggacgatttgaaggttaagctcttgctgacaaagctgagtgagacggcctacgccgagtatagcaaacactgtttgctgaaaaagccaacagagtttgactttgctaaaacttccgaaatgctgaaaagcttattcgcgaagcaaaaatcagtttggatcaaccgatatgagtgcttaaaggctgaaaagcaagacgaggaggaatttcgcggcttcatcaaccgccacaaaaggctgttaagcgattttgagtttaaaaagctcaacgaagagcagtttaactgcttgatgctcctcgtggcgctcaaatcgccgaaggatgctgaattgcgaaagcgcatactgtcaaagttagcggccgatggtgacagagcaacatatgaaaatgttgtgaacgacttacaaatgtttctgtcgaccatttcggaagcgaaagcgatggagagaccatcgaactccaacattttggctgtaaagcgcaggcagcaaccgaagaaggacaattttggagaaaagggcaagaagcagcaatcat

SEQ ID NO: 63387 - DNA, 678 bp, Heterodera glycines
  Genomic contig location: Contig_ID=SeqID_33272; Location=49..726; Strand=-
  SCN-specific regions: Sequence locations=1-39,61-116,141-162,184 -602,624-678
atggacggaacggcgcagccatcgtcatttatagtggaggaggaaatgctggaaagtgtggcggacgaaatggcgggcaaagagggacacgtggaattcacgggggaaaccagtggaaaagaggaagtgcagcagcagcacttagtgttgctcaagagtcccgagccggcggagggcggtggcggcagctcagctacaatggcgacgagccgacaaattggcactaacgaagcatttgacaggccagcggacgcagcactgcttttcgaggacattgacgacaaggacgtgacgtatgcgccggagattcagtcgttggaagttccgccggaccaactcagccaggcggactcgctgaatttggtggacgaggaacaattctcggaggagcatcaacgggtcattgtcactgatggtgaagacgaagtgccaccgaaggaagccgagaagcaaagagaacggcatgagccagaaaagttagaggagcaagaagccggagaagcaccgcagcgagagttgacgccgcatgaggaggaaaatctgcagcggatcatcgacagattgcgcagaacgccgtcgccacggcctcatcggatggaccaagcgcaggtgccacaggcgccgcaattcttgcgcagttacttcaacgacgagtccacctcatcactgtcatcgacg

SEQ ID NO: 63388 - DNA, 616 bp, Heterodera glycines
  Genomic contig location: Contig_ID=SeqID_33277; Location=518..1133; Strand=-
  SCN-specific regions: Sequence locations=1-470,505-616
acgtaaggacagcctttctgttcggcaaaaacaatgtcctcgcattttctggcgacagagaagcccctggtaaggagaaaaattcaaactcgagcattgattgctttgcaggttatttgtcgcttcatcatgaccaaaatcggatgcttattctcaaatggattccgaattcgcttctcctttcgaagtatgatatattcatttaagcgatttgttgcttaatgattcactttaacccattttcgcttccttttagacccgggggttcaacaacaaatgctgtcaaaagtccaagtcactcatcgcattgtgtgccggtgtcgattaaattcgagaccgtttcacatttgcacttgcataaaaatggtccgtgtctatgccaaaaatgtttgtcaattaattgtccctccctttcagagggcactctttcatcttcaattgtccttatcgattctgatggtgttcaacagttttgcttttcgttctctcttgagcaacattgtttctcctttctgaagacgttggaaggcgcacttttcccacttttcaaaatcgaccccccattaaattccattaaaatcgaatgcggtgccacaggtcgtccactaatgggaat

SEQ ID NO: 63389 - DNA, 388 bp, Heterodera glycines
  Genomic contig location: Contig_ID=SeqID_33278; Location=90..477; Strand=-
  SCN-specific regions: Sequence locations=1-388
acgctatgcaattcaaaaaatacgctaaaccggctgagattgtgcggtttgttgagaatggaatgaccgcactcgtgttggattaccgggagaatcaaacggaaaccattgaatacaaaagcacgcacggcacaattaaagtggtgcacatcagcagaagagacataatgcccgggtgagtctcttttgacttcgcttaattcgtttatgcattaattagtcttttagaagcttgcttcactccctgttcaaagccttggacatcagtgtacgccctcttctcgaaaacatctctcatgtcgatcttgttgcattgctcggcgaccccaatgacataacggacgaaaaggggaccaaaacgaccattttaatggaggcactcaccact

SEQ ID NO: 63390 - DNA, 425 bp, Heterodera glycines
  Genomic contig location: Contig_ID=SeqID_6955; Location=148..572; Strand=+
  SCN-specific regions: Sequence locations=1-222,244-425
  Gene Ontology: Cellular component=nucleus; Biological process=signal transduction
attttctccttgggctgctgccccaacgacgaatgggtggcggtcggaatggaaaacaacaatgtcgaggtgtgccccccccccctcactgcttgtaatataaatgctgtttttaaggtgttgcacatgaatcgccaggataaatatgtgctcgatgaccaccagagttgtgttctttcgttgaaattcgctaacagcggaaaggcaagccaaaatgagtcgaatttgaataattttatgtttttcagtggttcgtctccaccggaaaggattacgtcgtgaattgctggcgaacgccgtacggttaccgtcttttgaaaagcaaagagaacagttcggtcctttcttgcgacatttcgcatgacgaccgtttccttgtgactggttctggtgacaaaaaggcatctctctacgaattgagcttt

SEQ ID NO: 63391 - DNA, 1486 bp, Heterodera glycines
  Genomic contig location: Contig_ID=SeqID_6955; Location=1359..2844; Strand=-
  SCN-specific regions: Sequence locations=1-14,36-166,188-659,688 -691,713-796,818-921,943-1107,1129-1165,1187-1376,1398-1486
gccatcggtcggcttctccccctcgccttttcttctgccctaaactctctcacgatttcgcaatgtcagctgaacaaagcgattggcaaagtcgtggaaagggcctgcgaagccatcgacggccttcgcgaggtccgttctgacgacgccattccgccatttgaaattgacattttaagaaagcatgctcaattctgggtgaattgatgcaattggaggaaaagcacccgttgagtgaagcaattgccgaaagggacctgctcagttcgctgttcaccttaggtgaatgccttttatgctatttttgattattttggcgaatttatccttaggcaagtgccaaaatggaacgatgcctggggcaacgacggcgcatttaccgcagccgttcgaagcggccgattggcgcttttcccaaggctttgcgcggttggcgcctcttttaaattcggacacttacggaagaaatgctttggctggctttgttctttctgccggtgaggcaaaaaaggagtgccgaaaaggaaaaggctttaatcgcaacaaaattaggaagcgtttgcagttggacgagtcaaaatgcttttttggcgattgtttcccatttgaaaccgaacaaacgaaatgccaaggtgcccttagtgtttgttgtctgtgtcttcgttttatccccctttttccagttcctcgactcttttctctctgatcttctctccgtccattcttcgatcgtttcccgtcaaggcgaccccggcccagtgcttcaactcttccgattgcttctcaacgaccgccaattgcaagaaattgaagaaaatccggacggatatttcgaatttacggcactttgtgagctgccgattaaagtcaagtggaatgacttttcatttcgttgtcatcaaatatttcttaagctgtccgtggggaagggaaggccaaaagttaaaactttggccgtctctgtgctcggctcgctgcttcaactgaataagcaaagtcaaatgtaccgccgcgtgcttcgcctggtaggcatggaacagcttgtccccccaagccgtttccctcccaaggaatttttttttaatttacaaacaaaaaaagccttagaaaactttttaaataaagaaattacaaaaaaaaaattagcggaaaaaatcaattttttgaaattttcccttggaaaaacttatgggtttttattgaaaaatttctcggggggggggaacggtgcactcggtgggcatatttcgtcttcgatttgccattttttaagcttatttctctgttggattcgccatacgcgtcgctgagggaacaagcagccgaacagctcttcgagtttttcagttgcgaatccgacgacagcgaacatgggactgaaatggcactgaaattgctgacagagaccgactggggccgagggagggagggcctaggagagaacagacgccggatcagtgccattctgttggccaatgcgagatga

SEQ ID NO: 63392 - DNA, 312 bp, Heterodera glycines
  Genomic contig location: Contig_ID=SeqID_33286; Location=317..628; Strand=+
  SCN-specific regions: Sequence locations=1-312
atgactggcggtgccgtgccaccaaagccgtgccgtggaccgaccattccgatggcacagacgagaaagccattggacagcaattggacaacattcgcccatcgacgcacaaatccgcccgcgacaaacacaacgaaggcggtgccacaggccaagacgatcagaaatttgacgtatttgcggatttgcatttccagccgactttcgttggactgctggcccgtggtcaaatgcgcaatttggccgatcaccgtttgggccgcgacgcgaatcactgcaaaaaatggaaaacgcaaaataactgagttttaa

SEQ ID NO: 63393 - DNA, 935 bp, Heterodera glycines
  Genomic contig location: Contig_ID=SeqID_33286; Location=1..935; Strand=-
  SCN-specific regions: Sequence locations=1-37,126-905,927-935
  Gene Ontology: Mol. function=sodium/potassium-exchanging ATPase activity; Cellular component=integral to membrane; Biological process=neurotransmitter uptake
cagggaatcgcgtgccagcggactgtcggtgagacgcaaattaaactaattaattaatttaaatattcaaatattcaattacatatattaaattacaattagacgtaagtaaataattgaattaagcattttgcactgttcggagctgaagttggaatcctcctcaatcaccggcgaatctgagccaattgagtaccaagctgaggaagtggccgagtccgtgtcggtgttcgaggcacggaatgtggcgtttaacggctcactttgcgtggagggcgacgcaattgcaattggtgctggcatttaattaaaactcagttattttgcgttttccattttttgcagtgattcgcgtcgcggcccaaacggtgatcggccaaattgcgcatttgaccacgggccagcagtccaacgaaagtcggctggaaatgcaaatccgcaaatacgtcaaatttctgatcgtcttggcctgtggcaccgccttcgttgtgtttgtcgcgggcggatttgtgcgtcgatgggcgaatgttgtccaattgctgtccaatggctttctcgtctgtgccatcggaatggtcggtccacggcacggctttggtggcacggcaccgccagtcattctttccgttcctttcgtcggcaggtgccctgcggattgcctgcaacggtcacttccattctgacggtcatcgcgcgtcgcttggccagcagaaatgtgtacgttaaacgtttggacatttgcgaggcgctaggccaagtggccataatcgcatctgacaaaacgggcacactgaccaaaaacgaaatgcacgtcaccgcactttggcactgcaacaaattcatcaaaggtggacaaattgagggggagggggtaaggtcaattagggaataattagagtgaatggaaaaaagaaatacgaattaagaaacagcaa

SEQ ID NO: 63394 - DNA, 963 bp, Heterodera glycines
  Genomic contig location: Contig_ID=SeqID_33287; Location=9..971; Strand=-
  SCN-specific regions: Sequence locations=1-963
atgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatagaaatgtacaaattcgtccattgtctatttatggaaatgtacaaattcgtccattgtctatttatagaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatggaaatgtacaaattcgtccattgtctatttatataaatgtacaaattcgtccattgtctattcacaccgtccgaaaaaacgagatgtgtaccaataaatagagagtgccagagaaaaacaatatctttttttctctaattttttgtctccttttggcgtactatctaatatttttattattaggaaaaacaacattcacttcatcctgtttaacttttttcctgcttattaaatccacaccaaattttgcaaatcgatagagaaaaaaattctgcattattctatgctcaattattattttctgtgctcaaactcaaaagttaagaagttcctaataaa

SEQ ID NO: 63395 - DNA, 1095 bp, Heterodera glycines
  Genomic contig location: Contig_ID=SeqID_33289; Location=264..1358; Strand=-
  SCN-specific regions: Sequence locations=1-75,97-164,186-198,220 -277,313-331,389-570,592-751,773-775,819-910,932-1019,1041-1074
atgtcgggcgggtggcaattggaacaacttttgtccgcttttcaaattatatcggcacaaagaggcggcaccaacgaaaatgggtaaaatatttttcttccgtttttaattttgtgatttgctattaatgacttttttaaagaatttaatttaatttacagaatatttccttttcaaatcattcgcattgacgcgcaaaccaaaaaacatttttgggatgaaattaaagcgaacagcgcgagagaaccgcaatttattggtgggtgaacaaagcgagtaaataaaataaaattataattaatttattaaaaaggtttatgaagctgctttcaataatttaatttttgtacaaaaaaagatttttaatcgttttaattattttatttttcttttcgacaaaattcaacaattttaatagcattcgaattctaagctttcccttggtgatttggcaattattaaaaaaaaagttctagcatcaaaattgccaaaaatcgggatttttaagttttttcttaataactttaaaattaccataaaatctgtttttttgtaagcctcgagaaatcctgtgttaagaataccggggaccgcgggtccttgacagggtgccaaagcgtcaagttggactcggacccgtcaacaccctactggaaaccctacataatcctaagccctatttatatcatttttatggcattttgtgcctatttcaatgtttatagaatttttttttccaaaaataacgattttaacatttaatttacatatttcgtacaattttggtatttttcttatatattttatgtacatatttttgacagccctaacaattgcctttccataaatatttcagaaaatttcaactttctgctcaaactcggtgaattcacattgtcatattacgaggtgtacaaagtgttggaagcaattttaatgcgatggtcaaacacggagaaatcatctgctgacaataatggagaacagccgcccgaactttacactttcatggagcaatattttaacagcaaattaaattcccaaattttgcaaaaaaaggacaaaaaacaaataggcagcagcagcaaaaggagg

SEQ ID NO: 63396 - DNA, 68 bp, Heterodera glycines
  Genomic contig location: Contig_ID=SeqID_33290; Location=58..125; Strand=+
  SCN-specific regions: Sequence locations=1-68
atggtggaggacaaatctttggttggaactgtgaaatatgacggggcgaagcagtgcttttacgacag

SEQ ID NO: 63397 - DNA, 604 bp, Heterodera glycines
  Genomic contig location: Contig_ID=SeqID_6956; Location=290..893; Strand=-
  SCN-specific regions: Sequence locations=1-24,46-229,269-398,420 -511,536-604
atgtcggagaagaaaataatcgcggacattaagaaaatggccaaaatggggcaaatggtaggtgttaattattttttttttggcagaaaacgaataaaaaaaggtcgtcacaaatttcattatagaatttaaccctcatccttttgctatggtatatcaatttccgaatttcattttagaattctgtacgaataatggcaaaggatttggttaggacgcgtcaatacgtgaaaaaggtttttgcctttttggtttatgccatttaaaatggcctattcagtttattatgatgagagcgaacatccaggcagtctctttgaaggttcaaacgctgaagagccaagactcaatggcacaagtgcttccccttggattgaaaatcggaatgattcgattaattaatttcaaggcaatgaaaggcgtcacgcgggcgatgcgcagcatgaacaagcagctgaacttgccgcaaattcagaagataatgaacgaatttgagaagcaatccgaaattatggacatgaaggaggaaatgatggacgacgcaattgacgaagcgatgggcgacgcggacgaagaggaggagacggacaaagtggtgcagcag

SEQ ID NO: 63398 - DNA, 722 bp, Heterodera glycines
  misc_feature (702)..(702): n is a, c, g, or t
  Genomic contig location: Contig_ID=SeqID_6957; Location=34..755; Strand=-
  SCN-specific regions: Sequence locations=1-266,288-722
atggagctcgaagaaggagaatatgtcgaggaagaagagctttttacgcgtaatcaacgtcaaaaaaacaaatttcaattaaatcgagaacatctcaattcatctgttttaaaacgaagacgtgaagaggatgattatgaaacagtcagcatggagttagaaagcgatccaggtgcattacaatttgttgtacgtatttgataagttttaagataattgtctggttttccctaatgtaagacaaaaaaaattgatgggacaaatctaacagaaaacaaattgtatttaatccacagatggttaatttagagatgtccaaagaaagtaaaacaaccgaacaccacagcgaagacgaagttgagctgctgagaagacaattactttcgcaggcaaacatttttactgggaatattttgcttatctctattcccataaaatttcattaaacggcaatttttacttaacagcagttataggttcaaatgaagaaagcgaagaagcaaacaatgaacgaacgcgtctcagaaatgcaaaaagaaatggagggaagtgaaaatgtggagtcaaccgaaagaatgaacgacttgcagcgtatgagtgagaaattacggcaactgaatgagcagttaacggaggcacaacttttgcagtcaacaattgtgcgacgaaaaaagcgattgcaggtccatccgttaaaatggnctcaatacatttccaataaa

SEQ ID NO: 63399 - DNA, 627 bp, Heterodera glycines
  Genomic contig location: Contig_ID=SeqID_6958; Location=1312..1938; Strand=-
  SCN-specific regions: Sequence locations=1-61,83-210,232-533,555-627
atggtggtgatgaaaaaactgaattatttgctaacttatttgcaaattcgtttaacgattctgaggttgacccaggctgccataaactggggcaacacttttgctaatcaatgctttatatcagatatagactttaacatcatcgaaacgcaaaaacttttgaaaaaactcccgaataaaaatggtacatccccggatgatataagctataaaacattgaaaaactgccattcttcattggcaactgttattactgacctgttcaggatttctttagattctggttctcttccagatatttggaaggaatcaatagttttacctcttttcaaaaaaggggataaatctaatcctgaaaattataggcctatttctctaacctgctcactttgcaggttatggaaagaattcttagccaaaatatttacaacttcctcctaaaaaacaataaaatttcggaataccaatttggttttgttagaaataggtctacgacaagtcaactaatagcagttgtggaagattggtacgaggcaattataaaatggaaaaaatgtgaccggtcatgttaaccaaataacaaggaatgcgtatttacgtatgcgttccttgtttagaataattaaa

SEQ ID NO: 63400 - DNA, 333 bp, Heterodera glycines
  Genomic contig location: Contig_ID=SeqID_33293; Location=89..421; Strand=-
  SCN-specific regions: Sequence locations=1-81,105-120,142-333
atgcccattgtcaagccatggtttcttccatatgtttcaactcgaacaatttcaaatgcaacaaaactaattgaagtcgtgcgcatttttaaccatatttcaatggaactttctgaaagacttacaaataaatactacttttatcaattaaatttgctaaatgaggacaaattaagcaattataaagcaaactttggcaatttgaatgctattcgcaagagatttgacgaaaaattgaaaataatgttcaaaaatgaaagagagatcgaagaaggttatacaaacgattcaaattatctgcaatcttctccattttatgacaaaatcattaag

SEQ ID NO: 63401 - DNA, 491 bp, Heterodera glycines
  misc_feature (490)..(490): n is a, c, g, or t
  Genomic contig location: Contig_ID=SeqID_33296; Location=261..751; Strand=+
  SCN-specific regions: Sequence locations=1-89,128-172,194-331,353 -364,386-409,431-467,490-491
atgtttcgttctcattcacatagcgttttgctgaacattttgctcaattacacttcaagcatcgaagcaaaaattgcatattcgcttggttttatttatgaaatttatattaaattaaatattttttgccattttttgctgtttcggccatttcgaattgtttagtgccaattttcttttatatttttagactgccgaaagccgttcctttggcattctgttttcccacaaaaaatattgccaaattcgactttggatggtcatcattttccttttcgttaccgttttccatccgtgccatgccccgtgggcaacaaaagtgccgaattaatttgtgtcgatggaggaaaatggcgagccatcggatgccaagaagaaggagatgagaatgaaaattatggtaaaaccgtaaaacattaataatcattaatttgttattacattagcaaaaattttaatcttcgcacatttaaaaaataataatatttana

SEQ ID NO: 63402 - DNA, 567 bp, Heterodera glycines
  Genomic contig location: Contig_ID=SeqID_33300; Location=26..592; Strand=-
  SCN-specific regions: Sequence locations=1-3,26-69,91-241,269-351,373- 380,402-567
atgaaaatattattaatattattatgcgcattaatattcgaaaatacaattaaccaaattgaggctggcaaaataaatcaagaaaaaagttttgctgaaatatttggccaaagatgggacgaaagaactgaagaaaatatgtatcgaattggtccaataatttatgaagaaaatgctgatcagaataaccaatttggacaaaatgatcaacatattgatcaaattgttgatgaaagtttggaagtgaaagaagagcagagtgaagaaatgtccacagattgtgatgaattgggcggccaattgccaatgtcaacaaatattggacaaatttgtgaggatttttcaaaagcaattgataaaaagaaaagagaaattgttgaaaagtttcagaaaattaaggagaaagttaagcaaatggaaaagaaatattcaacgaaagaatggcaaaaaattgaacgaaaaattgcaaaaaaattgggtacaaatcaaaagaaaatttacgaatggaaaacagaatttggaatgatcaaaaagcattattatacggatgatgaaaaatataaaaaa

SEQ ID NO: 63403 - DNA, 1063 bp, Heterodera glycines
  Genomic contig location: Contig_ID=SeqID_6959; Location=1965..3027; Strand=-
  SCN-specific regions: Sequence locations=1-143,186-302,325-337,378 -484,506-510,557-681,704-716,772-914,952-1063
  Gene Ontology: Mol. function=protein binding; Cellular component =integral to membrane; Biological process=signal transduction
atgttgttgtctattttcgtatttcaaatgcgaccatttcggtaaccaatgtggaggattcaagtcgatccacaaaattgttggcccaaaccacgctaaggaacattttgggcacaaaaacattggccgaaatgttaaggttgaaataatattttttaaacaataatattatttttttaaatttagcgaccgcgaacaaatctcgctgcaaatgcaaagcacactggacgaaataacaaagtcggaaatataattcaaggattgggatatatttcagatggactccataaaaatagcaattcttaatttaatttatttttaaatgcctccctaacacaaaaaatcccctttttggcttaattttaatttatttgtaagcccctggggagtgaaggtggaacgagtggagatgaaggatgtccgccttccggtgcagcttcaacgggcgatggccgctgaagcggaggcaacgcgcgaagcgggcgcaaaggtaacactaattaggaagagaaaaatacaaaattaatatttaattacattttattttaatataaaagtttaatgaaatttgttgaaaccaaaattacaagaaaattttaaatataatgattttctcaaatcataagggatgtgttatttttatgttcaaatgctttcatattaacatgcttttagaagattgggttgaatttaaaaattatttcattaagacgaagatttaaaaataaatgtaaaattttaaaattaattttttaattttattaatattttccaatttccagattattgctgctgaaggcgagcagaaagcctcaaaagcgttaagcgaagcggcacacactgttgcgcagtcgccggttgccattcagctccgttttcttcaaactttgacttcgataaggcaaaaagcgtggaaataaaaaaactttttttatatttttaattattttagtgctgaaaagaatcgaacaatcattttcccactaccaatggagctgatcaaacactatatcaggtgatgaatgcttagaaaattgccaaaacaaaatgaatgccaattaaa

SEQ ID NO: 63404 - DNA, 1190 bp, Heterodera glycines
  Genomic contig location: Contig_ID=SeqID_6959; Location=4483..5672; Strand=-
  SCN-specific regions: Sequence locations=1-273,316-367,391-404,430 -444,469-735,757-1058,1152-1190
atgcccgctgagtccccacataaagcaattgccaattgcctgagggctcagccggcacttttttttgcgtcggttgatggcattccctggcacaaaattatttgtgtgagagtgtgcggtttctaattcataaaaaccatgcaatttactttcaacagaatgtcatgggctgctccaattcatttttctttcaaattgtataccaaccactccaattaatttataattacattctctataattatctaggatattttgactaaattatcttagttaaaaaatttttttgaaatatttatcttaatattaattattggaaaataagcatactaagaaacaaaaaaatgtagtatttcttcacttttagctttttagtgttgaaaattcatgctattttctttaccaaattattatttaatttaaatttttccgaatgtttttatttggccaataatcattcacattttcttccgccatttatttgtgctagactttaccacaacattccttgccacttacgacttactttaactcaattattccatcattatgatgtgtatcccgcgtaaaggcaaagttggcaaaattgccaacgacggcactaataagcgaagccgaaggcttaaaagcggcaacttatagaggcgaactcggcaaaaaacattgattaatttttcatatgcatttattggcacaaattttgagaggaagtaaatgcccaaaaaatgtgccaaaaaattctgccattttcaatttattttttagcctcttattaaaatgacatttttgagaggacttttgagttcgagaaaagggagagcgtcgtcaactttgaccaacagcagcagacgaggccaagcagcttctgcaacacaaccgatgacggcgacgacatcgcattggacacaacaccaacgccatttccaagcatcacaggcattttttagtgataattaaaagcaaaaaaaaaaaacttttttttagcattatcaacaccagtcaattcggttcaagggcaatgaccgtaacgatttctttgcaaatggtaatggttaatgattaaaattataatttcatcttaagaatgtttttattttttaaataactataaattataaaaataacaaaatacttttattttgtttaattttggtattcaaattaaaattatgctgattttaaataataaa

SEQ ID NO: 63405 - DNA, 278 bp, Heterodera glycines
  Genomic contig location: Contig_ID=SeqID_33302; Location=102..379; Strand=+
  SCN-specific regions: Sequence locations=1-153,182-278
ccaaattttgttgaatttatgaaagaccgaccggatttgcttcacaaatggcacacaatggagaactttatgaaagaatgcattaagcaatttgaagaaaattaaattcgtggcatttcggcaaatttgaaattgtcattttaggtttggcttttaaaacaaaattttgggaaaatttttatatgttgcacaactgaattttttttttattgtaatttgaaattttgagactctttatgtaacagattttaatttggataaattcattggattaagta

SEQ ID NO: 63406 - DNA, 56 bp, Heterodera glycines; identical to SEQ ID NO: 52733
  Genomic contig location: Contig_ID=SeqID_33303; Location=97..152; Strand=+
  SCN-specific regions: Sequence locations=1-56

SEQ ID NO: 63407 - DNA, 346 bp, Heterodera glycines
  Genomic contig location: Contig_ID=SeqID_33308; Location=458..803; Strand=-
  SCN-specific regions: Sequence locations=1-42,134-346
aaaggaaaaaattgcaacaaaagtcatttgacgaaatatttggagaaaaatgggaagaaaaagaagaagaaaaaagagaaataattggaaaattttataaaataaaagagaaaatcaaggaaaaaggaagaaatattcagcaaaagaatggagtaaaatcaatgcgaaaataaagaaaattttcaaaaaaagaatggaaccaaaattataacgaaatttgtaagaaaattggagttagtcaaagaataattgagaaatggaagaaacaatttggcaatggcatacacaagaaaagtattatcaaaaaagaaaaaatggaaaaaatgaaaatgtattggcaaataaa

SEQ ID NO: 63408 - DNA, 351 bp, Heterodera glycines; identical to SEQ ID NO: 53910
  Genomic contig location: Contig_ID=SeqID_33311; Location=442..792; Strand=+
  SCN-specific regions: Sequence locations=1-20,51-351

SEQ ID NO: 63409 - DNA, 812 bp, Heterodera glycines
  Genomic contig location: Contig_ID=SeqID_6961; Location=116..927; Strand=+
  SCN-specific regions: Sequence locations=1-161,216-349,389-471,556 -622,655-788,811-812
atgcatttagtgaaagtcttaaaaattcactgctggaaggaaaagggaccaaatttcggctccaaaaatttttctcgcttagtcggggcgatattgcattatatgagcaaatggttagcaaatttcctcaattaaaaaatttgtctagatcaggtaggtgcatttaaaattttttttataaaataatttttaaatatttaattgattttattatacaatagaattaacgaacgacgaaataacggaattacaaattcgaacttatattaaatttcttgacaataaaaatgatgagcaaatttgtagacgcgcaaaatatttgctcgatattttagcattttatcaatggtattttaaaataatttttaataaaaaaaaaactttttaaggttaaaaaataaggacgacattttaatggacaaacaggccgaagtgttaaaacacttggagttgtacgaacttttgatggtcattaaaatttatattttttagttgcaaatttctttgtttttttttcaatttgaaattaataaataattaaatatttttattttaggattcggtgccaaatttatctcaaaatgagatcaataatgatatgattatgcagctgttgtacgaacagagaaaagaattatttccaaatttaaatattgtaaaattttcaaattttgacagcccccaaggcggtgaaacggatgctaaatcggcacaacaatttttgcacggcaaaatcctccaaaaattggttttaaacagcgaatttttgacgcagttaaaaggtctctgaaaattctttaaaaattagcaaa

SEQ ID NO: 63410 - DNA, 1116 bp, Heterodera glycines
  Genomic contig location: Contig_ID=SeqID_6962; Location=2072..3187; Strand=+
  SCN-specific regions: Sequence locations=1-82,118-150,172-504,541 -665,695-706,731-735,908-991,1013-1116
atgcatttggtggtacaatcgcacagttttgtgctgggccaagttgcaaaggattgtgccgaatttgttcaatttgtcaaccaaaatgggattggaattttgaaaaatttatattgcggtaaataaatgtgccataggtcgtcgtatcgtaaaagtgccagttttgcagaattttcgagcaaaactcttcacactttttgtttgatatggttgtgcttataaaaattattacgagtttttctcgaaaaatctgtaaaattggctttttacgaaacgatccagccgcgtcaggatcaatcagccgaggacaactcagctttacgaggtgtcatgacaacttgtacacagacaactcgtacaatgacttatgctaggcctatgctttaggctaggcctaggttaagcttagtctttattttgtaaaaatttttattgtacgactgagttgtctatcagccgaattgtcccatcagctgaattgtcctcagctgactagtccagaagccaatccagcacattaaataaaaatcaattttaattttgattagatttttttcacagaaaatattgcctttaatgagcgaatcacttattacaagacaattttgggctcacctaattcggaggaaagaaaagtggcagaagcattgcttgtcattaaaatgacttttagtgaaattttacaaattgaaaaagcaaatttcaagtattattttcatattttgtttaaaaagcattaatttaaataaagatataaataaaataagtttgcatatatttaatgatttatctaaaaaacaaattcataaatccttaacaaataaaatattaataaattgaaaaatattttataaaaatgctaaaatataaatattcaaattttttttaaataaaatttgattttaaagagcatcgaaatttgacgaccaaattggcatctttcgagccgaattaattgccttgatgaaaatgcttcaaattgtccttggcgagacaaaagcaatgttttggatgttttgtccaattttaacttattttcattttctgaaaacgaaacaaggacattcatcagaaaagttagactacaatcttttaaatatgtgcttcaaaaatacg

SEQ ID NO: 63411 - DNA, 649 bp, Heterodera glycines
  Genomic contig location: Contig_ID=SeqID_33312; Location=1..649; Strand=-
  SCN-specific regions: Sequence locations=1-78,100-480,502-617,639-649
aaaaattttattcatctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccgataaatctgggcgcatcggttcagggggactgccccgaaaacacgaaaaaaaattttttggataaaaattatttaaatgaactga

SEQ ID NO: 63412 - DNA, 393 bp, Heterodera glycines
  Genomic contig location: Contig_ID=SeqID_33314; Location=296..688; Strand=+
  SCN-specific regions: Sequence locations=22-183,207-356,378-393
gaaaagccggacgaatttgaggagccatcgaatggggagaagaagccaaaggggggagcggaagaccaagctgacccaaagaagaagccggacggagtggaagaggagccaaagtcggagaataagccaaatgaagcggtgtcgaaggaagaggaaaaccaggcggaggagcccaaaaaggcaccagagctaaagacagcggaaaactcggaaaagccaccggtgtcacaggaaaaggcaccgccaaatggcacagccgaagatgatgtacaagttggcaagcaaggggaggaacaccaaaaacaagagcaaatgcaacaggcaggtgaccaacagccccaatcagacgaagtggcgcccgcgcgtgggaaccgacgccgacgaggtgcaaaa

SEQ ID NO: 63413 - DNA, 828 bp, Heterodera glycines
  Genomic contig location: Contig_ID=SeqID_33315; Location=46..873; Strand=+
  SCN-specific regions: Sequence locations=1-406,428-828
atgcaagagtgccacgactggatttggacgcagccactgatcaatggacatcctgtcaaacttgcggctgactcgtgctcgcatctgacaattattcaggagccactttggataagtttggggagtccaaaattgagaaaacaaggtaaaaaggttggcagtttttccggtcacaaattgagtttgttgggcgaattcgattgtttggtgcaatttaaaggtgttgatttaaagcttaaatgttcagttgcgaacaccgatgctccaaacatcatgggactagattggatcgtgccgtttgagcaggccacacagtctccaatcgcgaccacattggatttgtcaattgccacaacaaaagtcaacgcaattgaaccgaccgatgaaccaacaaatttggctgaacaaatgaaaaattcttttccacaggtttttcggccaggtttgggcgtgtgcacgaagatggaagcaacgcttcatttgaaacctggtgctcagcccgttttttgtcgagctaggccagttccgcatggagtttcggaggccgtcaacagcgaattggaccgtcttgttgaaattggagcgatccaccccgtcgatttttcgcgttgggcggcacctgtcctcgctgtgcgtaaaaagtctggtgaaattcgtgtttgcgtcgacttcacgaccggactaaatgatgcgttggaactcaaccgtcatccattgccacgaaccgacgacattttccatgcacttcgtgggtcaaaagttttctcacaacttgatctgcgcgatgcatatctccaattggaattggatgaaaagtcaaatcgttag

SEQ ID NO: 63414 - DNA, 285 bp, Heterodera glycines
  Genomic contig location: Contig_ID=SeqID_33316; Location=427..711; Strand=+
  SCN-specific regions: Sequence locations=1-14
atgaaaatagcattggggaaggaggagagacggaagagaaagagaggaaaaggaaaaattcgaagcaaggagggggagaaagaagaggaaaaggatgaaaatagcagtggggaaggaggagagacggaagagaaagagaggaaaaggaaaaattcgaagcaaggagggggaaaagaggaggaaaaggatgaaaatagcattggggaaggaggagagacggaagagaaagagagaaaaaggaaaaattcgaagcaaggagggggagaaagaagaggaaaaggatga

SEQ ID NO: 63415 - DNA, 272 bp, Heterodera glycines
  Genomic contig location: Contig_ID=SeqID_33317; Location=481..752; Strand=+
  SCN-specific regions: Sequence locations=1-7,29-131,157-272
atgatatcaaaaattaaaattttagaaggtgcgtaaaatgccgtttttctcgactgggttccatatttaaacaatcaatgtctttgatcataataatctttttctgattcaaagtgcattttcgatagagaaaagaaagggcttcaaaatgatatacaaaaatcaatcaatcggtaagatatttaatacgtttagagctttccaacaaaaacgaatggatttatgttaacaattcattggacaattacccgaaatcgacaatgacaagttga

SEQ ID NO: 63416 - DNA, 1500 bp, Heterodera glycines
  Genomic contig location: Contig_ID=SeqID_893; Location=3326..4825; Strand=-
  SCN-specific regions: Sequence locations=1-8,38-117,141-502,524 -652,696-709,731-785,814-868,893-1142,1189-1466,1493-1500
  Gene Ontology: Mol. function=general transcriptional repressor activity; Cellular component=nucleus; Biological process=regulation of protein activity, epigenetic
atggagcaacaacaacagagacagcagcagcacatggagcacatggttgcggctgccaagctgttgtccgccgcggcacagcaacagaaccagcagcagcatcaagcagtacaagaagcggcggcggcggcggcggcggcacgcatgccatccctggagggcttactgaaccagcaaatggtgctgtccacgctacacggtaaaaaatttttctgatcaattttctgaaagctgctgtggctgatcaaaattccccctgaacacatccatttgtatatcgcgtggtcttgatcaaattccctgatcacatttattgtatatcgtattggaaccaatatttttcgatcaactttttcgatcactgccaattttccgatcacccgtctgatcagtactaactaattcccctccaaatatttcagcccaattgccggcacatatgaggcggtccactccaaatctgttcagcgtccctgactatcagcagccgagcgcatttcgaccgccgcctcccgcagccgccgcggttgccaaccttttgcagtcgcagcaaccgcctcaacagtcgccctcctcagtcgccgcgaacgcgtcagcgaccgttgcggcggtcgcactgagcaacgcactgtcttccgttcagcaactgctccaacaccagcaacaacaacaccagcagcaacagcaacaacaacggcttgccgcgatggcagtcgctgccgccggcgccgctaccgccaacggactgttccggcaacactcatttggcggcatcggcttcaccgagcagcagcagcagcaacaacagcaacaactggtgcaactgcaacaaatcgctgctacacaaccgacgcctccaccactgccgcaacaacaacaacaacagcaacaagttgctcacaatcagcaacaaaatccgccaaaatgagatggatggcattagcacacagcacacaaaactcgttgttgttgttgttttgttgttttcagcagggcttttcctcttctatgtattaataagtgattttttgtatggttcatggtattttctgatcactgccttagtgatcgtttttttaatggatttcactgatcagagatcaaaattttctcggctttctttgatcatccactgatttgagttgatcattgatcattttctgtctgtttaattttctcaattttcttgtctcattgatcagttcatgatcaagtgatccagcctcctttttgatcagatttctgatcggattattatgactaatcaattaattaattcattagcttattcaattgttcaaattcaaattgtacagaattcattcatcattcttttctgaattgtcctctctttctttgtacagtacaaatgttctatgttattacattggccaaactacagtatacttctactctaataattaatatacgataattacatttctaattatacattgtttcctatcaataatttaattaattaattaataatggaataaa

SEQ ID NO: 63417 - DNA, 1673 bp, Heterodera glycines
  Genomic contig location: Contig_ID=SeqID_893; Location=1034..2706; Strand=+
  SCN-specific regions: Sequence locations=1-247,279-341,374-563,585 -628,659-716,738-1100,1122-1329,1362-1673
atgcggcaacgtgttccaacagtcggagcagttgcagaaccaccagaagctgatctgcgtgggcgcggacggcgtgttccggctggtccaaacccattaccaatgcaaccggtgcgcggaacgatttggcacacaggtgagaaggggagaaagccgtatggtgtggcacaatttagggctgggataaagccaattggccatggcacggcaaattttggggtgtgggattaatgcatcgatggacaagaaataaaattaaaaaattagtttttttaaatggaaaattggccaaatctttgagacagtggcactagagagggggcataaagcatatctaaaggagaaatagcataaaacataaaaggtgaagccttgctaaagggataaagcatgaaagggagtgcatcataaagcataatttaaatgggacaaaacataaaacagaattgaataaaaatagagggaacaaataggctatagcaaataagcacataaagcataggggggggggataaagcagtcattaattgaggaggcgggataaacgcataatgggttgagataccagcagagatttattcttggttctcgagtcaataaatttctctgggcttttctgtcgaggtcattaaagttttttgaagaaaaattgatacaattcttgagtcgagaaattctcaaattttttgggtaccattctctctcgttctcttgcaatcaattcttggtctccgttttctcgagtctctaggaaatttcaacactcccggcagccccagcaaacgaggggtttatccccgtgatccgttcgtggatggattggcggggatggcccctaaatcgggggcggggaccaaatgccatatcattactgtaattttttgtcataggccgagttccaagcacattgtcaagcggacttgcacaagttcaaacaggacaacagcagcagcggtgccaacaatgccgcctcggcacggggcacggaggttggcgcaactgagtgaacgcgaatgcgcgccaaatttggattggcaacaaacggacaaatttatacaacgaaagcctactgtagctgatcgatgatctccggcgagttaaagcatgcttcttcttcacagcacaaacacacaaacacacctactctcctctctgtacacatttaccacatttgtaatagtttctggaaaagctttaaattaccgcgtccaaaaaacaccacatttttggcattctcctcccccccactttttttggcataatgtcacacacaataattttgattttttttttcatttttttgtgttttcatctatttggtcagcaataggctttctctgttctctctctttctctttttgctatgtttgcgccccattgattttttttgatcgctttttcattgttttacacatcgccaaatttactcatatatttaaaacacattcgcgtgcagtattatttttgattaccatttatcacatttaaataaaaaaacaaaagttttaattgttttttttgctatttttcgagggctctctgatcattggcttttgatcaatatggtcatgcctcaactgatcgctcggttctttttggttctatcgatagatcagaagtggatcagttggtcatcgtttgatttcaattttcaaggacctgatcagagatga

SEQ ID NO: 63418 - DNA, 4150 bp, Heterodera glycines
  Genomic contig location: Contig_ID=SeqID_894; Location=556..4705; Strand=-
  SCN-specific regions: Sequence locations=1-165,187-319,343-623,645 -680,703-709,732-823,845-893,946-951,977-1308,1333-1934,1967 -2665,2699-2910,2997-3113,3198-3254,3299-3335,3357-3617,3639 -3774,3811-4095,4135-4150
  Gene Ontology: Mol. function=zinc ion binding; Cellular component =nucleus; Biological process=regulation of transcription, DNA -dependent
ctcagtcctaactacattccgaacggaacaatggacgccggtggtatgttttttttttgttgctttgccactacgccacacggaatgccaaaatcaaaccgccacttttggcacaggtccgccgagactgccgcccgtgtcgcccagctacccaacctcggacctgggctcctccccccgttcctccatctccgcctcgcattataccgcgctgggaatcaacgcgtccaactggcaagcgttccgcgacgcttacgtcgcgcgtcggcgcagcggcgagtgcgagctgttgtcggtggatgaagcggcgagtgccaaggcgggcggtgccggcggcggtggaggtttcttgacgccgcaccaactgttgtcaccggcaccattctcgcccttctccgactacggggtggcggatttgcatatgggcggcacttccgtcaccggcacgccgttctcgagcagatcgccaaatttgtcaccgtcgccagtgcaccgtgccggcaccaacctgcacttcaggtggtcatgcctttcaaagcatcagcgtttttcattttgtcgagtcaatttcagagtttagccgtttaaattccgtatccgagccttaaaaacgcatttggcacaaaaaagtctcaaaaaataaatatgaaactttccgatcacttgtcaacagattgctgattttttgaccattaaaacaagaattcagttttattttaattttttaaaatgagcaaaattttttatcgattttttgggtatctttttgatcgattttctgatcatttttgggttcgatttgaacaaagccaaaaaatttgcttatttgttagttttttaattatattttcaaaattgtattctcagtgagttagcaaacatactgagcctcgataaataaataataaaaaatataaaaataaaaaataaaaaatattattttttgccagaaattttttatttcaattatttctatttacagatttaccgaaaactttcggattttattgacacgaaaaatcggttactttactaattgccgatcaggaaaacttggcataaatccctagatattaagttatggattctatgggtgccggataatcgcattcatttactctcggatccattttttcagttttgatcaaatccgctcgcgcagctccctctccaatccgatcgccggcttctacgggttggacgcgtttggtgccggtagcgaatgccacctccgtattccgtctcagtcgcgtgtgcttgacgcggaggtgcgcgagcgctctctgtccgatggcgagacgctgcacagcggcggcggcggcggcggcagcgagcaccagcgactgctgcagtcgcaccagcatcagctggacgacgaggacgagcgcatggacaccagcgacgcgacctcgtcgtccccgctggtagtcgccatgaccgtgtcgcggccgtcgtcgtccaacggcacgcagcagcagttgcacgcgggccaaaagcggcgcttgttgcaccagcataaacgcgcggcaggggcggcaagcgcggaggggcggcactcgccagtgccgccagcgagcgtgtgcgtcttaaaacaacagtcgccgccggtgcacgccgcgtcgctgctcagcagccgaccgccggaaagcggcggtgatggagaagcgttggcgagtgccattgtcgccaacgcgcaagtcagccgacagccgaccattgaggagccgcccccgtctccgacgctggccgaactgttccagcccggcgatgtacgtacctgggtaatttgatcaactggttgtctaatgttttgaaataatgccaattctctcattatgtgatcaaagagttcacgagtgatcaaacgagtttcaagtgatcaaatagaggtccgagtgatcaaaaagatttttgagtgatcaattgtgtcaaaattgttcaaaaaagaatggatgatttattttttctccaattacccacgggcgattgacaattttaaggacatactcttggtagtgtaacaatgcccgtttccaatgaaggccttgtcttccaatgacgtatcagaatcattaattgtgaaaaaaatgccaaaagaggtgcaatcggggcttattaaatcaacatgggctggcaaagatcactgattgatcactgatcagaattccggaaataattggtatttccaagaacaaaaaaggccaaaacttatttgaattattgtgattaacatgatagctattaattgctgataaaaataacaaatccaaataaaatgccattgaaaaaggggattcgtggtttgcatccggcacaaaaacatacaaaaagcctatttccagttggacaaagaccgcaaacggcaagtggaggattggattcggcaacaaacagctgccctggaggcatttcggcactcgctaatcccgccgcagcaggaggccaacctgttgcaggcaagtggtgttgtatgtgtggggccagccatcttaatcccccgttatccgccaaatccaaataatttgggcaattcccccccccccccccttgcccataatcctccgtcttccgctctaaaatatcaccaatttttatttcttgaaaaaaaattaccaacacaattgaaaaaaatcgttcaaaaattttgaaattcaaaaaaaatcagatttttttcaataaaaataatttttaattttttcgcgcgcgcgagacggcgaaaaaatctgttgacacatgaacgtgaaatctcgaccgggatattcaatttatggcatttttaaggtgcccacaattgtgccgcaaaattcgctggaacatttgtggcccagcccatcggccacgaattcgtccgccgggcccatccgtccggcgaccatgtggcgtcgcagtcgctccgaatcggacgtctccgccgcgactgaagcggccgcggcgactgcgagcgccgaaagcggcggcggcggctgtggcgacgcgtcggcgacaacaccagcgactgggaccaaaatgcaccagcgacggacaagccaacagcacacggtaccgctgctcaaagtgccgctcaacgaggccacccacgtttgcgaacattgtggccaggtgattaatgctgcttaattagttaattggctcattaataaagccattaagtaaatgaaattaatgatacacaaacaattaatttgatcattaattaagcgaatatttttcttgaaacataaagatggcattggcactgtcttaaaattaatcacttatttattttatttattttttcaagaaaacaaaataaaaaattcttaggctgaagggggcgggctgtggactaaatactagatccaggaattttgaaaaagtcgggattgggatttggattggcatcaggccgagataggattaccgatacttaagtcctggttttgccgggattactggattcaattgatcaggatttgcatggttccagggcttctcaatgcatgatcggctcgccaaacacatcgccagccgtcaccgggaccgatcatcgtcaatgaacgacgagaacagtcgggtccacaaatgcacactttgcccaaagagttttggccgatcggacatgcttaccaggtgagggaatgaaattaatttttaagaaatggtaaattttttttatccgacacgccaaattttcaagaattgcaaaaatttctcaaatccgcccgggccattttggataaaaacacacacaatcattttttcttttttttttggctgattcagattgatcagcattttttgatttacaaacgatttttctaattaaaatttggtggctcttaaataataaatttggtttgagaaaccgaaaaagttcccgaaacaactgaacaccgagagttaatcccgagactgaaaagccgggaccaatatcagcaaaaattcgagacacttttctcaagttgtcaagggttcaacattctcgaccaccaataacccgagtaaagcccaattccgttggcacaggcacatgcgtctgcacaccggcattcggccctacgcgtgccaactgtgtggccaagtgttctcgcgcagcgaccatctgagcacgcatcagcgaacgcacacgggcgagaagccgtatcagtgtccgcagtgcaactattccgcg

SEQ ID NO: 63419 - DNA, 356 bp, Heterodera glycines
  Genomic contig location: Contig_ID=SeqID_894; Location=3342..3697; Strand=+
  SCN-specific regions: Sequence locations=1-32,57-356
atgctggtgcgactgcagcagtcgctggtgctcgctgccgccgccgccgccgccgctgtgcagcgtctcgccatcggacagagagcgctcgcgcacctccgcgtcaagcacacgcgactgagacggaatacggaggtggcattcgctaccggcaccaaacgcgtccaacccgtagaagccggcgatcggattggagagggagctgcgcgagcggatttgatcaaaactgaaaaaatggatccgagagtaaatgaatgcgattatccggcacccatagaatccataacttaatatctagggatttatgccaagttttcctgatcggcaattagtaaagtaaccgatttttcgtgtca

SEQ ID NO: 63420 - DNA, 105 bp, Heterodera glycines
  Genomic contig location: Contig_ID=SeqID_6963; Location=3060..3164; Strand=-
  SCN-specific regions: Sequence locations=1-24,46-105
atggtggaaatcgaagtgaatttggtgaacaacaccaacaacaactgcacaaatgatgttcttcgaaaataccgtgtggagatcactaattatgtgttctttttg

SEQ ID NO: 63421 - DNA, 1328 bp, Heterodera glycines
  Genomic contig location: Contig_ID=SeqID_6963; Location=4360..5687; Strand=-
  SCN-specific regions: Sequence locations=1-249,271-462,484-612,634 -1259,1281-1328
  Gene Ontology: Cellular component=synaptic junction; Biological process=protein targeting
atgaacgacccgctatacacccgacaacgatttgccctgattgtttcagttatgcagggacacacagaaattgctgcacttttggtagacacaattttcaggggcaaaaaatcaacaataataaatgttacccatttttagttggagaaaggcgcggacgtgcatcagaccacccttggccaagtgaacaacgtgaccatgggtgagaaatgcgttttgcggacacaattgtgctgttgcctaattcatctcttttttgccccattttcagccgttacgcccctgtggattgctgtcaatatgcgccagttggagctgtgcagtgtgctgatcgctcatggtgccaacgtggacttgggaagtgacgcctccttgacgccgctactgcttgcatgtgacaaaggcagcacagaaatcggtgaatcaatcgtccggaataattttctcatcagcactttttcaccattttcagtcacccttctcgtggagaatggcgccgacgtcaatctcggggacagcgaaggagcaacgccgataatgatcacttctcgtgccggaagggtgaaaaatgccaaacgtggaaaaatttagcatttttttcgctcagatcgatcttgcgagcttcttacttactcacggcgcaaacgttgaacagatcgattacagcggtgggttgcccgttattattgccctaattaatgtcttttttcaatttcagggactcgatttgctcttttggacgccgccgctcatggccatttggaggtgtgccgtttactggtggaagaatgggcagctgacgtcaatcagcaagcgaccgacggcatcaccgctttgatgggcgcgtgcatccacggacgcttggacattagtaagaagcaattggtacaaaagccgactcaattttttccccaattttcagccgtttttctcatcgaacatggcgcccacattgaccacgctgacatggacgggtacaacgcgttgatgtgggcagtgaagcaaaaaaagactgaagtggcgcgtcatttgctggcaatcggcgcgaacgcagaccaagtgggaattgacggtgggtgggcccaaaaagggcttaattgtgatgcttcaattgactgctctcccccgccccctttttaaggcaaaagagcgagggatttggcccgagaaagcagacgtgccgaattgattgacctttttcgcaccacagctaacaatgagcagcgggaggatggcaatgcgtaagaaaaaaaaaggaatttctgttcaaaaattatttttgatttttcaggcagcaggacgagcaaccgcagcagcagcagcagtaa

SEQ ID NO: 63422 - DNA, 79 bp, Heterodera glycines
  Genomic contig location: Contig_ID=SeqID_6963; Location=3913..3991; Strand=+
  SCN-specific regions: Sequence locations=1-21,51-79
ctgggactttttggctgggaaaaccgggaaaaaagccgggaatttcccggtcccggtcaaaactggtcaacacgggacc

SEQ ID NO: 63423 - DNA, 254 bp, Heterodera glycines
  Genomic contig location: Contig_ID=SeqID_33329; Location=295..548; Strand=+
  SCN-specific regions: Sequence locations=1-15,37-119,155-254
atgttaagtaatattaattttttattcgacaaaaatcaagcattcatgcttttttatattttgcaggtaaatgtatgcagctataaatttacaacgaatacaaaatatattctacagagaatataaaatgttaagtatatattaattttttattcgacaaaaatcaagcattcatgcttttttatattttgcaggtaaatgtatgcagctataaatttataacgaatacaaaatatattctacagagaatataa

SEQ ID NO: 63424 - DNA, 303 bp, Heterodera glycines
  Genomic contig location: Contig_ID=SeqID_33330; Location=567..869; Strand=+
  SCN-specific regions: Sequence locations=1-303
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcgaaaaataaaaggtctattgcgcaccgccctccctatca

SEQ ID NO: 63425 - DNA, 1151 bp, Heterodera glycines
  Genomic contig location: Contig_ID=SeqID_6964; Location=3125..4275; Strand=-
  SCN-specific regions: Sequence locations=1-418,448-1151
  Gene Ontology: Mol. function=thiol-disulfide exchange intermediate activity; Cellular component=cytoplasm; Biological process=signal transduction
atgcagtgcgatcgctccggtttttgacgaattatccaacaattatcttaatttgaaatttgttaaagtggatgtcgacaaatgcaaaggtgagagctaaagatgaccccttaaactaggcttgtaccagaaactaatttcatacatttttaaccataataacaatataatgcgaggaaattttatataaaaggactttttctttgaattcatgttataattcgaaagccttgaatatttatattacaccttaaattcattcagaaacaaagaacacatacggcgtcagtgcaatgccaacattcattgttctccttaatgggttagttgacaatgagtaaagtgaacagcagattggaattggtagtcctttcgttcgctgctttctattctaatggacttacctaattcgatttttgatgcttttccacataatggccggccgggtgctcaagtccccctccctaaattatgtaataattttcaaaaattagtccaattttcttgaaaaattcccctcttgctacgggcctgccggtcagtcctttattttggctaaatcattgcctttcttttcttcagtcaacgcgtggaccttttgcgtggtgccgacaaaactgcacttcagaatttggcccacaaatggtccaaaaattgtccaactcaaatggtctcaccgattcctggccaatgcgaattgtcaccgcttttcaacaaagtccaatgcgaatgtttgaacgaggttattccctatccattgttctctttgtgcattattatttgtattactttttaggacgattccaacaatttgaacaatttgctgaacggagttggtcccctgatcagtgattgtgacgagcaactgctgatcagcgtgtccttcatccaaccggtcaaagtgcactccgtccttttcaacggccccaaagagaaggcgccgaaaactgtgaaaatatttgcgaacatcaccaacactcttgggtttgaccaggcacagtccaccgagccaattcaggttcagaaaatgtgtcaaccgatgctaattgactaattattaaataatgattttcagtgcatcgacttgtccgaagaaaaactcgtcgcgctcaaatacgtcaagttccaggtattgtataaggtgaaataaa

SEQ ID NO: 63426 - DNA, 679 bp, Heterodera glycines
  Genomic contig location: Contig_ID=SeqID_6964; Location=5207..5885; Strand=-
  SCN-specific regions: Sequence locations=1-679
atggtccatgaaagtgtgacaaaagggttgatcaaaggcactcacaaatgcccagtccgtctatggcatttccacacagaaattccccctcccccgccagcccctctaaaacgatgtatgccaacggaacagcaacaaaaacaagggtaggccgtaccgaacacggccgagtcgccccctccatttgtatcatcgttggcattttcttcatgtgcattgggcggattcgcttgttgttgcccatcattatttgtactgctcgccaccgtcgacgcatcgacggaggcattgcattcactggttgaagctgctgagttggagttgttttgttggggggttggttttacaaacaaaatgcttttccagagacgcctctcactcccacccgaaaacttttcgacaatttgtttttcccggaatagaaaattggtcggatggaaaagacacgagcccatcagagggcgaacgtaccgaacttggccttgtcatgggcgcgttttgtgaatttgcagtagccgcattggccatgctcactgatgccaacgtaagagacaacggaacggcggcgaatattcaattgctgacgagccatttaaaaggaggcgaaaagggaggacggaggaagaaaatattatgaaacagaaaggaaagaaacattgagagataaatacgaaataaa

SEQ ID NO: 63427 - DNA, 435 bp, Heterodera glycines
  Genomic contig location: Contig_ID=SeqID_6964; Location=5294..5728; Strand=+
  SCN-specific regions: Sequence locations=1-435
atggctcgtcagcaattgaatattcgccgccgttccgttgtctcttacgttggcatcagtgagcatggccaatgcggctactgcaaattcacaaaacgcgcccatgacaaggccaagttcggtacgttcgccctctgatgggctcgtgtcttttccatccgaccaattttctattccgggaaaaacaaattgtcgaaaagttttcgggtgggagtgagaggcgtctctggaaaagcattttgtttgtaaaaccaaccccccaacaaaacaactccaactcagcagcttcaaccagtgaatgcaatgcctccgtcgatgcgtcgacggtggcgagcagtacaaataatgatgggcaacaacaagcgaatccgcccaatgcacatgaagaaaatgccaacgatgatacaaatggagggggcgactcggccgtgttcg

SEQ ID NO: 63428 - DNA, 155 bp, Heterodera glycines
  Genomic contig location: Contig_ID=SeqID_6965; Location=644..798; Strand=-
  SCN-specific regions: Sequence locations=1-155
ttgcataacgccatgcgtctttccgcactgctcaacgttcatccgtcgctttgccagtgaaaggacgagaatgggatgagtcagacccatccgactttaattgattctcaatttgacttaaatgatctgtttatcttttactgttttgttgtttt

SEQ ID NO: 63429 - DNA, 533 bp, Heterodera glycines
  Genomic contig location: Contig_ID=SeqID_33336; Location=195..727; Strand=-
  SCN-specific regions: Sequence locations=1-64,86-315,337-533
atggccaatgcattggcatccgaactcattgaacgcgtcgtttctcgtcaattccatttgtgtgccaacaaaattttttcccaacggatggcactcgaaatggcagtttctcagtcggagtcacttcttgaccaaattgtgcccaaactgctacactcaactgtccaccgaattcgagccaacaaagcccgtcatataaatgagaaaatgcacaacattcgtgagaatttgcaccgcgcgtggttgagacaattcgtcgaccattggcttgcggtggtccgacggaatcgaattttgcggaacatcactttcctgacaaatcaaaatggtatacctaattggtcaaattatggatgcaaagaaaggcactttcaggaaatggcactctcacactttcaccatcacaacctttgttcaggccgaacgcgaagaaaatgacgccggaaagaatgaaacaaatggcaacgaagaaaatgcaacaaatggaaaatgagaggaagaaaaggcgagagcaaaaagcaatgcaaatttag

SEQ ID NO: 63430 - DNA, 91 bp, Heterodera glycines
  Genomic contig location: Contig_ID=SeqID_33339; Location=8..98; Strand=-
  SCN-specific regions: Sequence locations=1-91
atgaagcgtcccggtcttaaattgcttcggaatcatccgaacagcccaatccccggcaaaaaactgcctgaagcagtcgagcacccgcagg

SEQ ID NO: 63431 - DNA, 590 bp, Heterodera glycines
  Genomic contig location: Contig_ID=SeqID_6966; Location=183..772; Strand=+
  SCN-specific regions: Sequence locations=1-590
atgaaggaaaatggaaaacattgtgatgatgtgaaggattccactaacatgacggccgactatgaaaagatgttcgctaaaaggtatttttaaagccgtgccaggttttgtcggttctagtgcagaatacgcgtcccatggacttttacgcgtcccataattttttatgcgccccatcaaatttttatgcgtcccaaggttttttacgcgtcccattgaattttcacgcgtcccatgaacttcatcaattaggattttttttttagaattaaccaacttttttatctttggtttccatccgaatagcccatgcttggcaaagcgtgtccagacatttgcgcctatgtccaaaatcggattcaaacaaatttttactaaaattaagaaatcgtagtcttctaattattaggaacattaattttgctgtttgaataattgatgtgatgacttttttaagaatatctaactatcaaattatcagacccccaatcgctttaggctatcagggattaaaaaaacttgttgaacccgacataggcgcgaatgtctgggcaattgtgaagatcattggtcccgaaatttttaattaa

SEQ ID NO: 63432 - DNA, 1674 bp, Heterodera glycines
  Genomic contig location: Contig_ID=SeqID_6967; Location=590..2263; Strand=+
  SCN-specific regions: Sequence locations=1-94,116-206,228-554,581 -914,936-1378,1400-1478,1501-1674
atggacgattttatgaggcacagcgattttcaagaggaggacggggacgtttttacaacagaagcagtggaaattttcgtgatgagaattttggaagacgaagagggggaagttataatcaaaggttttaaattgttggactttttgtttaattatatataatcatggcaaataaatgtctttttgatcccatcatagaagtaaaaagttcttttattattttatgatttttcattattacaaataacttttgtttgcatttttacaatggaaaaactgagcaacgatgagacgcaaatatatgacagacagatacgattgtggggaatggaagctcagaacaggtcttgaaagggatgtgtccagtcaaagaaactcgaggatttgttatcatgactaaacatagttgcaaattatccttcatctaaaaagggaatcgtgaactgaaaatggaaaatagagtaaaaatgggcggccatcggacactaaaattccagttttaaggtcctgtaactctgaaatgttgctatcggcagctaaaattaggaattcacaatacaaaagactgctttatatttttcgacttgcagttcgcgagcttccactgtaagaaatgacccatgagtttttgtatttaaaggcttcggaattcatccgttctgttggttggattgagtggtcttggcgcagaaattgcaaaaaacctgatgttatctggcttaaaatctttgacaattatggacaacaaagaggtactaatcggttgaaaactttccttttcattcattcaggtcgttgaaggcgattatgcatctaattttttgcttgttcgtgccattaaaacgaacgtatgtttttactttctcacatttgattgccttttgcacatagatttgttttagcgtgctgaagcttcagctgaaaatttgaaattattaaatccgatggttgaattaatggtgctctccgattctgtcgttggaatgccgtcgaacttcttttccaaatttgatttggttattgtcgttgaccaggattatgacacaaccaatttaattaacaagaaatgccgtcaaaacaaaattcggttgtttggttgctaattttttaacggacttttccgttttaatttggctgtttcctttaggtttgaagctgccagtgtcttcggttgggttggctatgctttttttgatttcaataatcacacctttttgatgtaaatcaagaaaagttgccgtgtagagcaaatacttttcttttttcagtccaaaaccgaaagagaaggaaacaattattgaaagtattttggatggggacgaagaagacggggaaactgggggaggaagagggacctgtggaatgccaaaaaagatgaaaatgaatggcattgaagaaggacgcggacattgcggcgatagccatcaaacactgaccatcggagacgaagaagacagcaaagtcaagaaggtgaatttacagagagcaaatgtagaaatgctctctattaatgcgaaattcctttcatccctttcacttcattttccgataataaaaagttcctcttccagactattccatttccgagctttgaacacacttttgccattgaactcgggacgaaacgcttccgacgcaaatttaacattccaagcacttattttgttgtgcggg

SEQ ID NO: 63433 - DNA, 1880 bp, Heterodera glycines
  Genomic contig location: Contig_ID=SeqID_6968; Location=1..1880; Strand=-
  SCN-specific regions: Sequence locations=1-151,173-855,877-1180,1202 -1880
aagggtgcgtcgcctgccaatatttggccatttccgacccaacgtcgaattcgcgcgtaggctgaaagacacgtcgaacgattaccggtccttacctcttggcatctttcatatcgctgttttgcagaccttacttcacttattggatctcaactgtacatttactcatcactttttttatgctcattttccatggcattggcactgactattcaaatgggctcaatgttattgagagaagcggagacgttatgggctcttcgctctccccgttacatattgtcgtatgggaacaaaacaatatttggatgggtccaagatttgtgagtcaaatttacatggtttggttttacaattgctatttttcataaatataaaggccgatctcgtccataccggtgccaaatttactccgtgcatgagaagggacgataaaatttatgaacaaattactgaagaacgaaagactgaagccgaaagcaccggtgagtaatatttccttcaattcgatacacttaatttcgaaattggtcatttcgagcggtgcaccccaaaacgtcgtcggccgaaacgtcgtcggaagactttttgaaccataactttgttcactgtcaatcaaattaagaattgttggtgttgttcgatagctctatgtgtttattattaatttgcaaaatctcaaaaattttcgttaagtttcaaaaaagttatggccagaaggaactcaaaaacccagtaattcgaactttttttgctctgatttttttgtgcataaataaaaatttttgaaaatttgcaggctaatagcatttttcgaatgctttcgaataataccaagaatgtttagtttggttgagaaagaaaaaagttatggttgaaaaattcgttcgacgacgtttcggctgacgacgttttgtcctactccgcatttcgaggtgcgtccttttgatactcggtgaaagtgtctcgtttcgagagtcatatgttaaacagcaatttattaggttataggccacaaaacataaagaaaatttttcttttttttcattcggaccacaatattcttgggttaatttggtatttataacgggtgcaccccaaaatcacgccgccaaataacgcctccgaacttgaaacgacatttagcctcttcaattctttattgaacttatcgttaaggctgttgtgttgggctcagtggttgtttccagacatcagagtgttcggtacgtaaacttgctaattgattgtctcgatttttgtccagaaacaatttgcgactctcttgaaatggactaacggcacttttcccgaaatgaattactctcgtgttgtttgtggccaggatccccgatactgtgctcgcccgcgttcagtacatccttatgtgtggggactgaacatttcgaattggccggtaaaaaatcttaaccaatcaattgaagatgaaattgattcaacaaaagatttgcgaaaagcattctccatcaatacccaaatccgaaaagcatatgcactgtacggtcacaggacggccttgctgcattcaaatgcacggacaatgtcggataacgtccagggagtactgcgactttgtccgtgggcatttccacccgaatgcgaccctttgttctcaggttttgtattgtttgttaattatttacttgcaaacttcagatttcctgtctgaatgaggtttgcggaatgactccatttctgaggcgtgacattcccgaccaactctaccgtcttttcaccccactctttattcatgctgggttggtgctgtccacgcttgttgagactattaatttgacagttatttcaggataatccgatgcgatagtcgctcacgctttacctgaccataatgtgccgat

SEQ ID NO: 63434 - DNA, 915 bp, Heterodera glycines
  Genomic contig location: Contig_ID=SeqID_33342; Location=511..1425; Strand=-
  SCN-specific regions: Sequence locations=1-240,264-410,432-789,881-915
atggaggatttaggcacaaatttcatccgatggccacatatttacgccaataaatttcttcccgagtttgacttaggcgcaaccgtttgttggtaagaaagtgtcaagaacgaagccgacatcgtgtttaaagcccgggatttcttcttttgaaatttttggaaatttttttttacaaaaattcgcgggtcttttttgtggaaattatgctatttcacattttccaataaattattgtcgaaaaaaattattttatattttttgcgattttcttacatacatttttcaaccatccctattaactaattaggtatgagtctctttacaatcgtacacaattcgacagccgagaggagcaactggcaatgttggacaaagaattctatttgcagctgcctaatgtaggctaattgtgacttttttaaatttctaatttaattgattttacctaatagtgatttcgaatttttaaaatatttgaagttagctaacagttattttgaattttcatatttgattaaatttaaaaaaaacagtgtcttcgagttttctaaactgattgcatttagcttaaaaggatttagaaatgcaaatttaatttaatttagctaacagtgacttagaattttcagatttgattgaatttaaaacaaatttacaggttcgcttccaaaaattcaagaaacagttgttattatcaaaaaaccaatcaaatggactgactaatttgccatcccataaagaattgatgcagttcgaatgtgtgattgaaaaaaacttagaatatccattaaatgaaaaatatcattaagatttttaattataaaacttatttattttgtattcataataattaaaaaattttaaattcaatttaattcaatctaatcatttttattctatacataaaataaa

SEQ ID NO: 63435 - DNA, 57 bp, Heterodera glycines
  Genomic contig location: Contig_ID=SeqID_33343; Location=388..444; Strand=-
  SCN-specific regions: Sequence locations=1-21,56-57
gtcccggttcccggtcccggattttgaaaagctcaggtcccggtcccggtagggcga

SEQ ID NO: 63436 - DNA, 572 bp, Heterodera glycines
  Genomic contig location: Contig_ID=SeqID_33345; Location=95..666; Strand=+
  SCN-specific regions: Sequence locations=1-4,27-170,192-572
agtttgtattttaagaatgattatatattaaaatggatcaacgttcaaaaaattaagcactccttcctcacattgatcaccgcgttgctgtacggcagtgacactttgtccgccaaagtgatcattctgtccgactcaaccacggcgtcgagctcctcgtgcagcttctgctgcacccgtggggctgtggatcaagtgaatgatgccccagttcagcgtgtccgtggttgtctcctggtcggaaaaagaagctattatggtcaaatatgtttttgtgatgacaacgttctgatcaccaccaataaacacagctatagtaaaaacattcattccatcgaatccaatttaattattactacgctttacaataattatttggcttaattttcattgaattcatttatttactttttcaccatttctcagttttaatcaatcttccttcataatttgatgagggatttacataaaatttgttactgacctgtcccgctatccaaaagcccaacaaatgcgcgtacgaattaactctggctaaaacagacgtaatttgtcaaattttgagcataaaa

SEQ ID NO: 63437 - DNA, 489 bp, Heterodera glycines
  Genomic contig location: Contig_ID=SeqID_33346; Location=484..972; Strand=+
  SCN-specific regions: Sequence locations=1-3,43-136,197-282,387-435
atgatttatttaaaaataaattttttatttacttttttatttgtcaatttttgttttgtcattgccatggataacgacgaactcacaaaaatagtgaaatcttcgaacaaagcgacaaagaataaacaaaaagtggtaaaaaaaattaacaaaaatttttgaaaatttaattttttaaattaaattttattaattagacaacacctagtcaatcaaatgacagtgattcttccaaaagatcatcgcagaacattgatcaactgacgacggctatttgtcttgaatttttttattaaaatattaattataaaaacaaaccgaaaaatgataaatttaattaaaaaataaataaatttaggaaaaagagaataattaaaataaaattattctcttaaagtaatttccagaaccatgtgatcctttaagagtaccatgaaaaaatttttttttaagattgttaaaataataattttataaaaatataattta

SEQ ID NO: 63438 - DNA, 573 bp, Heterodera glycines
  Genomic contig location: Contig_ID=SeqID_33349; Location=95..667; Strand=-
  SCN-specific regions: Sequence locations=1-48,70-456,478-573
aagcaaagcacgaatgaattaaagaggcgaaagaattcacagtatcgtttctaatagggaaatattgacaggatattccgctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaaaatacaaataattcaattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgat

SEQ ID NO: 63439 - DNA, 570 bp, Heterodera glycines
  Genomic contig location: Contig_ID=SeqID_33350; Location=39..608; Strand=-
  SCN-specific regions: Sequence locations=1-138,226-570
atggccgccggggtgaagacgataatcggaggggcggtggaagcagtgatcgccacaataatgaggacgaccaaagtggaagtgattcgtgtgaagcttgaggaggaccaatggatgggccaaaacggactaaaaggagaagaggaggaggaaaaggaaaagggagagcagaaaggagtgggaggaagggaaggggaaaaggaggaggaaaaggaagaggaagagcaattagaagagcagaaaggagtgagaggaaaggaagaggaagagcaattagaagagcagaaaggagtcggaggaagggaagggaccgaaatgcataaaaatggcaaaaaagagcagcaacagcagcaaaaagagcaaatggaacccaagcagtacctggcggtgtacacagcacaaacatgcatcaaaagagcagcaggtggacggattagcaattgcttaaacaatttattcaacaaaagccaaccacaatttaagagaaaggcggaaaatggcaaaaggaacaaaacggaacagcaaaagcgggggatgaagacgaattgtcaatttacagcgacgcattag

SEQ ID NO: 63440 - DNA, 601 bp, Heterodera glycines
  Genomic contig location: Contig_ID=SeqID_6971; Location=4277..4877; Strand=+
  SCN-specific regions: Sequence locations=1-228,250-447,470-565,593-601
atgcgcacccgaaagcttgaagaaggtgcagccgcgataacggacgagcagatggaaacgatgcgccaacaaatggagcaaaaattccgtcaaaatctgctggaagccgagcagcggattgatcacaaatgggcgacgatgctgaacaaagaacaacaaaggactcagcgaattgcggcacaaagtgcgacggtgattggccaactgatgagtaagcgagtgacagagaggggagaagaaaaggaaaatacgagagagacagaggaaaaaagttgataataagtgatcggtgcaattggtgcctagagaaaggccaagtgttattcggagttaggggatgcggacatgtgtttagctgtccaccatgctctattgcgataatggccgttgaccagccaaaatgtctgatttgtttccataaattaactgatttggaatacttaggatcataaatgtgtacaggatatttgatctggatcctaagtatttacaatatttgtactcctataattgtactcctgcagtaatacctcatccttaacacttttttcattgcctacagtaatcgttaatgttttcatttttctaatttcattaacca

SEQ ID NO: 63441 - DNA, 631 bp, Heterodera glycines
  Genomic contig location: Contig_ID=SeqID_6971; Location=5094..5724; Strand=-
  SCN-specific regions: Sequence locations=1-172,222-631
attatcaagggcaagaggtttgttgtttatcaacgaaaagcgatgcccttaagctgacgcacttccacgacattgactctaccatggactctacgctccatgcaattgtgggccgaccggtggcgccatttctacaacaacggcttaatgctcgcccactttttcatcaatgtaataaaaaatttttctaaatttaaattttttgaaatttttattaattagtgcgtcagaagcagcaaaatggtccgcaagtggtcgagcaacaattgccatttgtgttctcatcttctgtcgacttcacaccagcgcaaagggcaaaggtggattggtctttctcatttctctctctcacactctgtctctctcacatttcataaagtctgagtgttgatgggcaggccttccctcgtgttggccccccttcaatgcttatttcggagctgtgaaaagcggtaggcaggccttcccttgtgttggtccccctatagttttttgcttctcatttctctctctctctctcacacatttcctcattatttgtgttgataagcctaaccaaaaatatttaaaaattcaggcaaatgcattgtttgaagcgttcaaagtgcgagaaggactgaatgaagattag

SEQ ID NO: 63442 - DNA, 57 bp, Heterodera glycines
  Genomic contig location: Contig_ID=SeqID_33355; Location=14..70; Strand=+
  SCN-specific regions: Sequence locations=1-57
gctatagtggaagctactcccgaaggattcggtctccccataaatctgggcgcatcg

SEQ ID NO: 63443 - DNA, 365 bp, Heterodera glycines
  Genomic contig location: Contig_ID=SeqID_6972; Location=49..413; Strand=-
  SCN-specific regions: Sequence locations=1-27,49-215,237-365
atgtacaaaaaagcggaagaaagggcaaaaagtgccaataaaataaatgctgataagtatttgctaattatcaattctaaattcgatgatcaattaacatgggtgagacttaaccttcaatgaaaattaaataaatcaaaaatttagactgaagatgctctgttttcggaatttgtcaaaggattagcgacaaattcagagacattttttaaaatggcagaagaatattcaaattatttatgtcgaaggaaagaggaagggagtatttatggcaatgatagacccatgatctctcatgggttatacgaaattgagaaaattaaaaagcatttggcacaaaaatatgaggcccatcttggcgttat

SEQ ID NO: 63444 - DNA, 556 bp, Heterodera glycines
  Genomic contig location: Contig_ID=SeqID_6972; Location=467..1022; Strand=-
  SCN-specific regions: Sequence locations=1-12,34-191,214-216,247 -446,468-556
atgctttgttatatttctgcattttcctttattattattgctcagcattttttagttccaatttcaaatgcaaatccatcggtgagttaattaatttggggaattaattttactattgcattttaattaggttgagaacaaaatgctaattgcgtttgtgagaaatgatcagaaaatgcaaatcagtgaatattcaatgcaaaaatatgatgcacaccttggcattttttattttatgagaatgaattggaaatgtgacaaaatagcagggaaatttgaagaatatgaactgacagaatgccaaaaatatcgaaaatatttggacattttgtacgaatatttgtgtagagaatacgtcggaattcacacagtaaagccaaaatttgtgtttaaacacaaaattgaaattaatggggcaataatttatgcggtgaattgtttggccaaaatttcgcaattttattttaattcatctctgagttcttttttgaattataaattaaacaactttttcacttataattcggaaccaaaattgttgaatgagaacgattga

SEQ ID NO: 63445 - DNA, 1320 bp, Heterodera glycines
  Genomic contig location: Contig_ID=SeqID_6972; Location=3372..4691; Strand=-
  SCN-specific regions: Sequence locations=1-299,324-888,911-1089,1111 -1217,1239-1320
atgctcggccttctgtttgcgctggtggaggtgtcgctgtttgctttgctcgtctctccgtacctttccaagctgcccaattccaccgttgcccttctcgaccatgccattcactttaaccccgggggcttggctcagatggaacaccgattcggttgcatctttgaccagaatctttacgagactttcaaacgtcaaataaatccgcgggtgcgtccgtcgctctgtccttttgaattggctgaacttgcagaacacctgcgacccgttccttctgtcctccttcgtgccgcggcctctcctcttcgtcttcgtcctcctccgacttctacccatttctgttttctctttttgaatactcgcacaattcgtcgacaaaaacaacttttggcgtcaaagagaatgtgccaatctttccctgttaccttgcggcacacaaattccaccaaagcctccgccgttgggttacatggatcacagaagaaagtgggcacaaaatgatcgaaatttgtttggctaattaacttggtaccattttataacaatgccgcctttttcgccgtctccggcgccatcgcaaattatgcgcagtgccaaaatgccagcgcgacaaatttgggcggcggaaggagttcacgcagctcagaaatttccattaacaaattcggtggaaaatttggcgacggccgacccaatgaagcggcaaatgtcattttcccatctgtaggagaattaattgaccagatggacagcaaattaattcactaattcaggcgcagtacgcgcacaacgagcagttttgtatccgaagtttaagccaatggcacaccaaagaaacgtcttttgctttttggctgttccatcaacatttttgagcaccattctgctaaaactaattaattaattaattcccctcttttacattccaaatcttttctttattctttaatgttaatttttgtctctgctgatcattggtcaatttaaattcaattagccattttaaaagtgcgttttcttccccctcctcctccaattatttttgcccattttttcatttcatttttgtttgtttcgtcattttatttatgagattaaacatttgtacaaaatggcaaaaatgcacaaaaaatcattcttttttctcttcacttttcttttatttatttttatcactcggaaagcatcactaatttgttggcatcattaagcccttcctcagaatgttcggtgccattccatgggctgtgtttttatgcttttgaagtatttttatttgtgttttttaaatacaatttcgtagtaatatttaaaaataaa

SEQ ID NO: 63446 - DNA, 288 bp, Heterodera glycines
  Genomic contig location: Contig_ID=SeqID_33363; Location=400..687; Strand=+
  SCN-specific regions: Sequence locations=1-16,38-132,154-288
atgccttttttcttcccctccttctccttctcattccatcatattctgaattttgtgacaaaaatcaattgtaaaacagcaaactgtgctaattacagcaaaataaatgaacagacggtaatgaatttatcgaaaaattataaattattttatccaatttttttcatgtttcagttggatttgcaacgacgtgtggatggacattgcaaattgacaatttggagagatataacaattcacaaggacgaaggaactagaaaaattcaaaaaaaatttgttttatcatga

SEQ ID NO: 63447 - DNA, 552 bp, Heterodera glycines
  Genomic contig location: Contig_ID=SeqID_33365; Location=182..733; Strand=+
  SCN-specific regions: Sequence locations=1-23,131-205,259-552
atggaagaaggatcggaagaaggtataaaattaaattttttttttaattaataaatttaaaaaaatattttttaatcccttttttaaaatggtttaagtttataaatattattttttgtttttttataaagcattcatcgctcatttttgacaagaaataaaaatagtggtgccacttttaccgctcttggaattttgataattgaatatttattaatttatttaatttttgttttttttaattttaaaaattaaaatcggtacttttggaagaatggcgatgccaattaggattaatagattttgttttccaattctggctaatttgaaatcaattagattcaaaaatttcaacggatctacctatctatttttgatgctaataattaattagcccataatttaattgctgcttttttaggaagcactcatacagtgattaatcggcacgaacgaatcagtgaagatgaacacagaacccgatcactttacggcgcatttgcacccactgatcaagaagatgtacatttaaaaatgccaaaaatagtctaa

SEQ ID NO: 63448 - DNA, 94 bp, Heterodera glycines
  Genomic contig location: Contig_ID=SeqID_33366; Location=457..550; Strand=+
  SCN-specific regions: Sequence locations=1-94
aattctatttttccaacccatttcaaacctttttacatcgattctgaccgtttttaagcatttttgagtttggggcctatgatcaatatttacc

SEQ ID NO: 63449 - DNA, 842 bp, Heterodera glycines
  misc_feature (802)..(802): n is a, c, g, or t
  misc_feature (804)..(804): n is a, c, g, or t
  Genomic contig location: Contig_ID=SeqID_33367; Location=46..887; Strand=+
  SCN-specific regions: Sequence locations=1-63,123-145,180-392,435 -438,504-504,528-842
atggcggacaaaagtgcggacaacaacgacaaaactattaccggcacaaagtggaggttggagtaaattatgaaaaatttaataatttaaaaaaatgggcaaaaatgatttaaaaaattactttgccacccttcgtcagaagcgcaaaaatttatttttattttttttttgaaataatactttttcatgcatcctcaggaaacttatattcggaatactgctgagataatctcgctagcaaaatttgttttttcttaagggaccgtttcaatgaacacgcaatcattttaagtggatttaaaaatgttaattgtttttcatcttattttttagtaagacatctgtggcaccaaatttggcactggaacacgaattgcaaatggaggacgaaaatgtggtcaaaaaaggcaatatgacctgcagcaggtggaggacgggaattaattaatcttttttatatatacattaaatttattcaattattaattaattcatatttttaagtttttggggtttaattcctcattaagaaattaataaattttcactacttttaacactttaattgtctttcaatttttttagctcgtcatcatctgcacgtaaattgacattgagaaaggaattgacgagtgccaacgatgataatttccggtgagtttttaaacagaaggaaataattttacaaaaattaattccaacttaattttttccataaaaaattacttattagtacctttcatttaattggtttaattaagcgagtcgtccgcttcacaaaagttcgtttttgcgcagagtngnggaggattcaaagcgcgatgaccgagatactgatctga

SEQ ID NO: 63450 - DNA, 54 bp, Heterodera glycines; identical to SEQ ID NO: 53113
  Genomic contig location: Contig_ID=SeqID_33371; Location=188..241; Strand=-
  SCN-specific regions: Sequence locations=1-54

SEQ ID NO: 63451 - DNA, 1468 bp, Heterodera glycines
  Genomic contig location: Contig_ID=SeqID_6973; Location=10..1477; Strand=-
  SCN-specific regions: Sequence locations=1-108,130-792,814-986,1013 -1119,1141-1319,1341-1370,1405-1468
atgtggaatatcatgcagtcaacaactgctaccgctacattccagtctaaatccgcatcgagaagaagacgctcaacgcattcctcgatccagagcttcacatcctcacagcgtcatcaccattcgcaggaaacaggcgaagggctattcgcgcatttggacgaatggctgcgtttggatcaatacaagtcgaaggagaaggagcacaaaacggcacgagcgctcacactcggagccctcccgagcggagtgattggcctcaccgaagaatggttcatggacaaacttcggctgctcgtctcctactggactacggcatgctgcatttacgtcacattcatttttgggcgcgatgtcctgatacccttggtatgggtctacttaatggggcccgtcatcgttaccgtccgcaatttggtgacgggaaatcagtggacgcagcggaacagagctactcgaggcacacggcgagcaccggcaatttcaagaattgaagcaattgagctggtaccgcctccaatgccccaggagatgagagcgaatgaaacggcaagttcgcaacaagaggaccccgagccgtccccgctggtgatggatctgaaacgacaaatggtcgcgtcgcgttccgctcaaaacgacgttttcaaagtcgtgggaatgtcgcgactgaacgtcagccgcgaatgtccgtcgagcggacaaatggggaggacggggaggaatgaacgaagtagcgaacgaggagtgattgatggatgaaatgatgagaaaattagggcaaacgggaaatgatgaaggaaagaaaggggtgaagggaggggtcggctgacggcgggcacgtgaattaggggaaagaaagcgataaaaagcggatgtggcgccttacccgcgtgaaggtcgcccgaggcagcgcaaaaacgccgatcggaccatcggcggagcgacggcctcctctttatatttctcgcacatttattgtaagtgtagggtttaattacccaagtttgagtttgagataaatttgcggagtatttttggtgcgaatttttgggcggcaaattgggcaattggcgacggctaaatcggaacaaacggcgcagaccctcccccaactgcgtcaattaattaatttaaattgaaggctttccggcaacattatgcgccacattattattgtaaagcatagatggaaaatgggcagaagtcgacccccctcaccttcgcccgcaaaatgccccaaaataggtggggggggggtcggaagcggagaaaaaggaaaattgaacaaactttcttagcttaattcattaatagcaaaagttttttaattgtccccaaattgtaaaaaaaattaatatttttgggctagcttttttgaaaatttttaaaatatcaagccttagggaataatttctgttttattgtgattaccagggagggggccacatatgcatttacatgcaataaa

SEQ ID NO: 63452 - DNA, 167 bp, Heterodera glycines
  Genomic contig location: Contig_ID=SeqID_6973; Location=653..819; Strand=+
  SCN-specific regions: Sequence locations=1-12,34-167
ccgacccctcccttcacccctttctttccttcatcatttcccgtttgccctaattttctcatcatttcatccatcaatcactcctcgttcgctacttcgttcattcctccccgtcctccccatttgtccgctcgacggacattcgcggctgacgttcagtcgcgaca

SEQ ID NO: 63453 - DNA, 1520 bp, Heterodera glycines
  Genomic contig location: Contig_ID=SeqID_6975; Location=135..1654; Strand=+
  SCN-specific regions: Sequence locations=1-46,72-328,350-642,664 -708,730-776,809-829,853-1139,1161-1520
atggcagatagttagttatgcacacagtcaaacgaaatctttttgaaaattttgtgaatttttaaaaacttgccccacaaacccgcgcctaaactaaccacgacgacctactttttgcaattaactgaatttaaacttgaaaatttttttaaaaatttcccatcaaagaaaatacataaaaaatacaatgccaaaataggtttttctcagtcgaaacaaaagactgaggagcaactacaaaatagtatgttcgtagcgctaataaaatatgaattttctcgattttattgatggggtttcttgaattgctaattattggagcctaatgcagggttctttctttctttgtactccaaaagcaaaccccgcctccccccccccccctaatttaagtattaatattaaaaacaaggtgcaatctatatttaaataaaaagatttctgctatttttggcttaactcgcaattttttatgtattttttaaagattttttggccaaataaattacaaaacacaacctttttgtaattttgcccgttggcaccgccggatattatcaatatgctaaagtcggtttttaaatgttggctaaccgtgaaattcactccattaattaagaaaagttttttgacaaacaaaacttctcttataaaaattttcttcgattattaatccacgtaaaaaaaactcaaattaataaatattagctaaattcacaattttggcaccaaaagagttttacatttttttcgttagaaatccgctcacctcgtggattaatataaaatatcttaataaaattttaaagccaacgataattttttaacgacaatttactcaaaaacattgcaacaactttcgcacaaaaatgatcacaccaaaagatacgagcatttagcccaatgttttggcacaatttcttttttctatggacaaatttataaggcactaattgtggcacaaaattggctaaaacccagtgtgaaatttgaccaaaaattgacggaactcaaacagcaatgtgatgatgccacaaacgaattggcaaaaaccaaccccaaattagctgaaaataattccatcaaaaatctgctgctggacaatgatggcattaaaaatttgacaaaaacttttcacgacattaaaagcattgtaaattcgccaaagagtaaaagtgctaaaaatagattgacagaagaaaatggcggcgcaatagaaatgattgaatttgatgatgatttaaaaaatatgggaaaccaaagaggatgacatcactctcaaacggacactgacgatttcatgggaaattgggtgtggattgactgatgagtaggggcacagatttgtatggatttccatatttttttgcacacttatttcggcctaaaaacacgtaaatagtatttttagcttggtttgatgcttctaggatgactttttattgccatatttcaggtttttgtccatgtttccctattttcatacatattttagcattttcattaaaaaagtcgaaaaa

SEQ ID NO: 63454 - DNA, 463 bp, Heterodera glycines
  Genomic contig location: Contig_ID=SeqID_33372; Location=701..1163; Strand=+
  SCN-specific regions: Sequence locations=1-89,121-199,221-354,376-463
atgaacacgattaattcacgaaagagagatgcgaaaacggtgtttatagcaattaaggtttgcaaaaaaacaacaacatattttattggaaatataatttaaaataattaaatttaatttgctctcatttttcatttcaactttttagaatttgaacaacaataatttggagaaactcattgaggtgatttccattcagtttatttatatttttttaaatgatgagtaggacgtgaattttaggttttaactattttttttttgctcaattgatttgaagaaaggagctcaaaaaacgcatttccgcataaaaatttttcgattctgatgtcattatcggtcactagaaatcactattttgggattttgtcactaaaatagtgaaaattcactattttggagttttgtcactattttttcactatttcgacatttttttggaaaattctttaacaaaaatgca

SEQ ID NO: 63455 - DNA, 117 bp, Heterodera glycines
  Genomic contig location: Contig_ID=SeqID_33375; Location=1008..1124; Strand=-
  SCN-specific regions: Sequence locations=1-117
caacaaaatttgaataacgggcgcgaagcgcccgtccaaggccaacaaatttaaaaacgggcgcgaagcgcccgtcttgagcctcgatgtggactaaaaacccctactaatttttta

SEQ ID NO: 63456 - DNA, 434 bp, Heterodera glycines
  Genomic contig location: Contig_ID=SeqID_33376; Location=485..918; Strand=-
  SCN-specific regions: Sequence locations=1-434
atgcataaaattaaatccaaatttaaatggatgcgcgagtgggtcaaaagtgagcttcattgccgaaaatcttgacaaatttttgatttgcaattgcaaaaacaactgacaaaatttatgatgaataaaacttttaaattaatttgcacccctaattttcaagtttttttttgtccatatttggtgcatattttacgactttatttgcatatttatgcgcatattttggccacttttcatgcatattttttgcagccctggcaattactattggttgggtcgcatggtgatgacatttgcgttcacaatctaagcgacacttacgacgcagaattaaatggccacaaaaagccaattttttttctgcatttccaagtgcaatatgataagaaatagtgcaaaaagttaagaaaagccagggagagaaaaataaa

SEQ ID NO: 63457 - DNA, 519 bp, Heterodera glycines
  Genomic contig location: Contig_ID=SeqID_33377; Location=196..714; Strand=+
  SCN-specific regions: Sequence locations=1-97,128-250,279-519
gtccgtctttcgccgtctccgccgccccaaaaaaagccaacgaaagtggccaggcaattaaccttcgccagctcagatcgcacgcggacatcgaagtggatgacgaggaggaggagaagaagaacagacggcccgacgggagaagacgcaaagtgccaaaagtggtgagaaaccagcaaaattccaaaaaatttatcaaaaaatatatttttcccattcgttcgtcgtgaggggggggggtcgaagcgaagcgggaaagagaaaaaattttaaaatttgaacaaaccccttagcaaaattcatttaaaatttcaaaaaaaatttccccagcggtgcgtaaaaatcctaatttttcttttagaaaaatacgctcaaaaaattgcaaaattggttatttattggacaaaatctatttaataaatcgcaataagatttcggcccgagataatttccgttatttttcagccccgccgttgtgataaatgcccgatggaaattccacgaagtgtggaagcttga

SEQ ID NO: 63458 - DNA, 1235 bp, Heterodera glycines
  Genomic contig location: Contig_ID=SeqID_6976; Location=1650..2884; Strand=-
  SCN-specific regions: Sequence locations=1-172,208-290,314-867,889 -1235
gcacgtgaagcattgctccaatgggctcgccatgttacgtccggataccccggtgtcaatgttgccaacttttccggcagttggaaggacgggttggcattctgtgcccttctgcacttttaccatacctggctgataaactcggaagagatgatctgactgatcagtatagaaaattaattgaattttttttttctaaaattttatggccacgaatttgagagtttaaattttggcgtttgcctttgattttgctgaaatttttggaactgatttttcgaaacatgttcgttttattttaattttaaagtaatttgtaagtcttggtggatgagccgaaggttttgtttgtccacaagaccttgtggggcaaatccaagtgatcgacacaaatttctgctgatctccccaatcagtcaagaaatcagtcaccataatcgcaagacataaactgatcagacggggataaggatttctcgccagaatagatcaatttgaacctagctaaatattctgatagcttatcaggggataacaatgtttatcaaacgtcgttgctgctgtaccacacgccaacctctatttcttatcagggaaacttggacgacttggtctctcggctgacgcgcggcattggcatcactaacgaaaagttggaccacttattgacgcgcattgactcggtagacgcagcggaacgcggcgaacgcattgaactgttggagcgacaggtgcgccaaattggggacgacctgaagatgctgaagccaccaattgacgagctgttcctggacgtggacacgctgcggcaacatcggcacgcggacgcggccgacttcaacaaacagtgagcggataatcgagggatttttaaagaatatggaaacttatagagcattttcagtgaagctcgagaccgaggattgaccacgaaactaaaaaccttttagttcctaagtataggatgagaaattaagggggacggggaggatcaacgaattagaataagaaatttcaaaaattttttttttctaaatcggtaaaatgctgatcataatttttcagagttattggcctggaacaacgtcgaactgcctacctccaccgtctgaaagcttggccttagccagggagcacgctacgtcactgaacgctactcgaccgcatcgtccggcacgcgtggcaacgcttttcgtcgagttgaggatgccatccaatggattcgtgatcgaatg

SEQ ID NO: 63459 - DNA, 956 bp, Heterodera glycines
  Genomic contig location: Contig_ID=SeqID_6976; Location=1632..2587; Strand=+
  SCN-specific regions: Sequence locations=1-365,387-956
atgtcccatcaaacacaccattcgatcacgaatccattggatggcatcctcaactcgacgaaaagcgttgccacgcgtgccggacgatgcggtcgagtagcgttcagtgacgtagcgtgctccctggctaaggccaagctttcagacggtggaggtaggcagttcgacgttgttccaggccaataactctgaaaaattatgatcagcattttaccgatttagaaaaaaaaaatttttgaaatttcttattctaattcgttgatcctccccgtcccccttaatttctcatcctatacttaggaactaaaaggtttttagtttcgtggtcaatcctcggtctcgagcttcactgaaaatgctctataagtttccatattctttaaaaatccctcgattatccgctcactgtttgttgaagtcggccgcgtccgcgtgccgatgttgccgcagcgtgtccacgtccaggaacagctcgtcaattggtggcttcagcatcttcaggtcgtccccaatttggcgcacctgtcgctccaacagttcaatgcgttcgccgcgttccgctgcgtctaccgagtcaatgcgcgtcaataagtggtccaacttttcgttagtgatgccaatgccgcgcgtcagccgagagaccaagtcgtccaagtttccctgataagaaatagaggttggcgtgtggtacagcagcaacgacgtttgataaacattgttatcccctgataagctatcagaatatttagctaggttcaaattgatctattctggcgagaaatccttatccccgtctgatcagtttatgtcttgcgattatggtgactgatttcttgactgattggggagatcagcagaaatttgtgtcgatcacttggatttgccccacaaggtcttgtggacaaacaaaaccttcggctcatccaccaagacttacaaattactttaaaattaaa

SEQ ID NO: 63460 - DNA, 688 bp, Heterodera glycines
  Genomic contig location: Contig_ID=SeqID_6976; Location=2759..3446; Strand=+
  SCN-specific regions: Sequence locations=1-148,170-441,463-688
atggtaaaagtgcagaagggcacagaatgccaacccgtccttccaactgccggaaaagttggcaacattgacaccggggtatccggacgtaacatggcgagcccattggagcaatgcttcacgtgcagtcagcagtgcaagtgggagtttggagcggtgtcagcagcagcggttgattcagcattagcttgtggagtgccgttgttggtctgttgagtgatcaaatggatgggtgggaaatagagtggtgaatgaagagaattgtgagagaaatgagagtgcgagatacttgagagatagatagagagaaaagggcagaaacaaagaaaaaattgagaaggaaaacggagaaaaatcgcgcgcggaaagaccaaatgtaataaaagattggcagtcagaataattccagtcagtcaatgctcgcgtttcacacatttctcaccgaaattttcaaaaaattttaggctaattattaggactataaattattagttcggcgcataattatgttcgttgttttttagaaccagcgtatttctgagctttgttcacgtcgaacgcaagaaaccggattcgaaccgatcaattattcggatttttaaatgatacaaaaacaaattttctcagctaaactttgtaagttttttttggtttaaacaaaaaacgaacataattatgcgccgaccta

SEQ ID NO: 63461 - DNA, 314 bp, Heterodera glycines
  Genomic contig location: Contig_ID=SeqID_6976; Location=3845..4158; Strand=+
  SCN-specific regions: Sequence locations=1-17,39-59,87-314
atggtcaaaattctcaatttttcccccggcggatttccatatttcgggtttttgctccatattttatgtgcatgttttgtaatttcactgctatccataattgacagcccaaatgataagaccacaatcaatttactaattgctttttgccgtcggtccaatttcctaattgaggagcgagaacattcgcatgcaagaaaaaatccaccaaatgtcattaatttcacagttgagcaagaattgtttatttcacggccagtataatgctaaagttggcggacgacataaatatataataattccacccaaattga

SEQ ID NO: 63462 - DNA, 603 bp, Heterodera glycines
  Genomic contig location: Contig_ID=SeqID_33387; Location=122..724; Strand=+
  SCN-specific regions: Sequence locations=1-222,244-603
atgaccaattcatattcctcaattggactctccaaattcgcacaattggtgggattggacgagtcgagcggaactgtgcaagagttactccaaaagtgcaattggactgtgtctgaggacggcttcatttctccggtatcacacaaaaatgattttatcggttccctttaattatttttgggaacgcagcctttaattgctattaaaatgcgccgacactgggaatatccatttgattttaaggtgcgaaacgcagaattaatgcaagccattgaaagtctcaacgacgccaaatttggaacgggtttcgatattaagtttgcggaacggggtgtcggtggagcgaccgaatcggacagcaatttcgacaacttaaaatcattggtatttttcagaacccattcatttatcaaaaaagtccattatatataattaatttcacgatttgttaacccatttttggctaaaactaatatttcagatcgattccacaatgttcttcgatgcaatggccgtgcaatagaaaattaattccgaatgtttattccatttgcattatttattggtttttccatgaatggatttaagttaattacatgaaaa

SEQ ID NO: 63463 - DNA, 648 bp, Heterodera glycines
  Genomic contig location: Contig_ID=SeqID_33389; Location=879..1526; Strand=-
  SCN-specific regions: Sequence locations=1-131,169-252,274-427,478-616
atggccacattggacgatgataccaaaattggagttgaccttcgctgcggggcggaggaaagtgaacgacgcccggacgcaattccgtacaacgcgcaacgcgtaataatttaattgcttttaataactactaattaattaaaataattaattatttctaataaatttcaaacagatcgacataatcgagatggaaaatgtgggacatgcaaatttcactgaagtcaaagttaatttcattcgagagcaagggaaaggaaaggtgagaagaaacgatttaagacattttaaatcatttaatttttactatctttttaggcgccgcgacagccctcacaattgttccgtgccgtgtttggtgacgcagccactgccgatgactttgtaattcgcattgaatacacaacgccaacgagtgactccggtgaaaaaaaatatataaaaatcattttttgcattaaaaaataactttaaattcccagatgatttcactgctaaaaaggagacacttgcgcaggaattgaatcaaaaaattcaaaaagcccgtgccggtgattctgaccaaatcattcaaattatcactctcatcagcacattgacactcgtacaggtgtggatatttaattatgattaataatttaaaataaa

SEQ ID NO: 63464 - DNA, 708 bp, Heterodera glycines
  Genomic contig location: Contig_ID=SeqID_33391; Location=361..1068; Strand=-
  SCN-specific regions: Sequence locations=1-546,570-708
acttgtggattacatcaccacacaacacggatggccagcggatttgggatatttttgttcgcgaaatttggccaattttttcggaaaatattcaccatttggacttttacgattctgttggtttggacaatttgcttcgtcgcactacgccgacaattctcactgatctcaaccaattgacttcaatcaatttatatggtcggtttcctgctgcgtttggtgatgattttgatgggccaaattcaacaatttctgctggccaagcattgtccaaatggttgcactctccgagaaacgatggccaaccaaagcgattgcgttgcaaagactttaaagaacaaccgaacttagattggatcaacaatttcaaggaggtgagtggccacatttttgacaaatcactgatttttgttttcaaattgtttagcattttctccgtgccaatgccatttcttccgtcagttaccaatttaatttttctgttcctgtgccgtcaatgcaaattgtgccatttgaattggtgaacgaatggacaaaggaaaagctgacattggccaaaacaaagggatgggacaaccgatggataatgaaacgatgcaaaattattggggagacggcggcgattcagcagcaaaagaaagatgaaaattggggcaacagttgtaacaatgtgttcatttggcttaatagttacactaattgcattgg

SEQ ID NO: 63465 - DNA, 1811 bp, Heterodera glycines
  Genomic contig location: Contig_ID=SeqID_6978; Location=17..1827; Strand=-
  SCN-specific regions: Sequence locations=1-62,86-363,390-611,633 -1102,1124-1162,1188-1255,1289-1778,1803-1811
atgaagccttcgtggaaatcaactgtgaaaaattataaacatgaagtctgcgttatttttatcgacggtgaaggcggtgttgaagggcactacgacccggttaaaaatgttggaaaacttttcagtgcacgcaactattgttttggggtatttatagataattagaaaataatttttttaggctgaaaattatggcactgtgctggacaccctgccaccaattgagaactattacccaggtggactcttcccggcagatcgcgcaaagtttgagcaatggtacgacgagaaccgggaaactgggcttgagctcaccgaagtgatcgcggactactgcaagacaggtatactttttggaaaaactataataataatatataattttttaagatgtccaaatcctggcctatggtatggtaaagatgaggcagctgttcttgtccgagactcggcatgacatcacggattcggtcaccatcccatccggctgcatgaagtattgggtgcagttggctcaccacgacaaagaacgggttaccatcatcccacacttgggatacgagaagcgaggcaaacagagctccatcgccaggaaatatttgaaggtgtatccaaattattttaattttacattttgtcgactctcagtggcgtgccgaagaagaattgcgggagaatggccgagtcctgcgccatgtcgaaagccctggaggggagttcaaattcggcaactacagcttggacgggatgatggagcgccctgatgaagacaaaaacttggccatcgaggtcaatgggtaaggaaagaattccgaaaaggtgccaatttctccattgaaaaaggtgctattggcatggatgcccaagctgcttccccgacgatgcggcaattgtgggcggaggagaaacagccggtgccctcagggcccgtgatgccaagcgaacccgggacattgcgcgggagttcgaggtggaaatcatctgggagtgccacctgaacgcaatgctggaggacaacccagccatgaaggcgtacttcgacaactgcccggactccggaccaattgacttccacgacgccttctttggcggtaccttttccatttaatttttaactaattttccggcacaggtcgaacagggcccgaatacttgggcgcatcggtgatcaacccagagacgggcgactggaaaagccgcacaatcaaagtgaaggactttaacagtctttatccttcgcggtaagaaatgccggaaaaaattaataattgaaaaattttggctttttaaggaatatgtacaccaattacccggttggccatccgaccgtggtgcagtttgacaaggacgtggaatggaggagtccagcggacattgttggcgacgatggcatccgccttgagggcatcatcaagtgctacgccgtgccgccccgccactgtcactacgacatcccggtccttccctaccgggtcaacaaccggacgctgttccccctctgccggacttgttcggaaatgtacccgcgcggcttgatcgaccccgagtacaactgcaaacattttgaggactctgaaaggggtgggtttagaaacttttaattaagcaaatatttttcttgataggattttcgacaactgtgacgcacattgagctggaggccgccctccgctctgggtacaaggtgacgcacgtgtaccgtgcctacatttggcggcttgcgtgcgattggagcaatgggctgttccactcgtacctgctcaaatttctcaaaatgaaatttgaaggtaaaatttgaaaaacttaataaa

SEQ ID NO: 63466 - DNA, 644 bp, Heterodera glycines
  Genomic contig location: Contig_ID=SeqID_6978; Location=4471..5114; Strand=+
  SCN-specific regions: Sequence locations=1-4,75-87,110-228,268 -310,336-346,475-644
ataataataaaataataataattaattaattaaacatttttataataatttaactaataaatattatttaattataaccctcgttcctttttcctttaaaatcaaaaattgggaaaattccgttaattgatttgtttattaggtcttattgcagcactcttccccttcttcattgatttgtttattttgttcatcttaaggggtcctgtaattaatttggtttagttaaaataattatgcaaaaaaataaataaataaaaaaataaaatattgggctcataaattaaatttagataaaaaaaacattcaaagccaaagagttagaaaaaataaatttgcatcaaagtataaaatttcattgaaattttaattgtttgaaatttaaaaaaatatttgttattattttaaataataattaactagttaattaattagaacattttttaaaatttataaataaatattatttaattatacggtcccccatttctttttcgctttaagtcaaaaattgggaaattccgttaattgatttgtttatttgaccccccttcccttcccgccacccgaactcgccatttcccgtatccctcgctgcaacccttcctcgccactctcgctgccgagcaatttctcgccatttt

SEQ ID NO: 63467 - DNA, 241 bp, Heterodera glycines
  Genomic contig location: Contig_ID=SeqID_33396; Location=51..291; Strand=-
  SCN-specific regions: Sequence locations=1-39,99-241
atgaaaaagtaagtgcttttttgaatgttcaatgatcagaaatattaaaaaattattgttaattattattaattgtcattcttttttaattaatttttcgtttttcagttacattttcttcggattcaccgtcaaacggctgatgtatgaaagcatttctgcgtatgatagtgatggcttggctcggaataacggagaaattaaaaaaaatgccaaacattcctacggtgttggcgatacc

SEQ ID NO: 63468 - DNA, 458 bp, Heterodera glycines
  Genomic contig location: Contig_ID=SeqID_33397; Location=514..971; Strand=-
  SCN-specific regions: Sequence locations=1-321,363-458
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgggggggaaggcccaccacgaggccgcgaagcggccgagtgagtaccttcggtgcaggaaaattattaaggaagagagttcattatttatttgttttttgcataattaattcataaatatttttttcagaaagggttctgaaacgcaccaaattttatttacatgttagtttaggcactctgatgctttttctatcaaaaagggagatgaataaa

SEQ ID NO: 63469 - DNA, 366 bp, Heterodera glycines
  Genomic contig location: Contig_ID=SeqID_33397; Location=784..1149; Strand=+
  SCN-specific regions: Sequence locations=1-245,268-366
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaaatgggtgcgctttagagcactttctgaaaaaatatttat

SEQ ID NO: 63470 - DNA, 484 bp, Heterodera glycines
  misc_feature (471)..(471): n is a, c, g, or t
  Genomic contig location: Contig_ID=SeqID_33398; Location=1113..1596; Strand=+
  SCN-specific regions: Sequence locations=1-484
atgcgccgcattttgtccattttgcaggaggcccaaaccgattgcactgacacagtgagtaaagggagaaacttttcgacggcatttactcatttttcaggagtgttccacgagcactggcggcgaccccacgggcactgccgggtccaacgttctgctgattgccatggcctggggactgtttgccatgtaattccattttatttgtcatttccagggttcctctcattttatatgttcttccattttaaattcattttcgttttaggcttatgtttttcatgcggcctgcttcgatgcgttccggcggaaacgatcgcgaaaatggccaaatcgcgggcaaaccgtcgtcagcagcgaacggacacaacaacgatgtgagagtggaactagtaactttgattttggaccggaaatattagggaatggcaaatcggctgttagattcgtgaccggcggtcttgaaatggntctaataatttag

SEQ ID NO: 63471 - DNA, 930 bp, Heterodera glycines; identical to SEQ ID NO: 33399
  misc_feature (823)..(823): n is a, c, g, or t
  misc_feature (883)..(883): n is a, c, g, or t
  misc_feature (911)..(911): n is a, c, g, or t
  Genomic contig location: Contig_ID=SeqID_33399; Location=1..930; Strand=+
  SCN-specific regions: Sequence locations=1-135,161-163,186-421,444 -598,658-792,822-838,874-930
  Gene Ontology: Mol. function=GTPase activity; Cellular component =mitochondrion; Biological process=growth

SEQ ID NO: 63472 - DNA, 236 bp, Heterodera glycines
  Genomic contig location: Contig_ID=SeqID_33400; Location=203..438; Strand=-
  SCN-specific regions: Sequence locations=1-162,186-236
atgccaaaatttgtatggacggctaagaggttggccactgatttatggcattgggccaacaaaaaggaaaagaagcgggccgcatcaccacttcgcgtgatagaaaaaaaattgggcatcagtatttggctgtacaagcacaaaacccatgacgaatttgtgaaaaagcacccggaggaattagagccggtgcccgacccatgtgaggaggcaaagcttaagctgaagaagaagcc

SEQ ID NO: 63473 - DNA, 967 bp, Heterodera glycines
  Genomic contig location: Contig_ID=SeqID_6979; Location=4447..5413; Strand=-
  SCN-specific regions: Sequence locations=1-42,67-197,220-251,285 -526,559-853,875-967
atgggaggaggtgcaggacgcaaattggagcagggccaacatttgccggaggtggagaggaagaggcgcgagccgtggcgactctttgccaatttggcaaaaaatgtgagaaaagggacaaaaaagggaggtgggaagcgaaaaacttagcgaagggttaaaacatgaaatttatgggattttcgccagacgatttgagaaaaatttacattcaaaatttccctttctccaaacttcattgattttggtgattaaattgtttaaaaatttaaaaaagtacataatctcgattatttggtgagtttattaataaaaaaagctttttgttaattctttattgattaattattaatatgcattcaatttaataagtgccaaaatgttttgttcagcgcaagggcgccgatctgtcgtcgttgtgcccatccgatgagccgcccagctccacgctgccctccccaagtgtggaggaacagcgggcgcccttcagcatcacttctgcggatgcttttccaccgcaaaaggcataaatagaataaaaattaataattattaattcatgcaaaattataggcccaattcgccgctgccaaacctccgctgggaatgccttccgctgccatcccaacggattggtcgcctcggagtgccaaattggcctaccatccgccttcaatcgggtaaatttctggcacttttaaaaatttctgaacatttttttagctcattggatgaggcggaaagtggcggacgacaattagacatttcagcaccgagggaagagtacgagagcagattgagtacgccggacgaacttcggtaattagtgggagtaattagaggggggggggggacattgagtgaccataagcaaatgcgtttgttctgccgtttttcattgtgtgctttcctttggcaaaatgccacaagactttcacccagattagatttacccttttgcattaaa

SEQ ID NO: 63474 - DNA, 563 bp, Heterodera glycines
  Genomic contig location: Contig_ID=SeqID_6979; Location=3550..4112; Strand=-
  SCN-specific regions: Sequence locations=1-35,63-119,141-282,313-563
atggccacttttttcggcacggaagtgccaacggcgaaggaaaacaaaaagagaaaaagcaacgaggagaagtcgctttatgaggagctgcattcgcccaaattcatcgacgactcagccagaacagaggacgaaggcgacaacgaacagaaggaacccaagagaactgctggggacggagtcgccgttggcacggcactttcggcaacatcaaaaagccgcgcaagagtgattaattatcttattaacaatagtcaattccaaaaagcagtgatttaatgcttaattattattaacaataattaattaattgaattgtttagctttgcctatgaaatgccgtcgttttgccatttcagcatatagctaatgtgttgtttttttttttaatttaacccacttttgcaatgcagttgaccacaaagtcgaggccatcatcagcttggtgtccacccgccaaacattcgttggcttttcgtttggagggaccgctggcgccgttgggtcggcccataattcactcgccacggttgatgtgcgtgagcactgcttggcgtgaataa

SEQ ID NO: 63475 - DNA, 327 bp, Heterodera glycines
  Genomic contig location: Contig_ID=SeqID_6980; Location=163..489; Strand=+
  SCN-specific regions: Sequence locations=1-10,93-99,121-327
atgacacaaaaggcaaaggcggaaatggaggaggaggaacagaagacgaagcaggaacaacagcgagaatttgagggggaggaggaggaggaaaattgtgaagagaatggcagcgaagagaacggtgtgccgaaggaggcgacggcaaaatgccaccaacaaaatggaagacgagagaatggcacaggcaaagtaggaactgtcgggaatggcacgcacggggaaagttggaccatccgtttccctggctttaagggtttgattattgggcataattttcagtctcacggagtcaaggaaaagtcattcgcgaaaaccggacgctaa

SEQ ID NO: 63476 - DNA, 412 bp, Heterodera glycines
  Genomic contig location: Contig_ID=SeqID_6980; Location=619..1030; Strand=+
  SCN-specific regions: Sequence locations=1-143,165-174,197-412
atgccgcagcactcgccccccggctcttccgccaattcgtcgtcctcctccgcgagccttttgcgcttccgtgccgcgttggacagtccgttcggctcgcgcgatgacatcagcaacaatttgacgaccgtaagcaacggatacgccgcctttccgcccgccccaccggtgcacaaaattatatttcaatttttaagagttttttcagcgatttttgggcggcccattgcgccacgccaatggcggcgctcccgtggctcacccgcagcattttttggcaccgccgtcgcccttccgtcgtgccgcgccgtgcccaggcgacagcagcgagccgctgctgcggcgcagtctccgctcgccgaccatgcgacggctgcaggagtcgctgcagagtttggcggaggatgtgccg

SEQ ID NO: 63477 - DNA, 561 bp, Heterodera glycines
  Genomic contig location: Contig_ID=SeqID_6981; Location=1350..1910; Strand=+
  SCN-specific regions: Sequence locations=1-128,150-484,540-561
atggacaatttcccgcttcaccgtgcggtgttttccaatgaagttcaaatggtcaagcagcacatgaccgaaatgaacaagaaggataagcaaggcaatacgtgagtttttaagaataataaaaagtacaaaatgtttttcttttcttaagacgcatatcgcctgtatgcttggccacaaaggtagccaatttgtactgtgtttacagttttttcgattattttttattttacagaaattgcgcggattttgttggagaaggcgcaaaactgcggagcagaacaacggtgaatggaacgcgttggatgaggccatcgcgtatggcgacattggattaggtgtgaaatttcaaatttcacatcaaaattgaaggggactatataagcttgtagtgcgtttgcgcaaaaaatgtctaatttttgcaattttgggcttaaaatttcaattaatgtaaattggggtcaatatttttcgaaaaattcccttatttaatttttaactaaattttaagtaaatttttttacgtattaaaaaaatttggttttttgtctttcatttaaa

SEQ ID NO: 63478 - DNA, 1033 bp, Heterodera glycines
  Genomic contig location: Contig_ID=SeqID_6982; Location=1744..2776; Strand=-
  SCN-specific regions: Sequence locations=1-581,647-791,813-978,1000 -1009,1031-1033
atggcgtgccattgggcggccaccgccgtttttggcaaagtgccgctgatcgccacgatgctcccctcagttttggccaagggtttgaccagcaatgagctcaggtagaccagcctgaatttttaaatcccccaacaaaatgccaatgccaaccatcgcattgtgccaccaaacagctgatcagcggcagaatgttgtgtggagtcactgatcaggtcgacgctcaccttgaaagcaatttctttattattggcattccgtttaaatgccatttggcacaattaatgcgtcgattttgccgaagcgttgcagcgaccgttccaccaattccatggccgtgccctcctccgtcgttgcgcccgaaatggccaaaatgcgccgttcgtcgacgcccgaccgcacgagggactccttcacagccttggaaatttttttagctatgaaataaataaatataaatttccaaccgccaaacgctcccccgagggctcctgaatggtcagagaggcgccttcgcggccaaaactcagtgccatttggcggccgaatggacgcgttccgccttagaaaacaacaaatcgtattttaaataaataataataattttaaattcaatttaaaaataaatattttaaatatttaatttcaattctttcatatgatttccatgaattcttctcgaaatgttaacattttaatatgacccgaaaagggaaataaattaggcaatattaaatttaattatgctttttatttgatggtttttggtaaaatattgtaattccaataagataaattcaacaaaattcaccagtgacaattatcactttgcccacaaattcgccccgaaaatgcgctgaatttttttgcagtgccggcgatcgcttcggcgacgcattggcaccaatcggagaatcggcgaccaaagaattgggagacgaattgccattgatggccgaaccattgctgtagttggtggagttgttgtgctggttgttcagcaacattttgtaacaatttgagaaaaaataaa

SEQ ID NO: 63479 - DNA, 1189 bp, Heterodera glycines
  Genomic contig location: Contig_ID=SeqID_6982; Location=3868..5056; Strand=-
  SCN-specific regions: Sequence locations=1-94,118-205,227-575,597 -662,707-730,752-856,878-922,944-1002,1025-1189
atggcaatgccatcgcaggagaagcgaattcggagagcaaaaaaacgagaagaagaaggacggagaatggcaacaacaaacgacgaacgatggcagagaaacagaaacagaaacacttttggcccatggcaaaggccaacgaagaaaaaaccaaagttagggccaaaagaaaatgaaagacctaaagggaattgtcggcattttaaaggggaaaattgaaaattgacgaaaaacgaaaacaggtaatagcaaaatgagacgagcaaacaaaaagggcgaaggatgaacgaatccgaaaaagaacaacaggaggaaaagcattcatttgtccaatttgaaatgccaattttgacggtgccatccgacgaaagcaatgaaattgagcggacattttggagcacaaaatgatggcacaatgcaaaagaatgccgccattaattacaacattttggttttgcaaatattgaaattcaaaatttatttattttattccgtcggcggaatttcccaaaaaatgatgacgccaaataattcacgccagtcaattaataattgtctttccgtgctgataatgcaaaaaagggaggtaaataaatgataacattttgtccgtccccattttgcgtttgttcgtcctcaaaatgccattcatttgtccgtcattattttgtttattatttgtccatttgtccgtccgtccgtttgagtgcaaatgaaaaaaaaacaattaaaaaggcggggagggggaaaagaattaatgaattgaccaaacactgatcattttttattttcacattcgttgctgttctgcttttgctgctgtccgatcacgctaacggtgcacagagataaataaaaagaaaggcatcgtcactcatatgaccaaagatgggacgagacatggagggggagggtaattgaggggttaattggggtggggtaattagagggtgcaaagggcgatgggtaaaagggcggagacgctaatcaacgtcaattaccccaaaaaggaaaactttgcaaagaaaaaatttgcaaattttttgagacgagaatctaaaaaaaaattcaaaagcaggataagaatttgggaacccgatctgtgccggattcccagatgaaatcctaattttccaggttgatccggatgcgcttttcaaagtatccgggccagccaggaggaccatga

SEQ ID NO: 63480 - DNA, 674 bp, Heterodera glycines
  Genomic contig location: Contig_ID=SeqID_33415; Location=108..781; Strand=-
  SCN-specific regions: Sequence locations=1-17,44-674
  Gene Ontology: Mol. function=iron ion binding; Cellular component =mitochondrion; Biological process=citrate metabolism
gaggatcgggcggaatttgcattggtgtcggtggtgctgatgcggtcgatgtgatggctgattttccttgggaattgaagtgcccaaatgtcatcggagtcaaactgacggggcgtctttccggatggaaagcaagcaaggacatcattctcaaggtgggatggaaatttagtgatatgattcacatcacttttttcggacgttcagacgatgttttgtggctcatcgtctgccatgcaattgcattccattcgaacttgtaagcagaaaatttaactgaagctccaaataaaatgatttttcgataattttttaatagcgaaagtttattattattgctttggctagtgagttgtccttatgttgtaatatttagtctctacttcgactgacgatcagatcgaattgcgttcattcagagacactgtgctaagcaaagtaaacgaaaaacatgactttattatttaccatgttctttttgtctgcagctcgatgacatcaaaaacagcaatgatatccgttttgaggcagctgaaaaaattactaacaacatcaaacaatctgccgacgacagatacaattcaattgaaaaagtgtccagggaagcaattaacggacaactgcagggattcggacttaaagtttttgcgttcaacgcaggccttgcaggctct

SEQ ID NO: 63481 - DNA, 825 bp, Heterodera glycines
  Genomic contig location: Contig_ID=SeqID_33417; Location=54..878; Strand=+
  SCN-specific regions: Sequence locations=1-266,290-621,643-825
atgtggaacggaattttggccgatttgaaaattttcctcggactcgcacgaggcggtaatccaaacgtgaatgctggaggaacaagaatggaacaaattcaagacctggacagagaaagaatcagtacgaggaacggaatttcatgccaattcccgaaccaaatatgagacaaaatgatggacaaaaccaaaatttggttcaccaacaagtgcagggccaaaattttcaacaaaacatggcaagagtgatgccatacaccgagggaattcctgatattatccttgaacttcacaaagtcacactttcaaatcagtacgcaaatatccttagagaaattcctactctttttggcactgaaggaagggacgatgtcagcgatgatttcaacactcttgcatcgtgaatcaggcagatagcagacgaagaccaacaaggtgaaaattgagagcggatcgatgattggggtggagtgcgattttgagccgatgtcataatatctatatattctttccctctcccctcttttagctggtctgacccaaatgcaacagaatctgcaaaaggactccaaattctctgttcaaatggtgccggttccgcaacagcaaatgatgacgatgggcggcggcgccatggatggaccggcgcggacgtattttacatcgcgaaatccaacatcgattgcggtaccaggtcccgcccagagcaaggcgtccgattgtgatgagaagggcaccggaaattttggaaacatcccacccctcgacgggtttatgactcgggagatccggaaatttcgtcacgaaacatgcgaaacgatgtga

SEQ ID NO: 63482 - DNA, 256 bp, Heterodera glycines
  Genomic contig location: Contig_ID=SeqID_33419; Location=403..658; Strand=+
  SCN-specific regions: Sequence locations=1-96,133-256
atgtttggcactttcattctctccgccaccttttacatgtttctgcgctcaatgctcactttcagtgccgacgaattggaggcgatttttatgagcaaattttattagatttttacattttatataaattttcagcccattgaacagctcaccggtgctgtgcgcctggtctgctgcattttgttcacctggacagcgtcacaacttttccaaattcatcagcggttcatctatcacacgggatgccatggatacg

SEQ ID NO: 63483 - DNA, 414 bp, Heterodera glycines
  Genomic contig location: Contig_ID=SeqID_33421; Location=57..470; Strand=-
  SCN-specific regions: Sequence locations=1-216,252-414
gaatggtatgatgggcaaacgcaaatgctgaacgaatggcttacggtaataaatcaaaaattattttgaccaattaaatttaattgtttattttcttcctgcaggaaaggcttcaacaatcactttccaacacgcaactcaccagtttattgctcattgtaaaggtgaaaaataaaaacatttaaagaaatcaaatcaatttgaaaaagcgacgcgaaatttattttttcatgaaaatttaaaaaatttttgaaaagggtaaattttttagctttttttcacactctacccatttttcaaaaatttggaaattaaaaattcttaaaattcaaccaacccaaaatttccaaaaataaattttcagaaaatttattccgactttgaactgcacggcattgacgaggaacggctgaa

SEQ ID NO: 63484 - DNA, 2039 bp, Heterodera glycines
  Genomic contig location: Contig_ID=SeqID_895; Location=210..2248; Strand=+
  SCN-specific regions: Sequence locations=1-1786,1808-1830,1852-2039
atgtggaccaattgtttttatgaacccattcgtttgtacaaatctgtcggtgacttggatgaagaggaccgtttgcttattaagcagtttatatcagcgagcatttcgtcgatttctttgcttctcgaccaattcgtggacattcgcgcgactcttttcatccatttgggagacctgcacagatattcctacacaactgttgagcaaaatatgcaacatttaacagcagctgctgaatattacaaaaaagcgctgagattggaccccaaaaacggacatccgttcaatcagttggcattgctgttgaaggaacacaatttggagcattcgctttcgctgtttcttcgtgcttgcattgtgccaaggcctttctctcatgctttaaagaatttgcgtgcatttaagcaaaataaatttgagcacaattcgtctctttctctgtttaatcttgtggacattcttatctacgattttgggcaagtttaatttgtcttctttttttttggttaaatattttaatgatttagacgagtttcgttcgaagatgagcgaaagcgttttgatggactatttgacgaacttctaaagcaatcccactatctttttgctgttagactcattcattcgttcgcattggcttcaatttacactttattaaacgaaggtgtgcctcaattaatttgttttaacttttaaacaaaaattaagaggacgacgagaaattccgatgttccgtttcttttctttttcgcaaatgggctttattattggttgaagttgagaagcacttagaagagcacactttaaaagaagatgaacaacaactcgcaaaaaaacgccgccagaatagaaagtcttcgtcttccagtgaatcgtccgaagaaaatttggaattcaaaaacggaactgcgggggaagagtcgcagatttgcgccgactttgcctgggtgttactctcttcaatttttgaatttttgaacttcacggatgggcgatttactggcagaaaactgtctgtttctctcaaatttgtgagttttcaaaatgatttttctaatcaaacaaatttttttagcaattccaaaatttgctcaaaactttagtcgatatactcaatgaattgttgccaaaattgagcgcaaaaatgcaaaaaaatgacaatgaaatggaaacgatggaacaaattgccgaatggtccataaatgggccatttactgaaggcaatgaagaagaacagtgcgaaattgctgccagttttattcgccatgtcgtcaaaaaacaaaaattcgctatcgtttttgacaaattctttcaaatgagcagcaatttgatggaagaaaaagagcttaaaccgatagaggcgttttcaaagatgcaccttcaacacgtgacaaatgaggtgatggaaaggggtcgaacttacatccttttcaaaaggctattttggaaacattttgggaacgaccctccaccccctcagggcgtctcatcgaaaatcttcttcccatcccttttttaattatcatcttctaaaatttaaccaaaaaacaataaataattcaccgaactaatttcagaatgagaagacaagcaaagttcctgtttatgtcgcgcccgattcgtccgttttcctccacaaattggacctcgttaaacatttgcttctgtcgatgaaccaaacgattataattgcgcgcagtgttttgagccgattggacaaagtcaaaagggaaaataataatgcgagggaggcgataaggcaaaaagcacacgaacaacaaccaatgggccacttctgggctttccctttatttaggtggattcagagtcgcattcccgagggccgagttcgaatgcttccacacacaggcgagaaattcatcaatgaatgcctccaatttgtgcgcgaaaagggactattggacaagaaaacattgttctgttcaattttgacaactggagaagcttccgaggaatacgaacggcagaaggaggaaatgcgccaatacaattgtcagttccgaagacaattcaattaa

SEQ ID NO: 63485 - DNA, 3997 bp, Heterodera glycines
  Genomic contig location: Contig_ID=SeqID_895; Location=2678..6674; Strand=+
  SCN-specific regions: Sequence locations=1-364,386-1662,1685 -1722,1755-1782,1804-2426,2453-3290,3312-3969,3992-3997
atggcacaagttgacgacgattatgaagcgaacaaaagggtggcggagagtttgagggagtatatgggcagggtatgttcatgttttcgtgtattttcttgtctgccttatctccaaatccattcagaggctaaatgttgcgaatgccttcgaaacgcccattttggaagggctaatggctgctgtgaaagtggagccgctgcaacgcattggcactgtgttggacggttagtcatttgttcgtcggatgtttcatttgttaagcattgaaacggcacttttcagccagcgccagatgctatgcattccgtgtggacaacacttacagtgcgtagcctttgcttttgaaaatggaccctttgttaattgtcagcatacaaaatatcatactgaaacagttggattagtgatgagttgtattggctcattgtcatacttaaaatcgtaaaattcattggagtattattttcttttttcaacatttatttgttaggtgcctgctacaaagttctttcagcggcttcaggaggaggtacaattgaaccaaccttaaatacaatttacgttgtatttagagaaaattgccccatttcaaaacgacgattggcagaacgatcgggatgaggtcgagacggtcaatgcgaacgacgagggaggggacaaaagcggaacaattgcgagcggtgaagatggagaagggagcggcgaaggaaacaaacgggacaaaaacaaactgtcgaagccattggactcgtcgagaaaagcgaagcttttgacgcgagagactcaccaattggctgagggactttggaagcgatttgcttccgctcaacactttggggacacggaagatgatttgcatgcattgttcgaccaattatcaactgatgttactgggacggtaatgaaacgacgtcttggagcagtacatgggtcgttggaccgaaaggacaaccaattttcgattgaggatgccatctacaggtgtttctgaatgcacactactcaatgttctgcgccatgttaatttttttgtaaatttcagaaagatttcaaaggatttcgaagaagggtccgctcgaagtttcgtcagcaatcaaattctgatgaacgaccatggttagtggtaccaaatggtatctccttctcatttacctgcttatttttaggcaattttctgattttgcacacaaattggccgggggacgagccgtccaatccgttgccttcgttggtcaatcatctctcagccgcatcggcgcaatgccaaacaaaagcacttgaccaaatgacttctgctgtgaaacgtgcccagtccaaacggccctccgagttcgctcttctcactcaaatttgtgcggacgatgggcagaatttgcccacaatcgatttccaagaggaaaatagctacgaacagcgaattgattgtgttgtcgatgtttttgagaacgacggcggtgatgaggtgtggtggcaagaagcaccaagcccgtctcaaaaaaaatttttggaaggggaaccaggattttttttactctgtgagacaaaaaaatgtttccagtgttttcaccgcataagcgaaaaagcaggaatttgtagcggtgccgattggcgttgccgggaaattttttttggcaatttaatgaaatatgataagaaaataatacactaaaaatatataatttttcatttcggggccccttcccccaagttactcttccgttctttgttgcttttttattttcaaaattgggccacaaaaatattttgatggtaattaatttatataactttttactttgaagcatgcctcgacattggaaagtggtgatggtgcgcctttgcattcgtgtcgaatggctgtcgatgaaaccatcgctaattcgccttttgctgactcggccattgctcctctcacaaatggcataaatgtgccccatggaaatctcgaagaagatggtttaatcgttgaaacgttcagccaaaacattgatgaaggaactgacaatgagtcaaaagcaaccacagcttacttaggcagagatggggaagctttcggcacagaagtggtgagtttggcacggtattcctcccccatttaacttagcactcaaaaggctgaacgtgaaaagcaattggctggaggcgacgaggacattggcgatgaacaaatctgccgtctaattgacgaaaaccttttgccgctcactcaaacggacaatgaaaattttgtgccattaaaaaatacacttgttgaagatgattcccattggatggttgttttttttgggtttcttttttagcattttaaagtttgttctttagggggatcaaaatgttgaccatggcttagcgccaactgatgaaattcgacccaaaaaagggaaaacgaagcgcctgattcacgaggccggcagcgcaaaaggtatttttatttatttttttattttatggcattggaaacattcgcagtttaattaacttcagcaaaacgtcgtctgcaaaagggaaatgatttcgaggaaataagcggaattgcggatgatatgtgttggattccaaaaagagttgtcagctcattcgtgaagagagcaatagcggacattcagcggacatcgctggccaagcgaaggttggagatggacgccgacttcagcgacgacactccgttgccctttttgaacaagagactgacgagggacagggccaaacagctcgagtcaatggcatacgactcgaccaatctcctcagggcccgcattttctacaaggtggagagcaggatggtgtgacccggcacggcatatgccgaaaagtgccgtcggggaaatttggatttgcggcctaatgattttttcattttctacctcttttccacttgtttgttgtttttgcgttaatttttgcttaacggttaagagccacctcggagtttggtccttctttccctttgatgactctctgaaaagtgtccgtctgatcagtcggccccatttgctgccgcccttttcactgcctctccctcgcgacgaacaacacaacgaatttatcaaattttacctcgaattgatggatggtcagggtacggcggatacggaagcagcagatgtcatttccctggataatggggaggaaaattggcaaatggacgaccagaacggcacatttggagacgaagttcccatagacgctgaatttgctgtttctccgcacatggcatcagacgatggaagtcccaaacgaagaagatggggcagtgactgcactgatgaagaggacgacgaccaattggacactggctttggtttcctgaacaacataactctgaggtattcttacaatcagtcgttgggaaaccaacaattgtttttcagtgaaataaagcaaatttactatcaaacgaatttgaatgtggcaaaagtgaagaaggcgatgctaagggtcatttcctcccataagaaggtatttgcgtggtaaatgactaatttaatttaattgcatggtaaatgattaatttgatttctatcggtgatcgtttaagtgtgctcctccggcagttgattttgtgatgggtttggacgacgaagctgatgcagaagaccatctgtcatcttgtccatcagaggacaatgattcggaacagattgaaagcgatgttgaaagtatggctgccatttccgacgatgggacgccaactgcggagggagttcaggtgggcaccgccgagtcattagttaaggcactttggacagcactttcagaacaccgcagcgaaagcccgggggatcaacagcagagagttattcgcgaatgtcccgcgttttttgagtggaatgacaaagcgaaatttgactgtcacaaattcattcgctgttctgctgcatctatgcaacgataaggtgagaaaagaaggaaagaaaacaccgacggattggctgtaaagaaaattaaccacgcaaattttagcaattcactttggcacaaatggaaggagaga

SEQ ID NO: 63486 - DNA, 957 bp, Heterodera glycines
  Genomic contig location: Contig_ID=SeqID_896; Location=345..1301; Strand=+
  SCN-specific regions: Sequence locations=1-221,243-859,886-929,952-957
atggatggtcagggtacggcggatacggaagcagcagatgtcatttccctggataatggggaggaaaattggcaaatggacgaccagaacggcacacttggagacgaagttcccatagacgctgaatttgctgtttctccgcacatggcatcagacgatggaagtcccaaacgaagaagatggggcagtgactgcactgatgaagaggacgacgaccaattggacactggctttggtttcctgaacaacataactctgaggtattcttacaatcagtcgttgggaaaccaacaattgtttttcagtgaaataaagcaaatttactatcaaacgaatttgaatgtggcaaaagtgaagaaggcgatgctaagggtcatttcctcccataagaaggtatttgtgtggtaaatgactaatttaatttaattgcatggtaaatgattaatttgatttaattgcatggtaaatgattaatttgatttctatcggtgatcgtttaagtgtgctcctccggcagttgattttgtgatgggtttggacgacgaagctgatgcagaagaccatctgtcatcttgtccatcacaggacaatgattcggaacagattgaaagcgatgttgaaagtatggctgccatttccgacgatgggacgccaactgcggagggagttcaggtgggcaccgccgagtcattagttaaggcactttggacagcactttcagaacaccgcagcgaaagcccgggggatcaacagcagagagttattcgcgaatgtcccgcgttttttgaatggaatgacaaagcgaaatttgactgtcacaaattcattcgctgttctgctgcatctatgcaacgataaggtgagaaaagaaagaaagaaaacaccgacggattggctgtaaagaaaattaaccacgcaaattttagcaattcactttggcacaaatggaaggagaga

SEQ ID NO: 63487 - DNA, 681 bp, Heterodera glycines
  Genomic contig location: Contig_ID=SeqID_896; Location=1549..2229; Strand=-
  SCN-specific regions: Sequence locations=1-28,59-146,168-681
ctcttaattgttttgggcctcattatgataatggccaattgtggacaagcgatgcggcagcaggcggtggccgtacgtggccaactccgttgtgggaacagacccgcctcgggggtcaaagtgaaggtgggcccaaggggggggggaagaggggaggggacacttgcggaaaacgtacgttcagttgtgggacgaggacgacgggcccgaccccgacgacgtgtcggttctttcctagcagcgacactcgccaaacatcctttctttaggcttgacgaggcgtttaccgactcttctggctccttccaaatgagagggtcgacacgcgaactgacaaacattgaccccgtgctgaagatttgtcagtcgtcgggggagggggatttatttaataatggcaaaaaacaaacaaacaaaacagatcacgactgtgacgatgggataatgccaggtgagggggggggggggattggggaggacaacccaaaggggaagaagcattgcaggacaacgcaaagtgaaactgcgcatccccagccaatacatcacaaacggagggttggccagacgaacttttgaagtgtaagtgggaaaagagaaacgaaatgtgtgcatccgttccccaacagcggagtacttaatttggagacagtctttgctggggaggaaagggacttcatt

SEQ ID NO: 63488 - DNA, 148 bp, Heterodera glycines
  Genomic contig location: Contig_ID=SeqID_896; Location=2541..2688; Strand=-
  SCN-specific regions: Sequence locations=1-148
tgtatttgtttgagttggagaagcgtcccaacaatcagtagaaagctggccaatcccagaaaccgacaacgagttcccaaatgtgagacgacaaatggggatttttattgtacgtgcattactcatttgacatttatttatttcttcg

SEQ ID NO: 63489 - DNA, 469 bp, Heterodera glycines
  Genomic contig location: Contig_ID=SeqID_897; Location=1..469; Strand=-
  SCN-specific regions: Sequence locations=1-28,59-147,169-469
ctcttaattgttttgggcctcattatgataatggccaattgtggacaagcgatgcggcagcaggcggtggccgtacgtggccaactccgttgtgggaacagacccgcctcgggggtcaaagtgaaggtgggcccaagggggggggggaagaggggaggggacacttgcggaaaacgtacgttcagttgtgggacgaggacgacgggcccgaccccgacgacgtgtcggttctttcctagcagcgacactcgccaaacatcctttctttaggcttgacgaggcgtttaccgactcttctggctccttccaaatgagagggtcgacacgcgaactgacaaacattgaccccgtgctgaagatttgtcagtcgtcggggggaggggggaatttatttataatggcaaaaacaaacaaacaaaacagatcacgactgtgacgatgggataatgcaggtgaggggggggggggg

SEQ ID NO: 63490 - DNA, 194 bp, Heterodera glycines
  Genomic contig location: Contig_ID=SeqID_897; Location=777..970; Strand=-
  SCN-specific regions: Sequence locations=1-194
tttagtgccgctaaaaagttgggcaatttgagcaaggatgacgtgatgtatttgtttgagttggagaagcgtcccaacaatcagcagaaagctggccaatcccagaaaccgacaacgagttcccaaatgtgagacgacaaatggggatttttattgtacgtgcattactcatttgacatttatttatttcttcg

SEQ ID NO: 63491 - DNA, 1076 bp, Heterodera glycines
  Genomic contig location: Contig_ID=SeqID_899; Location=252..1327; Strand=-
  SCN-specific regions: Sequence locations=1-129,151-402,425-583,605 -1076
atggatcggacagttaatgattttagcttccaacatttttctgcaacttctactccaatgcccacatccacgtgccaatatctgaaaaaacgacctttactcaaagaaaaagtcagtgtttgcacattagttaaaaatttgaccattttcagaacaatacgatctcagcttctcctgccagtaagaaaacaccaatttctgctgaagaatcgttgtcaaatgagacaatgccggaccttttcttttacgacaagaaaagttcggacggattttcatttgaggaagaagggcaagagaatcggcagaaaaaagtgttgtcttcagtgtcagaagtaacttcgtgctcaaactcatcgcagaaaaaggaaattatcgaatgttcgctttctccaattcacgtgaaaaacgatcacaaatataaagcgaagaaaattatctcttcggatgtcgaggacagcattgtgtcaagttcgtcgaatggaaacgaaaaccgacaaaatgaacaaaattcgattgtggcagctgaagaagaccaaaatcgcaagagagtgttatctgattcaagtggaaccgacgaaggacgacagcttcaagttcaaagtgaagacgaaagtgggaggagcagcgaagaggaggcccaagtcgagcacaattcgagtgagacaacagccgaagaagagacggaggaagacatcgaaacagtcggggacagccaaagtgagggggaaagtgtgctgattgatgaagacgaagaatcggctgataaagttggagctttaccgaacagaattgaaggccgcaagaatctcccgggtgaatccctcagactttacattcaccacttacaaaggattttaggcaatgtgccacgaaccatcttactttcccaaccaaccatagtttctgagcaaaatcgtgccgaaatttacaatgcaatgcgtaagttagaacttttgacctaacagaaactgatttttagctgtccaacctggtcgcctttttggtggaaaaatgactgatgaaagattcatgaaaatctcatcagtgtccaatgacgtcatcaatgccatgcatag

SEQ ID NO: 63492 - DNA, 134 bp, Heterodera glycines
  Genomic contig location: Contig_ID=SeqID_900; Location=288..421; Strand=-
  SCN-specific regions: Sequence locations=1-134
atgagagctcgctggacaatgacgaaggccaggactgaggcacaagattctcagattggactaacactatttttctatcgcagttgcaaagactaccgagaaaatcctccttatttacttccacttgagatgtg

SEQ ID NO: 63493 - DNA, 681 bp, Heterodera glycines
  Genomic contig location: Contig_ID=SeqID_6983; Location=664..1344; Strand=+
  SCN-specific regions: Sequence locations=1-505,537-547,569-681
atggataagcgcactgagaaggagccgaaccgaccgaccgatggacggacggagacgaaaactgaggacaaaatgccaagaatatgtgtgatcagtgacaaattcaaacccaatgccgcgccctttcgatttattcccgatggaatgacaattccaaacttttttttaatttgttaaaattaaagagtgcatggtaataatttaaattcgtttaccgttacctgtcaattttggaaaagaaaacggtcaaaaaccggctgaaaaatttaatcatttaccagtcgacttaatttccgccgttaaattaccctgttttctggttaaaaaatttgcatgttttttgaagagattttttcgattttttattggattttgttccggaatactgaatttgcccttagcctggaaacgaacatatgttcattgtattctgaatagataaatttaaaaatcaaattgatgaaaatcatagacaaacttaatgatttttaaatctaattgctagaaaaattaaaaagaattttttatattattatctgccgagacacagtttctttttaccatttttccttctataactcgccaaactcttggacccaaagatttaaaagttttctttaattttagagttgcacgggatcgggtcgggaattcccggtcctccaggtcccggctgtccag

SEQ ID NO: 63494 - DNA, 1556 bp, Heterodera glycines
  Genomic contig location: Contig_ID=SeqID_6984; Location=13..1568; Strand=+
  SCN-specific regions: Sequence locations=1-253,284-597,619-848,886 -961,983-1229,1309-1425,1447-1449,1471-1485,1541-1556
atggcgttggagtccgcaacagcagcgctgggtgccaataaacattgcgaatgtgaacattgctcagaatggataagcgcactgagaaggagccgaaccgaccgaccgatggacggacggagacgaaaactgaggacaaaatgccaagaatatgtgtgatcagtgacaaattcaaacccaatgccgcgccctttcgattgccaaagtgcaaaaatgccactgataaataaacaaagtgagagcaaaccaatggaattttagcaaaaatggagaatatatccttgaaacacagctgaaaatgggttagccaacagctgctgatgttctaattttgtgaaaaaaatcaaaaagttaaattgacaaaaaattgtttatattctgaatgttgaaattgaatatgccaaggcattccgcaaaattcaaacttatgacccattctttactgaacggtggaaacaaaatgaaccggaccggctcatttcggcccgcacggttcggccccagcccagtttttgttgatctataacttttttctttgtcaaccaaatccaacaatcttgatatcattcgaaagctcttcacatactctattagccttacaaaaagcaaaaagattttctagcctgcaaaaaaattatgaagaaaaaacttcaaaaaaattgatttttttagttttcatgctattacttttttgatatttgtcgaattgccaagcaatagcttagaaaaagtttttaaactcgttaccaagattgttggatttggttgacaaagaaaaaagtcatagatcaaaaaattggctggggccgaactgaggtagaccgaaatgaacataaaaaagcaaatgcaatttttaaaatttataacataaaatgtaaatattttgccaaatataattttaggtgaagtttcggtcagtttagaaactcttggcatttctgttttgaatataatttttacaaaattataataagaacaacgaaaaaattttgtttggcgcgggatgaaccttatgatatttcgacatggcctttgacttaaaaccgaaagttgagctgaggctttagaccgagactcgagactggcaccaaaaaaaccagctgccctgactcgagaccagagacaaacaccgttggcataatattaggcctaaatgatttcgggtattttttgtatttcctatttcgatttaaatccgttgctcgccttcccggccttagggtacgcccatttaaaattattttcaattatttaatttagttttaaaatatttttaatgtataattgatttaacatatttaataatttctctttgctctctttgctttaattaattaatttctctttgctttaattaattattttctcattgcttttcgtcgtaaacggaagcattcacatgaaaaaattctcaacattttaaaattattcaccaacaaaacaaaatcttacttttacttctctaaaaaatgattgcattttggcataattttggttttctttcttcaaaattgcaaaaaacatttgattttattttaaagcaaaaaaaaagaaaa

SEQ ID NO: 63495 - DNA, 1706 bp, Heterodera glycines
  Genomic contig location: Contig_ID=SeqID_6984; Location=3051..4756; Strand=+
  SCN-specific regions: Sequence locations=1-1003,1025-1128,1150 -1219,1245-1343,1366-1380,1403-1451,1473-1588,1634-1706
atggaaattgtgaacaaatttatggaaatgaaaaaccgattttatgagagtggggaaaagcgaccgtttcgccaagtggacaaagaaatagcggacaaattggacgtaaacgcacggacaatttacaagtggaaaaagagattcggattgagtaagcctgcgacttaattaaggtaattaattactaaaaattaagaattgggagagaacagaaaaattggaattttgaaaaagatcaacgaactgaaaagcaaaaacccacagataacattggcacaaattgagaaagaattgccaacccttggatattatagtaagttgttcaggctttttattttcggcattttttaatttttaagcttaagtttaaattttaacgtaaatatgtgctgattttcataattatttcattaaaaatcccaattatggtaattttggagaaaattcgtcaaaaggtttcaaattttctaactatcggcatggcgtcgttggtccctccgccaccaaaaatttttgagagaaaaacgcaccgaagattttttaaactatgaattaaagtaattcacaaaaaaaggaattcaaagttacttccttccattgtcaaatttattaaaaaggagggttgcgcctcggggaagaaattttcagggagcggcgggaggggggggggggggggagcccaaaattgtcgaggaccggagaagccgatcggagaatgaccccttttaagcagattctgcattctctgattcaaaatcattgaataatgccagtaaaaccctgtccaaattggctttcactgtcaaaattatctattaaaaaaaattactaaaatttcttttaggaaaagactttaaagaatcttataaacaattggaaacaattagaaaatttgataaaattgtggcaaaaaagttaagtccgctttcatttgaagagaaaaccaaaattgctgcagaattgggcgtgaaaatcagaacactttatgattggaaaaagaaattaggaattaatggtctgttttaaggggtattggaaattcatgaattttgtaaaaaaacggacgagggccatgaaaaaactgggacatcgggaccaatcccggtgtcgggatttaaacgataaaagttaaaattaaaaattaatattgccaaatttagaagagagaggctacggaaaaaaggaaaaaatagcaattttaaaacggtatgatcagatcaaaaaagaaaacccacaaaagacaatgggacaaattgttaaggaaatgcaagtcagccaaagcatgttttatttgtggagaaaagaattcaaagtcaaaataaaacgtaagtaattaaggaaggaattaaaaatatttaaatttatcggcacaaaatcctcaaaattaattaataatatttaagcacattttttatctgaggatgaaaaacggaaaatagtggcaaaattcaacaaaataaaggaaataaagggacagtcaattaaacgagaagacaaaaagaaaattgccaagcgattgggcttttcactgaatgcaattttacgttggaaaaaccaattcggtcaaaaaggtcgtttaattgcagagaattaattaatataattgtgttttattttaattatgaaaatatttgacaatttctctaacagaaagtcgaaccttcgaattgtacgaaagaatggaattgctgaaaaagtattacaaa

SEQ ID NO: 63496 - DNA, 1536 bp, Heterodera glycines; identical to SEQ ID NO: 33422
  Genomic contig location: Contig_ID=SeqID_33422; Location=1..1536; Strand=+
  SCN-specific regions: Sequence locations=1-102,125-217,239-284,307 -363,385-529,554-695,725-775,798-892,916-1315,1339-1355,1377-1536
  Gene Ontology: Mol. function=acyl-CoA dehydrogenase activity; Cellular component=mitochondrion; Biological process=lipid metabolism

SEQ ID NO: 63497 - DNA, 555 bp, Heterodera glycines
  Genomic contig location: Contig_ID=SeqID_33423; Location=314..868; Strand=-
  SCN-specific regions: Sequence locations=1-379,407-433,455-505,527-555
atgttcaccaccgtccactacaatttcttcctacaaaaacgcgctcttcgctttaccgccgatcaattggtaggaaagagaattattgaaggaagtcaattttttgtttgacatttttttcaaaagatagttcttaaaatataaattgtgccattttaaaggggtatttttccctaaaaattcgtttacattggttttctgaatgtttgaaatttgtccatttttgggtcgatgcgtctgagctaccaaaggacaggcgcttttggctgccgttggccacttgcttggcccactcctacccaatgcttctcccattggacgccaattgctacagcgaccaaacggcgttcaaattgctcacaaaaaacataaaattgccgacggaagaggaggaggaggggaagagtgaaggaatggacgaagacgaccgaagatgaatgaaagaaaaagaagaaatacgaagtaggaaatgcaaaaaatgacggaagggattccaagtgggaagaaaaccatttgaatttttacaaattgtttgtttcatgttaaaaaaataaa

SEQ ID NO: 63498 - DNA, 743 bp, Heterodera glycines
  Genomic contig location: Contig_ID=SeqID_33424; Location=160..902; Strand=-
  SCN-specific regions: Sequence locations=1-30,53-123,201-282,353 -360,382-429,452-536,558-593,630-743
atgtggcaattaggtgttaatgatgaagccccgcaggaggatgaagaggatgtgcaccttatcaaacaggacacatcaagacttgttaagaaaaacagtaatatgcttaacaatttttaatggaaaaaaaaatcatttttaattaatatttattttattatatttaaatattgtatgttaatataaaacatttttttaaaggttgcgatactggtgagacattgaattgcacttcgacggaaagtggagatgagaaggatgaaattttgatgtaaaacaatgaattttaaaaattaaaattaattaaaaatgtatatttaaaaataattttaaatattttataaaataatttgcattgcttaaattattttagttgtttttatatcataaggttattacaacgcattaatttttagttgatcattttaatcatctcttttaaacaaacaaatttttggtattaatcaacggtaatcaatttaatataaaccggacagattttattattaatttggctgaagattgacaattctcaattcttcagctgaataatttttaatttgaatcaattatcatttggcgaagtcctatactaaataataatttaattataaaatttattttaatttgaaaaaggaaaaccgcagcaatacctattacattaagaaaaaaaataatataccattattctaattgatttgaagaaaaattttatgattgatacttcctttatgtaaaataaa

SEQ ID NO: 63499 - DNA, 280 bp, Heterodera glycines
  Genomic contig location: Contig_ID=SeqID_33425; Location=21..300; Strand=+
  SCN-specific regions: Sequence locations=1-166,188-280
aaatttttaaaaattttccagcaaataatggaaatttttttcgaattccccccccaaacgaaaattaaaaagtttaataggcaattttcgtaacaaataacactctaatttccaaaaattttcccggcggcgcctatcggcaccgccggacctaccttttccactatttttacaagttttttgccttaaaacggccaaaatttggtcatttttagtgaaaaagtgcagttgttacccagcagtgaaaaaaaaagttattggttaaatagcaaaaaaaaaa

SEQ ID NO: 63500 - DNA, 892 bp, Heterodera glycines
  Genomic contig location: Contig_ID=SeqID_33426; Location=48..939; Strand=+
  SCN-specific regions: Sequence locations=1-892
gcggcaaattatggcattgtgttggactccctcccaccgctcgatgactactaccccggcggacacttccctgaggagctaaagaagccggagcagtggtacgaggagaaccgcaacacgccgtttgacctgcgcgaagtcattgcggattactgcaaagcaggtaaaaattgggcatcaaaaaaaaatatgcaaattttcttcagatgtccaaattttggcccatggaatggtcaaaatgcggcagttgttcgccgctgcaactagccaggagctgaccgactccatcaccatcccgtcagcctgcatgaagttcttcgtggtcttgtcgcacgtcggaaaagagagggtggccatcatcccccatcttgggtacgagaagcgcgggaagcagagtgccatcgctcgcaagtacctcaagtggcgtgccgaggaagagatgcgcgacaacggatggactcttcgccacgtggaaagccctggcggcgaatacaatcacggcaacttcctgctggacggcatgctggaggagcggatcggcgaagacaagaatttggcgatcgaagtgaatgggtaaggaaacacctgccaaacttatgctaattttctcccattcagatgctattggcacgcgtgcccgcactgcttccccgaggacgacgcaattgttggcggtggagagacggccggtgccattcgagcgagggatgagaagaggatccggcagattgcgcgggacttcgaggtggagatcgtgtgggagtgccagctcggacgaatgctggaagtggacccgcagatgaaggcattcttcgacaacacgcccgattccggcccgattgacttccatgacgcctttttcggaggtcattttttcccaatttttggttaa

SEQ ID NO: 63501 - DNA, 996 bp, Heterodera glycines
  misc_feature (943)..(943): n is a, c, g, or t
  Genomic contig location: Contig_ID=SeqID_33431; Location=424..1419; Strand=+
  SCN-specific regions: Sequence locations=1-618,641-722,746-877,912 -970,992-996
atgaaaaatttgaaacttatggcacaaattcccaatagttttttttcgcgaaaaacctggataaatgctttcccccataggcaatgcaaaattacactgtataatgttttggtgacaaaaacatacatgcaaaaaaggcgaggaaatgatttgccaaaagaaacaattggtaaaccgaaggatgtgccaaaatccaaaattgaaaaaccattcaatatgccaaaaacaataattgccaaaccgaatgatgtgccaaaacagaaaaatgccaaaaagaaagcatcgaaaaatgatggggggcaaaagaaagaaaaacttgttgttagccgaccatcatcacccaatggagtgccaattgagtttgaattggaaatcaatgaatacactaatggacaattgatcaacaaaaacactatttctggacaatgggacaaaaggaatgagaaaatcattgatgaaatgttaaaaaataaaaaagttggtgtcacacaattggggcccattcagtcaaaagcaggtatattagcacaaagatgaaattcagaaaagccgcgtatctcaggcaatatcatataaccagatctaggattttgccgcttaaatggcaatctttgaaagttttttataaatttttatttaagccacaaatgagggtaaaacctcttatattggggcaaaggtaattaccgaaaaataatatttatatttccatgtttcacgggaaaaattattttttaaattataactgattgataaactttttagacattttgccattaaaaccaggacagttcgaaactgaattccattttttctctgataaccatgcaaacagtcagcaatcaactgttgcatcaacatcgaaaaatcaagtcagaaatttttaattaattaaaaaaataattattttagaaatctaaaaaagtgcctgagcgtctattanaacattccaagtcaatggccgaatttagaaacacgcaaaactcaaatgagtca

SEQ ID NO: 63502 - DNA, 322 bp, Heterodera glycines
  Genomic contig location: Contig_ID=SeqID_6985; Location=35..356; Strand=-
  SCN-specific regions: Sequence locations=1-322
atggacttccgtccggtgaggtcaattgaggatacggcgtggccaatgtttggtctggcccggtcatcatgtgctgcaggtgcgcatcgtcgccacgtattttgtccccccgcgtcggttggtcttccgccgttggcgccgtttccgtcgacggtgtctccgtgctattgacgccaacgatgaaatgagcaccgcccgcgttaatgggcaccaattgggcgtcctggccgcgcaccggcaaaacagtgaccgtaccggaagagatgctgatgccgggcagtggagtaccgttactgtaggaagttacggtgctggagaaacg

SEQ ID NO: 63503 - DNA, 1161 bp, Heterodera glycines
  Genomic contig location: Contig_ID=SeqID_6985; Location=2393..3553; Strand=-
  SCN-specific regions: Sequence locations=1-487,509-1161
atggcagatgaggatgggaagcgagtttctcgctctgaaaacgggcaacacattaaaaaaatgtttgtgaactcggccttggggtcatccgtcatgattgaaaataaaagtggtggcgataatgagccaaattatgaagagagtgaggtgagaattgaggtcttggacaaaacaactaagacggccttagggtcaccagtcatgcatagcagagctaatttagctataaacaacatgacaatagagaatattgaggacattaatagcttttttcacaacctttgaaaattattttgctcgaacatatcagattttgggaactttgacagaccctctgttatgggccatgttacagcccaaatctctgagtgaatcagagaatagaaaatctgaaactatttcaacggatgacaaatttattgttattcaaacagggataaattggaccttggcatcacgattaactgaagtgagttcttggcctcattttttgcttatgaaaaagaaatcacaatcagatgaatattttcgattgggtgaaatcattgatataaaagaatttgtggaaaatgagtcaaattctcttaatgcttctaacaaatttgcgacaaattttaccttgctcccagaggatggctgtgggtcaattgaaagaattctaaaatgcgaaaaaaccggcaaaataattgccgtcgatgtctgttttgatgtaggggagtcactacaacgtttctattcacaccaatttggatcagatgttgatgtttcagcaattgttgatgatgcttgggtagaacttattaccttaggttttcgaattcaaggctttgaagacagtctgtctactttaactggtctaaatacgttaagtgataaaccaacccaaatagtacctcaccaatacattggaaccagcattgatttagttatcaagattgtcagacaaattgatccagtagaggaggattaccgtcaatggtgtgagtttctcgcaaaacaacggtctacttccaaccatgatcaagactaccatcaccgaaggtagaattatattgagaacaaaagtaccctcgggtcaccagtcatgtgattttgttccctaattattaaaaatttgcagcatttaaaaacttattttaaattctttcttattaaaataaa

SEQ ID NO: 63504 - DNA, 325 bp, Heterodera glycines
  Genomic contig location: Contig_ID=SeqID_6985; Location=4129..4453; Strand=+
  SCN-specific regions: Sequence locations=1-98,120-169,192-277,299-325
atgtatttgtctatctttattagtagaaagtgtaaggattaattctttttgttttttgagcaccttatttggatggttataagtcggacgagaatcaaccgaagaaatatttgggagatgattcaatagtcctaattctgctctttcgaatgagcatttatttgttcaaaactattaaaatttcagagactagttaagtttttgtaacagtaacgaaatgagaggacaaaaaacaaatacagaaaatgtttaaaaaatatgaaacatttaattttaattttgtttggtatttattaattgcaaataatgattgtatataaattga

SEQ ID NO: 63505 - DNA, 460 bp, Heterodera glycines
  Genomic contig location: Contig_ID=SeqID_33432; Location=227..686; Strand=+
  SCN-specific regions: Sequence locations=1-87,114-252,284-460
atgcccctcgctaccgtattacctggcgagaagaaggtggacgtgaagtggtcagccattgcggacaaaaagtgctgcggatggatgacaggaggaagaggtggaggagcgggaggaagaagtgccgttggtgaagcggaagaaatgatgccgtcgccgacaacggcggtgccggaagatgaaacggatttttgtggttggagaggtgaagcggctgcggatgaatagtggggcggacggggaggagacactgtggcggaagaggaggaggaggagggacagcatgaagaggctaccaagtcagcggaggacatggcatgccaaacaaaaagtgaatgaaaaagtcaggcaaattgtactaaatggcacaaaaaagtcagtcagtctcgagccgaaactctcgaaccccgccccggccctccttactctcgacaaacgacggggacaaaaaacggggcaa

SEQ ID NO: 63506 - DNA, 555 bp, Heterodera glycines
  Genomic contig location: Contig_ID=SeqID_33434; Location=138..692; Strand=+
  SCN-specific regions: Sequence locations=1-18,45-162,184-555
atggtacaataaatatcctttcatttaaaaacaaattaatttttgtctaaaactttatgagtaatttatttgttaaaatggtaaaaaaaaataatttgtgataatggtaattgactttggcataaaaatcaaaaattaaaattaaaaagaggtatccaaacaattatttaatttatttattcaactaaaaaagtttggcacgttataactcgccactcgggctcattcagcaaaaaataaaaacatttggaaatccggcaacattttactattttttttttctttgcataagtttttattagaattttctaacgacacgaatttgcctacgcaatgtaattgaaaacgaagaatcgtttgtcgatcaagctgactgtaatacgggtacggctgccgacgactgggttcgtgatccgattagtgctaactgtcgaaatcgtccacagtcgaattctttgatagtaaatacataggtgtttaaccatcattgacctcttgaaaagcagctaaatgatgataataagcatagttgggagctctggattttctatttaa

SEQ ID NO: 63507 - DNA, 549 bp, Heterodera glycines
  Genomic contig location: Contig_ID=SeqID_33437; Location=419..967; Strand=+
  SCN-specific regions: Sequence locations=1-90,112-302,324-452,474 -487,523-549
atgtcggacaatccgaaggacgtggagaaggaaatggaaaaagcgatgtaataattcaaattatttaaatttccatgctaatcattttgctttcccttttcagcttcatcgctgccgactgttggctcaaagtgttcgatttgcttccacgctctcagcttggcctcggaattgcgctgatcagccgccgatttgactatttcgttgaagaacacttcaaaacgcgcaaatggaaattgggcgaaacaatttatgctatggaaattgggcaaaaaatttagctttccgtgcgccgttttgtcaaattttttttaaattattaagtgtaggaacaaaaccgaaaagtacctgatttatgcccgaccgtaaacactttctaaccatttctttctttgcttcctttggattgtgcgacatttttttttttgctggtaattaacgggaatcccgccgggaacgggaaaaaattttttacgaaaaaatcatgttttttttctaaaattttactttattttattttttcaagtgaaaatactaattttttaaaca

SEQ ID NO: 63508 - DNA, 108 bp, Heterodera glycines
  Genomic contig location: Contig_ID=SeqID_33438; Location=50..157; Strand=-
  SCN-specific regions: Sequence locations=1-108
atgcttcgcactgctactgtccatgattggccagaatatccggtcaggggcattctgctggacacttcgcgacactatctgaacaaaaatgtcattttgcgacaaatt

SEQ ID NO: 63509 - DNA, 4003 bp, Heterodera glycines
  Genomic contig location: Contig_ID=SeqID_6988; Location=48..4050; Strand=-
  SCN-specific regions: Sequence locations=1-9,31-111,459-569,591 -913,960-1063,1090-1110,1160-1179,1201-1602,1653-1735,1822-2019,2113 -2216,2278-2896,2965-3024,3046-3260,3315-3571,3594-3744,3846 -3885,3907-4003
atgtacaagctgaaaacgggaaggcatttcgagaagaatgttgcggcacacattgcttctctgcaagcggcacaagcagcaaacggaggcgaagaaaaagcagtaaaatgtttttatttacaataaaaaaaattatttttttactttttaataaagttttatataataaaaaataaagtgtttataaaagcaatttttttaattttatttcaatttataaattatttttctatttataataaatttttatttgtatatgtcattatttaaattatttcattaattaaatttacaaaaccccttaaattataatttaaaaaattttttgttgtaattttcattggtaaattattttttcaatttatatatattttatttttattgttgtttataattatttcattaattaaatttacaaaatgccattaaattctaatttaaaaaaatatttttttttaccattttttcccatttttctcagctgatcgttcccgtggttagccacgcggttgcggacgtggagctgtgcttggactcgcgccagctgcttgttgccagccgttctggccaagtcacactgttcctttttgccaagaccgaatgttgccaagaaattgcggtaaatcccggatttttcaaaattttttttatacaaaatgccaaatgaaaatttttgctaaacaattttttttcatacagacattggtgttgccacagttgtgccgttccaccatttcaacaacttttttacccacaacagcaccaccatcgcccaagaatggtggccaagaagtgccaaagggtaatcaaaaaattaattaggcattaattacgctattaaaaaatcattaaattgtttcggtcatttaattaaggatatatctagtcctccgcccgcgtattatttcctccgaaatttaaaaaaattttctaatataaatctttcaaaaaaaattaaagaagcttttgaagaaaatatttttgaaaattttcttgcgtttttcgaaattttatgatgaaattactgttttttcaaaaattttttccaaaaaaccaacggatgaaatttcttataaaaatttctaagttttttgccggaaaattttcaagtttaaaactttaataaattttttatgaatagttgattaataaattaattgtcactttgccacaggcaatttaattaatcaattaattagtgaacattaagccgtgtccgccaccggtcgcctcaagcgacaatcgcatgctgccgacggcacagcaatgccatcggcgacgacggcgccagcggccgaacaatcggtgccatcgccgccgcttccagcgccgtcgtcttctcgcaattcctcccactccacggacacatcgttgggctcccactgcgcggaacttatcccgctgaaagtgcgcggcggcgcattgcgccggcccgctggtgggtgccatgccgaaataaaaaaaatgattgaaaatgaatttccaatcatagatggacaggggggggggggggttgggtaaatttcgtaaatcatatagagaggtccgcggcattgcgtaaaattttcaacgaaaatcgtaaaagcactggtaaagaggggaaaattttttatgaaattgggaaaaagcaaaatttttcttccaaaaatttaatgaagtttaatttcgtttcaatttttaacgaaatttcttcgtttacaatttcgtaaacttttttttatgaagttggatttcgtaaatttttaaaattatagatagttaagaaaaaaaaattatgtttttttctttaaaaaattgttataatttttttaatgaaattttggcgcattctacataatatgaattttttctcgccccaggctatcagcccgagttggtgtgccaaatcccgtggatcaatggcattcgacccgagttggtcaccgcattggcactgaattccgcgcacggactcattgcactgggcaccagagttggctttgcgctaatcgatgcgcacaccgcggcacaggtcaaactaattttattaaagtggattaattaaaaaataatgtaaattaaattaaaaaattaaaaaaatatttaatttatttattaaataaaatttaaatattgaaattttgtttacctttaaagcttaatgaataagaatatataataagcaattataaatttttaaatagccttttaaataataatcattcactttctatatgtaaatttattaaaatttatatttaatatatttaaaattttaatcaaatttaaattaaaaaactccattctgtcaaggtctacgcttggtccaacgatgaactgtttggtcgtgagccaatcccttattggtcctccgcgttgaacagccaaatagacgaaatgaccatttcgccagcaacggaggttaacgcgaaggcattttttttaccaatttcccaatttattttaatgactttaaaaaattaattatgggtacttaagctaattaccgtgatttaattgcgcgtttgactaaagctactcactgactaattacaattatatacagcactaacgctcattccttacagtatctctctccctttcacagtacacccagcaaccgtacctctctgtatctctttgtctttcctccatttctcctcctttttcccactttgattataccgtactatctttactgaccgcatacaattgacagtatacttaccgtaaccgccgtctttttcgatactcacacaccatacataatacaaaacatacttactgaatatacaaataccataacaacaataatagctcgccccgtccgtgtcgtccaccgccaactcgacgccgcgcaagcggcacccgctcgcgcgcgcgctgtccatccgctcgccatgcatcaaagtgagtagtgtgtgtgtgtgtgtgtgtgtgtgtgtgtgtgtgtgtgtgtgtgtgtgtgtgtgtgtgtgtgcgcgtttgctgtgctcgcgttcaccgtatttcggcaaattgcttattgtataccgtaacgggaagttccctgtactgtgtctcctcggcactcgataatgacgtcgttattttgctgctcccttgcacgttcaaatgcaggcataccgtagtatattcattttggttatggtagaacgagaatacgcattttacaatgccaacggttgcggcggcattttgtctatccaattcggcacatggatattaattaaaattaccctctgcctgcaaaaattcttatgagtttgcagtttatttgcttttaaaatagttttataaaattaataactttttttttatttctaaataattatgcaaataaagtaacattttctctttacctatttgttcttgattttaatatttaattcttgttcaataccaattttattttcacctaattcacttttattacaccacttcagttttaattactaacaatcaaattatatatatttccagtttatcattccaataatcactcacatcacctttgttcaccgagaacggtctgatcagtttggtttggtttgaaaagctactgattaatcatcggttctgatcactcatttggatcattttatttttgaaattgctactcattaaaaaaaacttttttttttccaaattaatcactccacttcttttgactaatttattttcttctcctgcttatcaggggcctttgctcgtcttgttataattgttgcacccgggtttaactttatcgaggcagggttaaggaaattaaattagttttgattattaaaaaggtttttaatttattttaatttattgttagaaattaattttattaatatacaaaaaattaaataattaattttgggtaatttcacataaatagcttattaatttccggaatatatataaatttcaggaatccagaattccttcttttatatacgggtctggaaattccgtcttctactatcataaatttccgggatgtgcaatttcaaccttaaattaccggaatccataa

SEQ ID NO: 63510 - DNA, 383 bp, Heterodera glycines
  Genomic contig location: Contig_ID=SeqID_33443; Location=350..732; Strand=+
  SCN-specific regions: Sequence locations=1-20,42-275,297-383
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccctttgcttctcccagttttaagtcttggatttgtcaa

SEQ ID NO: 63511 - DNA, 952 bp, Heterodera glycines; identical to SEQ ID NO: 33444
  Genomic contig location: Contig_ID=SeqID_33444; Location=1..952; Strand=+
  SCN-specific regions: Sequence locations=1-421,443-791,813-932
  Gene Ontology: Mol. function=protein binding; Cellular component =synaptic vesicle; Biological process=regulation of protein activity, epigenetic

SEQ ID NO: 63512 - DNA, 656 bp, Heterodera glycines
  Genomic contig location: Contig_ID=SeqID_33448; Location=1..656; Strand=-
  SCN-specific regions: Sequence locations=1-338,360-572,598-635
cctcttcagggagttcaacagttccttggtccgcgtgatgaccttttcgaccacttacgtcgaggtggaggtggtccgtgccggcctttccatgctgccatttctgatggtcagtgagtactggaaaaaaaattgaaaaaattcaggattcaaaaatttgtgacttaaattccgggaacttttgactttcggcgtgcctaaccctgcctagaaacattttttttttgttaatttttgtatttttttccacttttctccatttttgtgctctcgcactcgcttttctctgcacctctcttttcatccatctctcgcttcttttccccattagtctctccaattttccccactatttctttcccttcacatcattactctttacactccctgctaattgaccgtaatgggccaattcattcattaattatactaattaattgaatttccaaggtcggttttgccatcatggccacctgcacttctgtgtccgtgctgctctcggctgtttattggcgccaatggcacgtgcaaaagttggcacttgcgctgatggcatgcgtgtgcccattcatggcgtgcggcaccgcgttgggcctcctgtttttggccggtgtccgttatgggtaggaaattcgtaaaaattttaaaaattaaaa

SEQ ID NO: 63513 - DNA, 343 bp, Heterodera glycines
  Genomic contig location: Contig_ID=SeqID_33449; Location=249..591; Strand=-
  SCN-specific regions: Sequence locations=1-343
atgatgatgaagcaagtgctgaaggcaaagggcaagcaggagaaggacgtcattccgtaagcataaaaaatgaaggggccgggggaaggacgggtgggcgaagagcatttggagtttcattttgaattaggattctgattttgaatttttatttgggaattgtctcggcacttttgctgacggaacattcactgctttcagatggcagaaaactgtgcaaaagattggcaacactgaaaaaagacgaaaggaaatcaaatggaatttggaggaggaatcggtggaatcgctggaccaattgacctaccggggactgaaaaggcagggcgcaattgaagacaat

SEQ ID NO: 63514 - DNA, 102 bp, Heterodera glycines
  Genomic contig location: Contig_ID=SeqID_33450; Location=36..137; Strand=-
  SCN-specific regions: Sequence locations=1-102
atgtccttccgggctcgtaaagtcccgttgaaaaaattggaacaaaaagtgccgaagtgttctttggaattttatttcgccgattcggcactttcttgctca

SEQ ID NO: 63515 - DNA, 709 bp, Heterodera glycines
  Genomic contig location: Contig_ID=SeqID_6989; Location=1221..1929; Strand=+
  SCN-specific regions: Sequence locations=1-258,284-709
atgtttgcgttttatttgtcaaaatgcggaacaattgtttgattctgaggaattcttgcaaattgatcagaatttgttgtgtgaaatatttggccgtgatcagttggtgatcagcaatgaatttggcatttggaaagctgtaatttgaattgaaagaatattacataaaatactcataatttaaatattattaaggcactccgttgggccgacgaaaagtgccgtcaaaatgccatcgaatgttcctctgaaaatcgtcgtgctgcgcttggcccggcactgttcaaaattcgtttccctctcatcccatcagatgcatttgtgaagcaaatcggtagaaatttaattgtttttcgacctttgcgcttttttgcagttccttctggtgttttgtccaatgaagaatttgtcggtgtttatcagtttcattgccatccgaatttttgtggtgtacccggactaaacccactgaaatttccatggaacggacgaattttcgattggaacacagccaaaggcaacagaggaacattgacgatggaaattgggagattttctgaatttacacaaaaggaagtggggagtaaatgctttagtgattatgaaatacgaataaatggatttggatggaaaatattggcaggaataaagccgaaaagcaatcaaaaatggctgggcttttacctttgttgcaccgctccaaaagaag

SEQ ID NO: 63516 - DNA, 747 bp, Heterodera glycines
  Genomic contig location: Contig_ID=SeqID_6991; Location=376..1122; Strand=+
  SCN-specific regions: Sequence locations=24-119,146-235,270-332,364 -374,396-478,500-651,675-697,719-747
atgacttttaaaataaacttttcaaggtaaataataaaagaaagcatttttgcgatgcaaaatcgattaaaaaattgattaaaatttagcataaaaagtatgaccaacacaaaagctagaaaaaattaattaattaattatatttcatatgattggtcaaatggaagattttgtaaataattataaattaccttattcgattaattcaacgatttaaaaaattttggttgagaaatttacagttaaaaattttattgaaattttttaaaggcataattcacattaataattgaaaaccatggatgggctggccaggtcaggaaagagaatttaatttgtttaaatttttaaaagtgatgaaaacatggaaattttcggtcacactctgaatttttgccactattttgctatccccccaccccgagtttaggcctctattttgggatttttcgacctaaaaaatcttgcaaagattttatttaagtcatattagttttttaccagtttctattggatattttttgttcttaagaaataatttgaaaattacagattacgtattatggaaaaccttggcggattacggatttccgtaactgaaaatacatttacgccggccccattcaataatattaatggaaaaaaagttacgaagaaaaaagttcattttcaattttttgatacccggagaaattgggcaaaaagggtagtttaaaaacgaaacatttgtaaaagtattaaaactta

SEQ ID NO: 63517 - DNA, 769 bp, Heterodera glycines
  Genomic contig location: Contig_ID=SeqID_33452; Location=101..869; Strand=+
  SCN-specific regions: Sequence locations=1-769
  Gene Ontology: Mol. function=extracellular matrix structural constituent; Cellular component=extracellular matrix
ttgggcctaatcaattggagcgctttgccttcgatgttcaagcgcaacagtgcgtgccgttcgcttatcgcgggctgaagggcaaccgaaacaattttctgagccaagaggagtgtgaggtggcatgcctgccaaattcctgcccttccggtgagactgcaggaccaaaacaacagtgcctttacgctgatcctttcccatttatgcactgtgaatcctatccatttggtcggttttaggaagtccttttgtgggggccgatggacgggcccaaagctgcgcagtaagcacggcgatgagcacatgtcccaacggttattggtgccacgttggggcgaatgctgccacgacaatgtgttgccctgagggtatcggccgtttgaagtgccgccaccccaaagtgttttgtttagcaaatgccagtccctgccaattgccaatgtccacgggggagggaccgttccgattggatcgcttttacttcgatttgggctccaaaagttgcaaatcgttcatttacaagggactgaagggcaaccagaacaacttcctctctttggtgctttgctcctttcgttcgttttcgcttttccattttctgctttagcgcgcgtgtcagctcagctgtctccccctcgacagttcgtccgtccaattggcattgccaaatggcatttgccaatgctttgctttccttcagatccgtgcattggtcagccggccaaatcgaccagtgggccaagtgtttttctgctcggcttccatcgcg

SEQ ID NO: 63518 - DNA, 186 bp, Heterodera glycines
  Genomic contig location: Contig_ID=SeqID_33454; Location=256..441; Strand=-
  SCN-specific regions: Sequence locations=1-61,83-186
atgatttatatcaaacaattcctcttgacaggtaaattatgaatcataaagaattttttttgacaaaaatgaaattaacataagttttggttccacaaaacctaatgaaaagaattgatgaaaaataaaaaaaacacatataaatcattttcaggtcgctttaccgaatttttttgttgtagttaa

SEQ ID NO: 63519 - DNA, 460 bp, Heterodera glycines
  Genomic contig location: Contig_ID=SeqID_33456; Location=887..1346; Strand=+
  SCN-specific regions: Sequence locations=1-58,109-120,280-297,411-460
  Gene Ontology: Mol. function=protein binding; Cellular component =axoneme; Biological process=N-linked glycosylation
atgtcggggttcggggtcggggcggggtcggggttgcaaccctagattaaattaccagattttaattttgtaaattaaaaattgttttaaaaggttttaaatttaaatgttgagagagacagaggaacagaaaatggagaaagatgaagagaaagaagaatataaagaagaaaataaagaggaagggaagagaaagatgaagaaaaatagtgaggaagagggacagaaaggggaagagagagagaggggggaagagaacgaggaaaagagagggagagaagaacaaaataatgatgaagagagagaggaacagaaagaaacgggaagaggaaaaggggatgatggaagaaaaaagaggaagaggaaagaaagggaagggggaacagaaagtgacaaacagaagaagagggcacaactaaattattctcctaatttccttcctattagtagaatagattag

SEQ ID NO: 63520 - DNA, 255 bp, Heterodera glycines
  Genomic contig location: Contig_ID=SeqID_33457; Location=119..373; Strand=-
  SCN-specific regions: Sequence locations=1-67,127-255
atgtctgatgctgatcattttaatgcgcacgaatctttcaacgacacaagtaaaaatcacacaattaaataaattaattcatttatctaattaattaattgcttaattaattaattgcctaattaagtgtggccaggcagcattgggggcggcgatttggtggaaaaaagtgccattccgtggtggaaaagaatggaattttggcgcaacagtttgatcattttgctcattctattgtttggacttatttttttg

SEQ ID NO: 63521 - DNA, 141 bp, Heterodera glycines
  Genomic contig location: Contig_ID=SeqID_33460; Location=174..314; Strand=-
  SCN-specific regions: Sequence locations=1-141
atgacaaaacaacgaatggtcgtgaacatttacaaaagtaaatatgcgaagagaaaaacggaagagatttctttgataagccaagtgaaggaaattgaagagattgagcggttgaccttcgacgagaataaatccattttt

SEQ ID NO: 63522 - DNA, 551 bp, Heterodera glycines
  Genomic contig location: Contig_ID=SeqID_33461; Location=825..1375; Strand=+
  SCN-specific regions: Sequence locations=1-24,58-111,133-551
atgcattcgatttttataaaaacgtttccttatttatttaattttaaacaatattgtacctctcctaacaatgttgtaccacttctaatcacagttgtaccacttctaatcacagttgcacctcttctaatcactgctgtacctcttctaatcacagttgtatctcttctaatcacttttgtacctcttctaatcacttttgtacctcttctaatcacttttgtacctcttctaatcagtgttgtacctcttctaatcactcttctaatcgctgttgtacctcttctatttactgttgtacctcttctaatcactgttgtacctcttctaatcacagttgtacctctttttatcacagttgtacctctttttatcacagttgtacctcttctaatcactgttgtacctcttctaattccagtgaatcccttcacagtctatgtagaaaatctcctaaagagtcaagtgctttttcccactaaatatccaacgactcacgcaccccctatatactatatatgacatattgacatggagtttcgattctcaaa

SEQ ID NO: 63523 - DNA, 1037 bp, Heterodera glycines; identical to SEQ ID NO: 6992
  misc_feature (15)..(15): n is a, c, g, or t
  Genomic contig location: Contig_ID=SeqID_6992; Location=1..1037; Strand=+
  SCN-specific regions: Sequence locations=1-82,104-292,315-461,485 -931,954-1037
  Gene Ontology: Mol. function=oxidoreductase activity; Cellular component=integral to membrane; Biological process=metabolism

SEQ ID NO: 63524 - DNA, 845 bp, Heterodera glycines
  Genomic contig location: Contig_ID=SeqID_6994; Location=196..1040; Strand=-
  SCN-specific regions: Sequence locations=1-403,439-845
atggctgaaacagatgccattgcaattttatgtgacccagacattaagctcaatgcgggtgtcggaagggcaatcagaaacacaggtggtcaggacttcatggttcgttttttgaacaacctttcaagaaataaactggatataatattcatgaacatgttttagttctttattttgatgtttagaattctttaaacgaggagaaacgcaaacagcgtggttcacgtgtgatctctgttcctatttcaagtggaattcgctctgcttctgtgctgttggctcccgtttctggcatggaccgtcattctctcgaccaagtttattctgcaatcatccaaaaagctttggaccttcggattgagagtctttcgatgcctctgcttggtacggtttttattatcatatttttcaattcattaaatttaggaaatttattttcctcacttgataccgcttcaaattatttgtgggcttgccttcagcagttttcttcatttggtcgtttaaaggtaaatggaaattattttcatttagccaactccacattttagaaaattcaaatcgtggacaccaatgatttccatatgcgatctcttcacaaattcatcattgccaaattgcgtgctcaatcacaactccaaaatggttcatctgcttcaagtaactcggaaaacaatcaatcggacgacagtcggctgacagtgagcacaccaaccgggaacaccgacagcgaacagtcatttcgcttggttggctcggggacttcgcaatcgccaattgaacttttctgttccactggtgccggacccggacgcaatcttcgtgagttttatttgattaattaa

SEQ ID NO: 63525 - DNA, 398 bp, Heterodera glycines
  misc_feature (341)..(341): n is a, c, g, or t
  misc_feature (365)..(365): n is a, c, g, or t
  misc_feature (388)..(388): n is a, c, g, or t
  Genomic contig location: Contig_ID=SeqID_6994; Location=2009..2406; Strand=+
  SCN-specific regions: Sequence locations=1-398
atgtcatctgcaaaaaataaaaaatccattgagaatgtaatcatcagtgttcggaatgagtttggttatctgaaccagctctgggacactgtttacatggacttgccaacccgggaattccgcgtggaagaagcctgcgaatttatgttcaatctcctacaggtgatcagaaaatcagaagagaaagtaagtacattaagaccttcatctacgtctaaatatatttgcaattttaggtggtccgtaatattgtttctgacttggaaatccgccgagaagcagtgaccaatctgaggaaatttttggggttgccttctttcgacgagtcgcttttcccgccncagtcgatcgcattggtacctcanattttttctaacattctcactgnatttttttag

SEQ ID NO: 63526 - DNA, 367 bp, Heterodera glycines
  Genomic contig location: Contig_ID=SeqID_33466; Location=846..1212; Strand=-
  SCN-specific regions: Sequence locations=1-124,148-367
atgattgctgaacccgaagtgccttctgcgaccaatgttgataacgatgggaatggtgatgaacaaacaaaaaacgaccaacctgtcatttacaggtacaaaaataatttaaattagtctaattgcataataatttttaattttagcccagatgatcaaccaattgagcttcaattttcttaattgatgaaagaatttcaaaaactcgcccaatattggttcaattattttttatgcatctaaattttaatatttttttcaaattgtggtagttaattcattaatctttgaagatgatatgtgatcaatgaatgctaatttaatcagtcaaacttttcctttactttatttcattattttgaataaa

SEQ ID NO: 63527 - DNA, 524 bp, Heterodera glycines
  Genomic contig location: Contig_ID=SeqID_6996; Location=1..524; Strand=+
  SCN-specific regions: Sequence locations=1-524
ctggttttgaattgattcgaaacggaacgaccagcatcaaggtgcaatttaatgagcctataaaggacggcgggtatgagatgatcgttctgggggaatttgattcgattttatctattaatgctaatcgtgtgctcagtagcgacggaagcatatgatgaattcttatgagattgaaatatttctatccaaacatccgacaacccgaaaatattttatcgggtttttgcttccgacaagatgccaaaattgaaggacaggcattttccgtactgttttgtggcgaatactgaccgggcgggcacgataggtgaacactgggtcgcctgttttgtaaattcgccgacagaaattgaatattttgattcattgggcgattatcccaatgaagatttaagttcataccttaacttatttgaacgaattctcattaacgaccgcatcgtccaacatcaattctcagatgcatgtggtcaattttgcatttatttcttgacacagcgctgctccggaatcccttattg

SEQ ID NO: 63528 - DNA, 2509 bp, Heterodera glycines
  Genomic contig location: Contig_ID=SeqID_6996; Location=1953..4461; Strand=-
  SCN-specific regions: Sequence locations=1-28,50-434,457-1242,1266 -1373,1395-1502,1524-1566,1588-2509
gatttggagagacatgtttattgatgccggtgaagcttgagtcgctgaaggcgacatttaatttggactgtgaggacaagccctttttcccctattattacaacaagaaagaaaattatggaatacgattggaacatctgctaccgatggaggactattcgccgggatctatgaataaggataaatttataaaattcgaaaaatggtaggaaaatagaaaaatttttgaataaaattcttttttttttcaggtacaatgagaacaaggagacacccttttatttggatgaagaattgagaaattattgccgaaacgacacggagattttattgttgtctattattgagtttaggaggatattgattaacgacattacgaaaggattcgaccccctgccgaggagttgtacgaatgcgggggttgcgatgaatatttttaaagcaatgtttttattgacggagcaattatcgattgtgccggagaagggatatgagcggtgtgatcgcgccagtgtgatggcaataaaatatttggagtggaggagcaagagagatggaattgagatacgacacgcggggaacggacgagaagttaaaattgggaattacaaattggatgggtttattgcgaataacggagctagcgacaaatgcattgaggttatgggatgttacatacacggatgtttgaattgttatgacccggcggcggaactgattggaggaaggacagcccaggaattgaacgatgagtctcaggagagattagtggagctacggaagactttggatgtcgaagaagtttgggtatgtttatttgacatttgaatttataaattctactttttaggggtgtcaaattgagaaggaattgaaaaaggatgaggaaatgagggacttctttgacgacagaggaaatgagaaggggccgatgatccgaggatggcatatgagggagggaggacgggaccgatgaaattgtttgcgaaatcggatgagaagaagaaaattagtgtttatgatattgtgagtctgtatccgtcggtgaattacggtacagcttacccgattggattgccggagattattttaccgaagagtgatgagattgatgttaattggatgagaccggaggatttgaagtataatgggttgtataaagtgagggtcaacccgccgcgagggttgcgggttccggttcttcagttgaagtgcgatgagagattattgttcccgttatgttggagatgtgtgtcaaaatttaagaaggagactacgagatgtaactacaagtgcccacatgatggggcacagcggcgatacgtggcgacatatactagcgttgaattggtaagaatttatagagaaaacttttaagaaaattttgacattttcaggcaaaggcgttggaatgcggttatactgtggacagattttatagagcgtggcactacgaagaggaggcgaatgatttattcaagggatacgtgcgcttatttttgaagctgaaggaggaggcgagcggtttcccgaagggggttgagacgggggagcagaaggatatgtggagagaagagtataaggaaaaatatggaatcgacattgaattggctaaagtgaagaagaatccggggttgcggtacataagcaagttgatgctaaatagtttatgggtaagaaaattgaaaataaatttcgataggtaattttcaatttcagggaaagttttcgatgagaaattgtttgaacaagaatgcggtaattgatagggcgtcggagttttataaaatagcgtgtgaccataaaattgaattatgtgatattgttgaatattcggaagaggcgattagattgatatacagggacaaggaggactttgtgatggagcacaagtcgagcaacatagtcattagtttatggtgagttcaaaaaaattataaatttgtatataacctaattttaggacgacgagtatggcgaggttaaaattattggaattcatgagagaagcggagagccatggcggagaaatattgtacacggacacggacagtatttttgttttgcacgatagggacgtggagccgattacgacggggaaatttttgggagaaatgagtgaggaatacggtgggcatgagattgaagaatattgttgtggaggggcgaagcagtacgcgttgaagatgaaaaacaagcagacgggggagacggaatacgttatgaaaattagggggattacgttcgacgtggacaacaggaagactttgcattacgatacattcagggagatggttcttagttacgggaaaggggaggttgacccggcgttcttcgtgtacaagaatgattttgggtacgtttttcaaacatttgactcattaaaaaatcaatatttaggccgacaagggattcaaaagtggtgacaagggagaagcacaaaatgtacaggccggtctgccagaaggggataatcgatgaagaacttaatgtgatgccatttggattt

SEQ ID NO: 63529 - DNA, 111 bp, Heterodera glycines
  Genomic contig location: Contig_ID=SeqID_33473; Location=229..339; Strand=-
  SCN-specific regions: Sequence locations=1-111
tttagtgacaaaaccccaaaatagtgatttatagtgacgaaaagtgacgtccaaatgaaaaaattttaatgcagaaatgcgttttttgagctcctttcttcaaaacaattg

SEQ ID NO: 63530 - DNA, 105 bp, Heterodera glycines
  Genomic contig location: Contig_ID=SeqID_33474; Location=802..906; Strand=+
  SCN-specific regions: Sequence locations=1-11,34-105
tttattgttcgtcaataaacatttatttattgattgtcttccttaaaccctcggaccgaacaattggcgcagtcacaaaaatttggactttgctcacatcttcgg

SEQ ID NO: 63531 - DNA, 204 bp, Heterodera glycines
  Genomic contig location: Contig_ID=SeqID_33478; Location=310..513; Strand=-
  SCN-specific regions: Sequence locations=1-204
atggatttgccatttgttgaaattgacgagagaggggtcgaacggcactacagcagagcagtggtggacgaatggggcttacgccgcgcatttcgcaacgaacggcgcaaaaacggcgccaaacatgaaatggtggacaaaaagcatgaaaagttggcactaagaaatgcggccaagaacaacgaaattgcccaatatacaaag

SEQ ID NO: 63532 - DNA, 1147 bp, Heterodera glycines
  Genomic contig location: Contig_ID=SeqID_33481; Location=153..1299; Strand=-
  SCN-specific regions: Sequence locations=1-749,776-787,816-1078,1100 -1147
atgggcaccaaattgacattgtggccatacagaaccgagaaagatcagtcaatttgggatgtttttgttcgcgaaatttggccaatttttgcaccaaacattcgtcatttgggctttcacgatggcgattatttggacaaattgcgtcgtcgcacttcaccaacaattctcactgatcttgatcaattgaatgcaattgattccggttttctattcccagaaggaattgccgattttgatgtgctgaatccaactgctgcccaagcgttgaccaaatggttgcacactccgagcaaaaatggtcaaccgaagcgattgtattactttaattctccacggaatctcggatgggtcaacagcttcaaagaggtcgtctcgccagaattttcgtcaatttgtttttgttttaccaatttttgtgtttaggcattccgtcgtgccaccacttctatcagttacaaaattcgatttaatttatatttggaaccaatgccaattgaaccatttgaattggtgaacaaacggacgaaagaaaagctgacactgacgaaggagatcgacgaattcgacgtaaatgtgtgtaattggctgttgcaacggtgcccaattggggagacggcgacggtgccagcaattaaatggaaagacagcgtaaatccgagtgccaatttgaacaatgtcacttttgatctgtggagtttcgataaatccattgggtgagcagcagcaatagcatttgaattttatcgaaaaataaaatatttaattaattttaggccattgtcgccaccaacggaagaagaaaaagaagaagcggatcaaagcaacggaaatgtcatctgattaagtgtacgggaaagaataattaattgtatttgagaaatgatcgatctcaatttgttgtgcttattttctctcagaaatgcttttttaattgtttcgttccaattatataaaaatatgcttttttgttgagcaatttattaataattagggtttgtaattatatggatataaaaacgcgaaatatggccataaaatatggaccaaaaatcgcaaaatatggacagaaaatggcaagaatatggacataaattttccgaatttatgggtaaattttcaaaaaaaaattttcaaattcattaaa

SEQ ID NO: 63533 - DNA, 777 bp, Heterodera glycines
  Genomic contig location: Contig_ID=SeqID_6997; Location=981..1757; Strand=+
  SCN-specific regions: Sequence locations=1-738,764-777
atgaaactgtgcttattattctttttaattgttgaaattgaaattggagcggaaaagaaaaaagtgcaacaaaaaacatttgaagaaatatttggagaaaaatgggaagaaaaagaaaatgaacagaaaaagagagataaaatagaattgaaaatcggaaaaaaattgggcacaaatcgaaacaaaatttacaaatggatcaaagaattaggaatatacaaaaaatggcataacaaatcaaaaacggatgtacaaaaaattgaaattgttcaaaaatttaatgcaatgaaaaatgaatataaacaaaatggatgaaaatattcgacaaaagaatgggacaaaaattatgaagaaattgggaagaaaattggagtaagttatgtaacaattcaaaaatggaagaaacaatttggaatgggtgaaagattaacggagaaagaaaaaatggacaaaatgaaaatatattggaaaatgaaaagagaagacgcaaaaatgagtgacgagaaaatttcaaaaatattgaaaattcatcgactgaacattttcagatggaagaaacaatttgaagaagaattaaatgaggattaaaaaaacattgatgagataaaatatcttttcatttattcatttttttcttgtcatgatttgcattcactcaactttttgcttcctcctaatccaaggccttgtcttcatatttgttttttaatccctatattgtatagccttacatatttttgatttttcttaagataattaagattaaaaaaaggtaaa

SEQ ID NO: 63534 - DNA, 575 bp, Heterodera glycines
  Genomic contig location: Contig_ID=SeqID_6998; Location=1536..2110; Strand=-
  SCN-specific regions: Sequence locations=1-160,212-575
atgaaagcgaaaaacgaaaaaagtgtccaattaaagcttgaagtgccatcgccaccgccactaccaaacgaattcgaattaaaaaatggtaaaaaaaaatacataaattatctaaaaaatgttgtatcattaaatattttattccaatttttaaggagggatattatgaaaataataattttattttttaattagaatttttaatattttagtttttggcatcagtccaaatccattgcgccagaaaaattgtacgaaagatatacagagtcaaaatgctgacgtacaacaacagtatgacgacttagaaatgcaattcatgattcaaagtacgataggcatgctcaacgaatttgaggatgaaaatgaatgaaaaaaaagaaaaatgattttatttttgattttttgtaaacatatattttatgggttagccgacatttgcggaccgacttttgcggaccgacatttgcggaccgacttttgcggaccgacatttgcggaccgacttttgcggaccgacatttgcggaccgacttttgtggaccactatttctgggttgaactgtctaaataaa

SEQ ID NO: 63535 - DNA, 135 bp, Heterodera glycines
  Genomic contig location: Contig_ID=SeqID_33482; Location=223..357; Strand=-
  SCN-specific regions: Sequence locations=1-135
atggcgctgaattggacttttcggaaggagtgcgtcattattttcgtaatgaatttggtcaattatgtttcattgatggcaatggtgcactttttgtactcccgtagagcgaaaaaccgaaagagatactgtata

SEQ ID NO: 63536 - DNA, 345 bp, Heterodera glycines
  Genomic contig location: Contig_ID=SeqID_33482; Location=462..806; Strand=-
  SCN-specific regions: Sequence locations=1-21,50-301,323-345
atgcagaggagtacaagtaagaaaaataaatgaaaaattaaaaatttttcaatatgaaatttctagaaactgcaattttgaaattgggcgggtcgagacgggctgatccctttaaaagcaatcggttccgagtctctccgatgctgttcaaatcggattctcaaatttcccggctcggaaccagtttccatttggataaaaatttaaattcccatgtattttcaccaacagtgaaattgataaaaaaaagtctcttgccaataaaattgatgtctccgaataatggtttaaagactcaataactgttggtataaaaaaggctagcttttagtatttcttaataaa

SEQ ID NO: 63537 - DNA, 745 bp, Heterodera glycines
  Genomic contig location: Contig_ID=SeqID_33483; Location=28..772; Strand=-
  SCN-specific regions: Sequence locations=1-118,209-608,662-745
atggtcagcgaccaaaaccggatcattttcaacttgcgctcccagatgatagaccaaagagcagtcattttgcagaatttatcacggattgagagattggaatgtttcgcttcgaacgtaatttaaatttatttattggatttttttaaattttataattttattttaatataataattcaacattgttaaaattaaaactattttttccagaaccgcggtggtcgtggtaactttcgtctgcggtataacccaatggcggctgttgaactgaccctgctcgggaatcgtcttgaggacagggctcgtagacaccgggtggccataggcgcatcgacgtcagcatcaactgtgaacgaagccaacgggggcgagcatggcgagggaagtagcgcacaaaaccagaacggtgagttttaaaattgtgcataaaacaaaataatatatagaacagtcaactccgcgcacttcacgcgtgcctttgtcggccataggtattaaaataatcacatttcaatttttatcccccccccccccccaaaaaaataggtaatgttgtcgctggtcaggctgtgcagcagcctcagctgttagaaggcgaaaatggtgaatttatttaataaattaaattatataaattattttaataatattaaattttagtgccttcttttgggccaacaattgagcgccatatggagagatcgcgtcaccggttgctccatgacgagatggttcagagatcg

SEQ ID NO: 63538 - DNA, 234 bp, Heterodera glycines
  Genomic contig location: Contig_ID=SeqID_33485; Location=590..823; Strand=-
  SCN-specific regions: Sequence locations=1-234
atgccaattcagacaaaaagagaaatggagacaccaaatgagcaacagcagcagaattgtaatgaagcgattgaacttccgtgtgtaaatgaaaagggaggacaaagcaatggcagtgaacggccaaagcaaacgataaaacgaaagccgcaacaaatggccaagggggaggagtgcgatttgttgtccgacgaattcctctttgagaatggcaattccatcgacttggaatgg

SEQ ID NO: 63539 - DNA, 758 bp, Heterodera glycines; identical to SEQ ID NO: 33486
  Genomic contig location: Contig_ID=SeqID_33486; Location=1..758; Strand=+
  SCN-specific regions: Sequence locations=1-758
  Gene Ontology: Mol. function=nucleic acid binding; Cellular component= integral to membrane; Biological process=transport

SEQ ID NO: 63540 - DNA, 615 bp, Heterodera glycines
  Genomic contig location: Contig_ID=SeqID_33490; Location=104..718; Strand=-
  SCN-specific regions: Sequence locations=1-40,66-76,98-340,486-615
atgcacgtttggttattggtgagtgagtgggacgaatggcgaagaaaacaaaaaccaaagacaaacaatcgatcgatcatttgtttactattttataatagcaaatccaattatggcatttaatgatgtcattacttttttcttcaggaaaacatcgattattctgctaatggcacggagggagtacagcttgaaaatgtggaggaggtgagaaggggagggttttttcgccagaatatttatggcatttataagctaatgagcatatttgtatatgcatataataataaccatttaatgatggccaagcgaattaattggacgaatgaaagcattcagaaaaaagagcaaaacgaagaagacactcagaacagtggagaacagcagcaaagagaagaggaaaaggacgacgaaatggcggaaaacaattgggagaaaggggaggaagaagaggaaggaggaagagggaacggaggcgaagaagacccaatcgaagtgctgctcaaagacattttcggagggcacggggggacagcggcggtggcagcagaaacggcggcggaagaggagccgacaacgagcggagaaatgcaacaaaatgccaccaacgaaaag

SEQ ID NO: 63541 - DNA, 874 bp, Heterodera glycines
  Genomic contig location: Contig_ID=SeqID_7000; Location=2011..2884; Strand=+
  SCN-specific regions: Sequence locations=1-215,256-299,350-394,416 -433,466-501,524-550,582-600,624-763,796-874
atggcacggattgtgcataatgatggcacatgtaaaaattactggaataaattgaatatttaattggcttttgcatttttttaaaatccaatttactctagcaaatcttttcaaccaaatcccatcaatccctgtggacaatgaattggaatgtgcaatttgtcttgatcaaattggtgccggaatacttgcgaagcgaatgccctcgtgcgaagtaaataaatattattaaatatttttttaatattaattttagcacatctatcacgaaaattgcattataacatggtgagcatcagaaaaattataattgtaaaaaaataattttataaaatctattatttttaaacaatcgaatgtcatctctactcaaaaggttccccaattttctgaatttaatttctaagattttgaggaaatccgatggaaatggaaaattttcaaaatattataaattaattttatgggcgcaaggttcagagcatttatagaagtttaaaatagatttaattttgttgttgtttgtgatcccaagtgcgaagaattatgcttatttaaaaataaaaatttttaattttttaggtttcgagttgggcataacacttgcccaatttgtcgtcagcaaataattgaaatgccaatgatacagccccaaaatggtccatagcgaaactgtgtttgaccttgtgccaacagcgcatccagaaattagctgatgattttactataaaatattaagaaaacaaaaaaaaggtgctgagagattataaaagataataatattttattatttatgtctatatgtatttgtgatttacacaaacatcataactagggctgggatttttatgtgctaaaaatcctgaaatatgta

SEQ ID NO: 63542 - DNA, 675 bp, Heterodera glycines
  Genomic contig location: Contig_ID=SeqID_7001; Location=486..1160; Strand=-
  SCN-specific regions: Sequence locations=1-119,141-199,256-390,412 -448,470-518,565-591,628-645,668-675
atgcctggacctggacctggacctggattccatgttggacctggacctggatttcctggtcaaaaatcaaggaaaatccaggtccaggaaaaatccaggctcctcgagacctggatccaggcctggacctggattttttaaaccaattttaaaaatcaaaaaaatgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggacctagatttttttcacatttgacctggacctggatttcctggacaaaaatccaggaaaatccaggttgtcaaaaaatgacctggacctggatccaggaaaaatccaggcctggatccaggtccaggtcgaactctactgttaattcttcagtgaaaaaacaatgagctgaattaatttataattttctatatttaattaattatctaattttttagggcatattttggcattttctgatttctattttatattatataatttttttgatattatttatgtcgttttaaacactttaagcattatggatttcaaattttatatataa

SEQ ID NO: 63543 - DNA, 523 bp, Heterodera glycines
  Genomic contig location: Contig_ID=SeqID_33494; Location=165..687; Strand=+
  SCN-specific regions: Sequence locations=1-117,142-385,408-523
atgttcttatttgtaagaaatgttctgatttcgggctattgttcttactttgttcttatttgtcgcttctcagaaaaatctgtcaaatttctttaaaaatttctgattggcgtactgtttaagaaaaatattttcaattttggcattataatttctttcttgctgttatttttggctaattattttagtttttattgctttattgtctttctcttttgtttttaatttagcacctgcactacatattactaacaaatggcaccgcctaagcgcaaaagcttttttaaaagtgaatattccaatgaatttcaggggatcacaaaaagcaaaacaggaggtgaatttgcgcattacgtcccatgcaattttgacatttctttgttgtccattgaaaaagcagccattcctcaccatctgaagacggaaaaacacaaaaaagcagcgaaagctgcaaattccgctttggcaatcacggcattcatgccaagcaaatcggcacccacggaggaaggttgaattacaa

SEQ ID NO: 63544 - DNA, 594 bp, Heterodera glycines
  Genomic contig location: Contig_ID=SeqID_33498; Location=127..720; Strand=+
  SCN-specific regions: Sequence locations=1-98,120-215,240-420,442-594
atgaaaaaagaactcagtgtgaatggggataagcgaccgtatggcgagaaatataaagaaatatgcgcgaaacttggcgcaagttcacgttcaatttataaatggaaaaggaaatttggctttagtaagttgaaaaattagggccttaattttagtaaataaaaagtcataaaaatgcgtataaaataggaaaatcttatgaattttaatttgaattcaaatcatgcagaggaaccaacaaaattaattcactgaccagtcatttttcattcctacacatcagggatgtgccgagccagacaaaatccgattccgattaaatcgccgattccgattatggccaaaaatccgatacggttttaaaaccgattacgattatggcccaaaatccgattaattgcgattccgattacgattccgatttttttaaaataattttttcccaaaaattttattcataatcaaaatcataaattttaagattgtgatgcaaaaataaaagtttgtccacattctgaggcaataaacgttttctcagatctgtcacaatcaacccagcggtggagaaaagccgttcgctttcagtcgatgtag

SEQ ID NO: 63545 - DNA, 308 bp, Heterodera glycines; identical to SEQ ID NO: 54826
  Genomic contig location: Contig_ID=SeqID_33499; Location=931..1238; Strand=-
  SCN-specific regions: Sequence locations=1-62,90-102,137-153,261 -261,293-308

SEQ ID NO: 63546 - DNA, 1618 bp, Heterodera glycines
  Genomic contig location: Contig_ID=SeqID_7002; Location=8..1625; Strand=-
  SCN-specific regions: Sequence locations=1-446,492-579,663-739,761 -804,826-831,996-1016,1259-1370,1430-1618
atgccgaacggaactcaagaattacgttttgacattttcctgctagagcattggtttgtcattatggtgagcggcaagcagcttggcgatgtgttttggccaaatgaatggtggcacggcgaggcatggaaaaacattacggcaattagggtgagcaaaaaaaaaaagaaatggcaaaattttaattgcattggccgaacccgaaaatttggtcttgcatggatttacaaaaataattgatacatggtttcgagaaataaatataccgtattcccgagggctctatttttcaacccctcttaaaagtgtgcctttatttcagggcgggggggggggctaattcagtgggggaggctgtattataggaaacactgtagtcactttttggcaccaaaatgtaaagcttgtttacaataactcaaactcgggatgctgcatatttttgctaatttaaaaaaaaataaataaaaattcgaaataattttataaaagtttttggcatttaaagcttaacggccaaatgttgcttctctatgggcccgaattggatgcatatggcattgaaaatgagaatgtaagaaataatttaaaattgattaaaaataaaataattaaattatcatttagcattaaaatttaaataattaaattattattatttagttcaaattttctgttccgcttccattctccactggaatcaatggccttcatgaaaattcgtcatgctttttccgtgtccaaatgcttaatgtgtatgaagcaaaattgttgattgttaattttacgaatgataaatcaggtaagaattatgaaatgaaacaaaaaattttatttaattatccaattacttattaaacgattcaaaaataacaaaataattttattttattgttaattgattattaaacaatgacaaataattttattttaatattcaattgattattaaatgatttaaaaataaaaaaaatttttaattaattgattattaacgatttcaaaataacaaatagttttatttttattatatccaattgattacaaaataaattcaaaataataaaaataattgtattttattattcattgattatgaatcatttaaacaaattaattttaaataagtaactgtatttttattcaattgattattagattatataaaataatcaaaaataattttttatttttcaattgattataatttcaaaataaattaaggaaaaaaagtaattttatttattattcaattaatctttaatgtttagcaagtgatctggcaacattttccatcatattaggcaaatcatttaacaatgacacatcatttaacaatgatacaattgtatttgaagttgaactgcgtgttttttatgtaatttttaattaaattattttaaatgttttttaattaaaaaaaatatttccaaaattttaggacggaaaatggcttgaaaatgaacatcgaaatgcaacaattacattcaaaaacatttctgttttagaactgttttttggcatcaccaatggcaatgatgtgataaagttgaacggtgtgcaaatgtttgaagaatattccaattcggcgccatattgcgacatgaaaaaaatcgag

SEQ ID NO: 63547 - DNA, 290 bp, Heterodera glycines
  misc_feature (51)..(51): n is a, c, g, or t
  Genomic contig location: Contig_ID=SeqID_7004; Location=2069..2358; Strand=+
  SCN-specific regions: Sequence locations=1-67,91-127,155-290
atgatttctgcaaaagttgaaaatattctctgcaacaaatcggtcatgctntcggagataaattctattggctttgacatggattacaccctggccggtgaaacatttaaaaccagttttttccgaggaaaatcaaaaattcattttccactttttcaggctatatatcacccaacacggaggaactcatcttcaaattatgcattgagtacctgcagaaacataaagggttttggattgaagcaatagctttttgtgtaattgagcaacgcatggcggagaattcttga

SEQ ID NO: 63548 - DNA, 122 bp, Heterodera glycines
  Genomic contig location: Contig_ID=SeqID_7004; Location=2427..2548; Strand=+
  SCN-specific regions: Sequence locations=1-122
atgtatcccagaaatatggtccaattgaacggagaagtgaaagtgatgaacactttctacgacttgcccgaaaccgatctgttgtcccaacttgttcatctcttcgacaaaaactctggagt

SEQ ID NO: 63549 - DNA, 1087 bp, Heterodera glycines
  Genomic contig location: Contig_ID=SeqID_7005; Location=78..1164; Strand=-
  SCN-specific regions: Sequence locations=1-186,263-286,308-388,415 -429,451-486,565-733,756-1087
cactctgacttcaaacgttggaaaatcattgtggcatggattttgccaataattttattgaattttaatttgctttttgcattgaaaagcactgaaaatgacacatacacaattttggtgtcttcgtcatctgaagaacgtgtgaaatgtcaatacaattattctcttcacgaggcatatgtatggaaattaaattgaaaaattttaattaaatttatttcatttaaaaaaaagtttatttttattattttaagtattttttctactggccacgatcatttttcacctttttgctgccaacactggtcgttttagttgccaacttaacaatcatcattaaattgcgaggccgttcaattctgacaggtaatcataattggaataattaaataagaactaataaaagaaaattttcttgtcaatatttcaaatgccaccttttccagaaacttatcaacttaaaaaaagaagtaatcaactttttccaaataaatttcaattcaaaaaatatactaataaaaaaagaacaaaaaatataatattttggaaaaatttttaaaaataccaatagatttatgagccaaaaatggatttttaaataatttattcactttagtttaacattctctgaagagggtgataggttgattcgtaaaatctgcaattagagcctttgtttgctgcaaaatatggcataattttgcataagtttaagttttttctatgaaaaaagtttattttagaaataataaaatcctatttaaattttggttatacactctaaaaaaattgtttttattttaaatgctaattaacaatttgggttttagggaatgtcaattcatcagccgtggcacgtgcaaacaatgttgtgctgtttgcaattcctgttgtttacattgtgttgaatattccttattccgtgcgaagtcttatgaaatttgtaatggattcggtgtccaatgaaaaactgtaccaaaaccattatttactgtatgccggatcattttacatttattgcttcaatttttctgtcaattttatcatttacgcgctcagtaggtcagaatcaaaaaataaaatataa

SEQ ID NO: 63550 - DNA, 552 bp, Heterodera glycines
  Genomic contig location: Contig_ID=SeqID_33504; Location=230..781; Strand=+
  SCN-specific regions: Sequence locations=1-104,153-412,434-552
atgcgatttgcacttttggaggagaaaatggcacttgtgcgactgttgcggcgctattcactggccaaaaatgagcaaacggaggtggcgaaaagggcaaattgaaaatttaattataattaaaaatatttaataattttttgttatttttagaaatttctaaaggtcaattcgcaagttgtgcttaatcctggcgcagtgatggtacaattgaatttgagagaagagaatttttaagaaaatcaaattgactgaatttgaggaaaatttgtaacaaatttattaaaatatttcacccaaatatgttttatgtaaaagatatttataaaaataattagtgaattctttaaattttaatacttttccgacaataatcgcaagaaataatagtaaaaaatttgatataaagcaaccaactaaattttgctttattaatatcattcgatagctcaaattttctctgttaattttaagatttgaaaaagaaaagttatgaaattatatggatttttttatattgattttttaagcttgccttttaggcacaaaaaa

SEQ ID NO: 63551 - DNA, 865 bp, Heterodera glycines
  Genomic contig location: Contig_ID=SeqID_33508; Location=255..1119; Strand=+
  SCN-specific regions: Sequence locations=1-427,451-459,484-737,775-865
atggctgaagcatcttcaaatgtcaccgaaatcagcggcactgtcattttcgctgcttatgccatggcatttttggaacttggcacactcattccgacaattcccatcctggcattctgctcttcaattgtttacaaaacttccattctgcaccggaaccttaagggcattctgttggcccaactttttggcatatttatgagtttgtggccacgtgtctttttgttggttgacaaaattttcgtgacaaaaaatttttttttgttggtgccaaattttattgctggagcatcaactgctgcattgacattcatcaacattgttggccatgtgctgattgtggagcgaatatgtgcaactgtttacgtggacacttacgagagataccgtagttgggcatttacggtggtttggctgtccattacggtaaaatattgtaccttttaaaaagcaataatgttttgttcattaatacataaaacagttttttttcaattaaacatcgcgtgaaaagtaaaattaaaaagtttttctttcattgagtaattatcggtgacattaattaatgaaataaatattcttaatttaatcagttgtccgctttaaagatcatcctttctttggggctaacaatttatcaaacgcttgttttggattcaatgttttcactaacaaatatttttgttggtatttacaacggagcaatgatcgccagtttaatagaaatttttgtaagctaaaaattaaaataatttgtttatattaatttttttagcttttttcaattatcacaaaatttaaccaaaaaatgtttgatttacgtcaaggcaattgtaaaaatcagcaattatctgttcggtatcag

SEQ ID NO: 63552 - DNA, 1309 bp, Heterodera glycines
  misc_feature (1241)..(1241): n is a, c, g, or t
  Genomic contig location: Contig_ID=SeqID_7006; Location=532..1840; Strand=-
  SCN-specific regions: Sequence locations=1-184,206-309,331-1160,1187 -1309
  Gene Ontology: Mol. function=prolyl oligopeptidase activity; Cellular component=cytoplasm; Biological process=protein metabolism
atgttcattgtccttcaaaaaggcgtgaaattggatggcagtaacccggcaattctcgacggctatggcggcttcggcagttctcagactccatatttctccgttactcgcctgatgctcgctaaacattttggcattgtatcagtaattgcaaatattcggggtggaaggtattgatgatcgcttgttttttggtttattgtttcaaattcagcgaatatggggaaaaatggcacgaggcggggatgctcgaccgtaagcagaacgttttcgacgacttcattgccgcggccgactttctcatcagcgaaaaatacacgaacaacaagaagtgagttgtggtgcagtatccgttcgtaaaactcgcaattcctttttcaggttggccatccatggcgggtccaacgggggattactgacggcagtctgctctcaacaacggccggacctcttcggggccgtcgtcacccgtgttgggtaagtaagcaataacagcagatttgctatttattatgaactttttttagcgtccttgacatgctccgtttcaacaagttcaccgtcggcgctgcttgggctaccgaatatggagaccccgacaaaccggacgacttctccttcatttacaggtatgttttaccccttttcctgcttattcattgtttcttcgacaaaggtactcgcgccttcattgtctccgcctcacgaacggcgtgaattggccggcaacactgctgatgagtgccgatcacgatgtaagttgtctgctgcagcgggtcggtcccaaagggttggaggggtacgcgggggttgggtacttaccagagtttgcctttttcattcgtttactttttaaggaccgcgttgtgcctcttcacaccttaaagtacgttgctcagctgtaccatttgctgcgcacggaggcaagcgaatggcagcggaggccggtgctggcgcgcattgagacaaaggcggggcacggagccggcaaaccaaccaccaaaacggtaacgcattctcttggggaaacaggcaagtgatactgtgctgattttggttcagatcgccgaacttgtcgatttgtactgttttttgcagcgggtgctcgaactcgaatggaaggagatttgattttgtgatgttgtgcaaaacttaattctatttatatgaaaatgtatgtctttttcgttgtttcatgtctataaatatgaaaaaagcacgattccatttcacttcctccnccccccccatcatacatgtacaaggggtgtctcagaccaagggccatacgttttcattatttattaaa

SEQ ID NO: 63553 - DNA, 1364 bp, Heterodera glycines
  misc_feature (1331)..(1331): n is a, c, g, or t
  Genomic contig location: Contig_ID=SeqID_7007; Location=1124..2487; Strand=+
  SCN-specific regions: Sequence locations=1-776,802-805,827-938,960 -961,983-1038,1060-1131,1163-1364
atggcgtcggaaaccactccctcgtcacttccgctcccaaattcatcgcaaagcatttatccgttaacaactcaatcagaaactgctgctgtgtgcttttcctccacctcgagtccaaaattggccgtttacaacaataaccattcggtcagtgatcagcagcggtgctctccgtcagtcaacaattcaaagtgcaaattgacgagcattttaatttatattttttggcgatttccagtataaaaagagtgctcagccgaagcggtactccgtcctcttccaacgcatcgctccacttaaaaattggcacgcctaagtcaaccgccggcgatgtctatgatttccatagcagtcccgaagaagatggcgttccgaccacgggccccggctttttcttttcctccgccccaaacgccggtgttattcaatcgaaaggtcgcaaagcattaaacaaaaaaagattacctatctacttaaaaaatataattaattcacaatcagttccagaaagtcttcaaccgccacaaaaaaggataaaaacggcaattttggcaaagaaattattggctgcggcagctgactcgaatttaattgactcaattggagtgggacaacccaatggaaatggcacaccaaaaaggatgtcatcggacgaacattttggaaatgaaaatctgagcatttttggtgagatttgggggtggtaaacagtaattaatttttttaacaatcacagagggaacacagagagaaaccgaaggaattggcgaaggactctttgaggaagatgaagaagaaacggaggagcaggaggaaagagaattggacgagcgaccggacggaggacgaacggatgccgccacttcagtggttgtccaggaacagaaaaaggtgggtcatggtacaatcagtgaaactctgattctagtctggaaaaatctaaatggtaaatgaatatttgattgtttttctcagaagggaggtgcggtgccgataggcgccgccgactaaaagccgggaaaaattggaatatttgatgaatttttattagaaatttgttcaaaattttaataattttcctctcccctttatccgtgacccccctcccctcatcaccccttcgattcgaaagggttccccatttttggggcctttttcggggaccccctattttttgtatgttctaaaatttttgagacttgacgagttattgaggttcctttagttttcttaataatcctttttgagacccctctctatttgaagctttatttacaaaagaataacatgaaattaatcctcacagaattttctccctaatttatctcaanaaataaataataaatttccagaataacaattga

SEQ ID NO: 63554 - DNA, 176 bp, Heterodera glycines
  Genomic contig location: Contig_ID=SeqID_7008; Location=1929..2104; Strand=+
  SCN-specific regions: Sequence locations=1-176
atggcccgaattgctgcagaaactgtacgccgaacaatcgaatcgaagcaacgaaatggcggaagcgcaccgccaggacagagaacgcattcggacgatgatgcaaagagaagtgacaaaaatggcggaagcgcagggacagacgggcgaaaggcagacacttttcataacggcag

SEQ ID NO: 63555 - DNA, 243 bp, Heterodera glycines
  Genomic contig location: Contig_ID=SeqID_33512; Location=159..401; Strand=-
  SCN-specific regions: Sequence locations=1-45,67-78,132-243
atggccactaaacggacggcgttggcatctgcggccacaacgacggtgcatgaccaaaatttggtgggcatttttgtgaaaatttattttattacaattttcaattttaaattttttaaaattattaaaaagtgttttgtcttgagtcgtttcctggtatttttgcgcaattatatcaataagatcagtcactgaacctgatcaaatcagaaacaaaatgtaatcatttcgaattttcagtag

SEQ ID NO: 63556 - DNA, 471 bp, Heterodera glycines
  Genomic contig location: Contig_ID=SeqID_33515; Location=291..761; Strand=-
  SCN-specific regions: Sequence locations=1-12,34-223,245-320
  Gene Ontology: Biological process=N-linked glycosylation
atggagcattgctttcatttagctaaaattgaacggcgacatcgccgcgctgacagtgaaacaaacaaaaatataccaagctttttggaactcaacctgaacaacaacacttatgaacagtacaagacaaatgtattgtgtgacttttaacatttttgacaatttattattttctaaaaaattcagttttctgcggccgatggaaatgtaacgacgaattcgacaaataattacagcaataacaaaaaagccacaaccgaattcgatatagaaaagccgccggtgtttaaaacgaaaaccgaagaaaatgcatttcgacgaaaggaagtggaagaaaaacggaaaaaggaagaggaagaagagcagcagaaggggaagaaggaagagaaaaaggaacggaaaatggggcaagaaaaggaagaaaacccaaaaagtgaggaggagcagaagaaaaagaatgaggaacaaaag

SEQ ID NO: 63557 - DNA, 441 bp, Heterodera glycines
  Genomic contig location: Contig_ID=SeqID_33516; Location=321..761; Strand=+
  SCN-specific regions: Sequence locations=1-270,309-441
atgtcgctgatcgaactgctcgcaaaaacaacatcggcggcgcgggcggtgaagaagcgccagcggttacaaaaacggccaaaaccttggctgaactgcttcaatactcaaacgtcgttgcagcaaatctggaaaataaacgtaagagcgccgccattgctcactattttttattattattgtaaggttcaaaaaggatgaatcaatcaacaaaaataaattcagtcacttcaccgacgacttccaagaatgatggtcctccgacggcggatggtttcacatttacagcagcagctcaggaagaatgtccgtcctcgtcatcgtccaaatcaattgccacgctcatcaccgaccggttcaggccaaacagaggcactttttaccgttatacaccagcgccagtggttacaccggcggtcgtgcacaaactcttactcaacg

SEQ ID NO: 63558 - DNA, 8318 bp, Heterodera glycines
  Genomic contig location: Contig_ID=SeqID_901; Location=2102..10419; Strand=-
  SCN-specific regions: Sequence locations=1-598,623-1055,1077 -1320,1342-3064,3086-3128,3153-3189,3212-5174,5196-5297,5322 -5740,5762-5777,5820-5853,5875-6756,6778-7007,7029-7303,7326 -7516,7539-8318
atgtcgggatttttgcgtacaaaaatcgcaatagagctaaaggctcttgaaaaggcaaaaacggcaacagaattgtatgctgagccggaccaaactctgacctcattggaaaatgcaattctcctggaaagcgcggcagagagaataaagtcagaggtggaggcagtgaatgccaaaatcgagcaaatttggataaccgcaagcaaatggcatgacgtcatacaaaaaatggacaaggacgaaagaaaaagtgagcagacagcgtatgaacaatttcaaacaacggagaaactgaacacaaaaatggaagcagccaacacaaagctaacagagcttaaggacctggagatgaaggtggaagcaggagcaaagctgcaacgctccaaagcggacagagacgcgcgagtggagcaaagagaacatgcaaaagcaatggcgaagtcaaatgcagaagcagacaaagggaataaccgtgcgagaggcaatgaaatgactgccgcgttgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcttggaagagaaaaattacgaaattgccatgaagctgttaaaggacacctatggagacaaaggcgaatatgtaaggaggttgcacacggagttgtcgaacctcaagcgatactttcggtggaagacacaaagcatttttgcatggaattggaacgcctggcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggccttaggaagtgcattgagcaaagagctagcaatcaaagaagtcatgagggagtatggcttcgaaggcaaagaggcaaatccagagcatggattcaaacgacaattaaggcggaacagattcggaggctcagtcaatgtagccacaacacatttcgggaaacccaatggagagcgaagaaaaatcccggaacaaaaaatgccaagtccgaggcaaggccaacgaagttttcagcagactccacaaaattccgcattccgagaacgtaagggacaaggaagaagcccaaaaattcagcggaatccaacagcagttaacacacaaggtgaactgtttctgtgtgttttctgtggagggaaacacagacacgacagttgcgaaaaggcaaggacggtgcaacaacgatttgcagtcctccaggagaagggcttatgctacaaatgcctgaagtcaaatcatatcggaagaaattgcccatgcccaatgaaatgtttcaagtgccagcaagcacacccaacggcattatgccatcagacaaacaacccacaaagggcaacagagtggagaaacatggcaaacaaagtcatgaacgtccggaaagaagagaaaccggacaaacgggacgaattcaaagaagtttcgttcacgccctcgcaatgcaattcagtgcaaggaaattcgcgagtcctgctgagaacagcagaggtgaccatcttcaatccatccaatccaaaaagaagcatggtcgcatcagtttttgtggatgacggaagtgaacgctcattcatccgtgccaatgtggcaaaacaattaggccttccggtgattgaaacggaagagtgccatttgactggttttggcgagaaagaagccaaacgctacgtgagcaatgttgtccgcgtaggatttttgggagtcaacggagacccatatatatgcgcactcaatgaaatggaattcattgtgaaagcgatgcccatcgtaacgctgaattcgatggatgaagcggaattaagcaagaaaaaactttcccttccatcgcggccaagacagccagacattctgttgggaatggatgtcagacatgacctgaaaataagagacgaaacagaaaagttgccaagtggattcacattgtcaacgtctcgagtcgggcggatgataagtggttatggccaagtccagggcccaatggacatgagtgtgcaagtgacgtacactggagcactcataagtgccttacaatgtgccaatagcagaagagatgctgacgaagaaattgaagaacagataaagacatttttcgggctgaacataatcggattgagtgacaatccagaagaaaacgacaaagaagaagtgatgagaacgttcagaaaaagcttgacattcaaagaaggaagatatgaatgtggcctaccatggaacgaaagagtaaaggatttgccgacaaattttcaacaagcgagggcaagactttgtggcacagtgaaaaaattgcgagaattaaatttggtggacgaataccaaaaaattttcaatgagtgggagaggaacgggataatcgaaagagtgccggatccaacacaaacaactggaccggtacattatctcccacatcggcccgtgataaaaatggacaaggccacgacaaaaataagaattgtgatggatgcatccgcgaagccagcaaaccgcaaaggagccccatcgttgaacgaatgcttgcacacagggccgttgttgctaaatgaattgaccgggatccttctaagatggagaagaatgaaggatctaatcctggcggacatcgaaaaagccttcctccaattatcagtgagagaggaggacagagacgcgaccagatttctgtggctggaggatccacaaaagacagaaatttcaagcccaacatatgtgagaaccgttgtgtttcggttctgtcgggtctcatttggattgacaacttcaccatttcttttaaatgcaaccatccgtgaacatctctcattctacgacacggttctaccgcaaaccataatggagaatttgtacgtggacaacatactgatcaatgtgaagaagaatgaagacatggcgcaaatttgccacgaatcgatcgagctgttccgtcaagggggaatgaagctgcaggaatttttctgcagtaagccgatcgccatacgaagccttcctgcggaattattggccaaaaaccaaaaggagataaaagttctcggaattccgtggacgaatgaggatgatgaaatttgcttccgatttaaaaaatttgccggaaagcacacgaagaggaacatcttggcacacattgcaaaaatttatgaccctttggggttagtggcgcctgcagtgctcccagcaaagcattttttgcaaaaacgttttgaagccaaaaacggctgggatgaaggattggaagaagaattgattcatgaatggaatcaaatcatggagacttggcaaacgaaagaggggacagaggtccaaattcgattcgcacgaagagtcgacaacgaagacgaagtggacaaggaaatgcattgcttcgcagatgcgagcggaaaaggcttaggcgttgccatttacatccgggaatcgacagaaaaaatgagcgtcaatttggtgtttgcaaagagcctggtgaagccctccaacatatcagatgttgcggcaacaattccaaaaatggaattacaatccataacgctgggagtgaagttgttaaagtacgtgctccaacatctcaaactcaaaccaacacagacaacgatttggactgacagcttgtgttccgttgaacgaattaaggagcataagaaatgcgatcgatttgtttcaaatcgattagcaaaaatacgtggacagtttgaagtcaaacatttggtcagtgcagataatcccgcggacgtggcatcacgcggcacaacaccaagagagttgagcagaaatttgttatggaagcatggcccaaaatggttatcagaagaaaaggccctgtggccaaaaccagcaaaggtttatcacccagatgaagagaagctcaggggaagtgctgaagatgaagaagtgaaaacagccgcagtcatgaatgaggtgcctttccaaccaaccattgatgtgaaccggtactccagctggaaaaaggccaaaaccgtgggtgcctatgtcttacgctggatacattcggtggcaaaaaatggatacaatggaaatttgttgccaattctgagcaaaatgggcccaaaaaagcacgggaaccaagataagggtgtactgtcagtgcccgaattatgtgcatccgaacatttgctgatatgggaagcacaacgacaatttccaacggaggaaaaaacaaaggaaaatcttcgtctgttcaaagacaaagaaatctggagatgccgaggacgcattggagaagcaacagtaaaggaggatacgaaattcccgattttcttgcctcctgaagcatggaccacaaaactcattgtgctggaagcacactggaaaatgaagcatccaactcacagtactctgttggggtacatgagggaaaagtactggatacccaaaggaagaaggttcatcagaaacacgatattgtctgatcgacacggatgtttgaattgccgcaaagagaggcttaaaccatatgcctatccacaaatgccaaacttgcccagtgaacgagttgcgatgataaggccatttgagaagacgggcgttgactattttggcccattaacgataaaaggcggagttaaagtctacatcgcactttatacctgtctcgtaatacgagcggttcatttggaagtggccgatgattgtacggcaacagaatttttgaggacctttcgaaggttcagctcacgccgcggcctcccaagcctaatgtggtcagataatggcaccaattttattgctggagcagagtgcataaaagaggaatggagaagagaaatactggtggaaaccagccactcaggagtgagttggaaattcaacgtaccacgagcaccctggcaaggtggcgcatgggaaagactggtgggcatcaccagaagtgcgttacgaagaacagtgggaaaaagcctaatggaaaggcaagaattcgatacgcttgtttgcgaaatcgaagctgtggtgaacacaaggcctcttacattccaatcagaagaagaattcacacaaccgctcagacccgtcgattttttattgccatataaacgtgtggaaacaagccttccattgtcggacgaagatccaatggatcccgactatacataccaaccccggaaaaggggggaattgcatcaattgatgagagttgcaataaaaagaattgatcgattctggaaacagtggaaaacggagtacttactttcactcagagaaagagatcgaaccaaccgagcagaaggaagtctcccaagagagggggatattgtcctggttgaagaagaggaagacccacggtccatttggacgatgggaaaagtcgaaaagcttttgaaggggagggatggactcgtgcgcacggcacgagtacacacaaaaggaaaaactctggttcgagcgattaaccttttgtaccctctagaaattaacacttctgcggaggacgaagtcagtcaaattcaagtgactgccattatggattcaccaagtgctgtgatggaaggcggggacccgcaagcagccacaacggagtccagtttgcctccagggacggtgatgcaggattcacaaatcgtcacgacagaatcgagtttgtctcctgtcagaggaaggaaggagcggcaagctgtgaaagagagaagaattcgaaagagacagccaacggaggaagtcagaggcaaaggcaaatcgaagaagaatggaccatatgatccactgcgaccgggcaactacagaattcctcgccgaaacccgttctttccgtcacaagtagcgtacaatgagcaaacacgcacgtatcgacgacgacgggggaggacgattgatctttcgggattgaggaagttgttcgctggattgggcggcactgaatttgtgagacgagagctgcaagagaaggctaacccggctctaagagaagaaaggctgcgaaaagataaagtcaaattcatggaagatgacgccaggcgcgtcgctgagagtgaaagaaaggcagcggaggagaaattggaaaaatcaatgaaggattctcaacggcaaacgaatgtcgaatcatcgtcgggcggaacgacacgtaatcctttcgaaccgatggaagtgcttcccggagaccccgaaccagaagttcctttggaggaattggcacgccaggagaaatttgatagggaaatggcacttgaacaaaggaagatgtacgaaaaacgaagagcagagagaaatgctgagaaggatcggaggcgttggggactaccacgcggaatggttcggagaaaggggcattatgccccgcaccaagggatcaacaaaaggcagaaatggcaccgtggacggcacattaatgagatccaaactgggcggaagtaccgacatccacgtgcccatgacatttctccgctacggcaaccaaatggcgctacaaccgaattgctggctctaagttcggagatggaagggcaaattcggaatgacaagcgagcacgggatgagagtcagtcaaaggagcccgtgcggtcccagcgacgattcaaagccagagatccgttggacgaacagttgaaaagaaggcaaaaagggcaacaagctgaagagaaccctggcagaataaagctggcaccagcaagtcccggctaccgacgtaccatcaattattcgctgtttacgcgatgtgagcctggtgtaaagggacatgaaggttgtcaaaggaattgcaccatgggaagtctgtcccacggccggctaaccaaaatcccgcaagccgaatcaaaggcggtctgcctggcccaagccttcgcattcgattggctaggacgtatgcacgccaagaaatttaatgaaaattggtgcgccttgctgggaagcggaagcgagattgaggattcattgaagaattggtggacgaaagtgctccaaaacaatgagaagacgataccacagaagcaactcgagtgtgtgctgatggcatgggacaattcgtgccaagtttttggacaagagtggaaaggaaaaatctatggaccagttggtctggaggaagtgccagtgaaaacgaatgtgataagtgcagaggcgcaatttgagagttggctcaggaatctcacggagagattcggccagaccttgaccaaactgagagccaaggagtactggaaggactgccatctccaaagcaagagggtattggttgtgagtaaccaagaagccgctgagctggtagccaaggaatttgaggaagaaggctcgagctggttcgtccattttggtgacaaaccgttgcgtgaaaagatgttcccggccaattggaatatcaaaattatcttcaatttggagctgaggagggaagaaagagaagaattggaagtgttcaaagaagacataaaagatattgcaagggcaggactggaagttcatttggcgactcggaaaaatgcacgtttgccacgagagtttgaggaattcgccgagatgcaaggctgtggaatttaccaatacgaaaaaattggagaactcgcagcggcgatcagaggaacaccggccaacacgggaacaaatcccgagtcaggagagtcagcccagaagagtacaactggatggaggcgagccgtaaccaaaagtctgacaggattgaccatgctggtcatgttattgatcacactgttgcaaccaatgatgatcaatggacaagtcattcggccggaacgaaacggcagatggattcctgtaaatcccttcggaagaccactacgaatggaggaactcgttggatttacggagccgacggtacctcggctgagcctcgacaagagagggcaaatcacgcccactttgccgacaacagcggcggatatgtccattgcgcatatccgggaatggtacaaaaaggcgcggatgcaaacaagtggtacgactcaaacttcggcagcaacgacgacagtgcgtacgagtaccagtgccagtacagaaatgactactctacgaactcccgaaacgacggtaaccacgagaacgacgacgaaaacaaagggagtcaccacgcaaccacagcggaagactacgaatcaagaaccaaggacggactcaagacggaggcagtggactcaaactccaagccgtcgctggactgatcaaatctga

SEQ ID NO: 63559 - DNA, 1163 bp, Heterodera glycines
  Genomic contig location: Contig_ID=SeqID_901; Location=11455..12617; Strand=+
  SCN-specific regions: Sequence locations=1-520,552-627,659-734,756 -788,820-895,927-1101,1123-1163
atgcgagggggaaatgcaaagggaaaaatggcacaattggggggcacaaaagtggggtgagtcgcggggaggggggggcacatcaccggagaaaggcgggaggggaagggtccgggcgaatttgctctcccgcaaattcgtaattttccatcaaatgatcgccgatttcatcggctgtccgcctgggtgatgtgtcgtttcgtccgtcgcaccgcgatggtccgatcggcgtttttgcactgcttcgggcgtccttcacgcggagaaggcgccacatccgctttttatcgctttccttcccctcattcacgtgctcgcctgctgccgtccctcccttcgccccctttttgtcctcccttcccttcatcatttcccgtttgccctatttttcccatctttccatccatttatcactccttgttcgcaacttcattcactcctccccgtcctcctcatttgtccgctcaacggacattcgcggctgtcgttcagccgcgacaccacagcacacaaaattgttttttgtaagcaacaaacaaaaaacttggtttaacttcaatttctattcattttcaggtgctgtatttgcaacaaaattgttgatgagccacagcacacaaaattgttttttgtaagcaacaaacaaaaaacttggtttaacttcaatttctattcatttacaggtgctgtatttgcaacaaaattgttgatgagccacagcacacaaaattgttttttgtaagcaacaaacaaaaaacttttgatgagccacagcacacaaaattgttttttgtaagcaacaaacaaaaaacttggtttaacttcaatttctattcattttcaggtgctgtatttgcaacaaaattgttgatgagccacagcacacaaaattgttttttgtaagcaacaaacaaaaaacttggtttaacttcaatttctattcattttcaggtgctgtatttgcaacaaaattgttgatgagacaaaaattgttttttgtaagcaaatcactttttttggttcattaattcttatttttattttaaagtgttttggtttttggtcccggattgaactggagcgaaaaaactccaaaaaaactttttatttaaattctttaatacttgtgtttaaataattgtcacaagttttattgaatttga

SEQ ID NO: 63560 - DNA, 624 bp, Heterodera glycines
  Genomic contig location: Contig_ID=SeqID_901; Location=12792..13415; Strand=+
  SCN-specific regions: Sequence locations=1-6,30-494,521-568,596-624
atgtcaaatcctcctaatcctcctaattccccctatcattttttaaaagaattccaaatcccttggcaaccgccttcaagatccccatcgccgcttccttgtcctcatcaacctccttctacaccaacgggcgctacaactcccccgggttgcgagcctcttataacctggcctccggaggactggtcacctgaggaatgtatgcagacgaacaattttgatttattatggaattctaaaattaatataggttcttcgtcccagtgcatgcctgaagagccacaaattgtccaaactgatgtttaggacattgtgcaaccagttcatgaaattgaacggtaaaagagccaaaaattaactcgtgctaaattttgaaaaatctcttggtttagaaatgattcgccaaagcctccgccggtcttattgttctctgagtttaaaaaaaagctcgaaaacaaaaaaagaaacgaacggaaggccaagtatggcttgaactttaaacaaaaacaacaactttttaagaaaaaaactcttggaccgtgcagaaaaagctgaaaaggaggcaattgagaagaaaagaaaggaggaaacaaaagagtaatttgttatttttaaattagtaaa

SEQ ID NO: 63561 - DNA, 1360 bp, Heterodera glycines
  Genomic contig location: Contig_ID=SeqID_7009; Location=907..2266; Strand=-
  SCN-specific regions: Sequence locations=1-78,108-207,233-431,471 -575,630-694,717-718,741-752,896-1055,1090-1108,1149-1360
atggctgttcgctcaattttgggcaattacaattggagtgaagtgtcatttgtatacacgccggacgaccaacggatgtaattaattaattatttaattttaattatgggctgcccctaattagttttaacggattatttaacaatttgcccagccggacaccaacggatttaattaatttgatcagccggccaccaaccgatttacttatttaattaattaattttaattagagcctaattaataaaaaaagattaatttcccagggtatgccaatatttttatacggattttatcgcgttggtcaacgacgacccaaacgtgaccattgttttccggcgcaaaatggactccagcgcggaaagcatgcgctcgacactgatcgcagtgtcaaaccgatccagaagttggaaattgatcaaatcaaaatcaaaaaaaaaaaataataatttaaaattaatttaataaatggtaaaaaagtagtaatattcagaaaatagaagaggatattattggcaggagcagatcgttcgttacccgtcctcccgaaatttttttaaaaatttccaactcagaaattttaaaaaaataaaatattttttttaacaaaatttcaagaaaaaaaaattgtcaagaatttttctagcgatttttgaaaagtttaataataaattactttttaaatcgctgaaaaatatttcacaatacttttttcttgtaattttctaataaaaatttttcgaagatttttgtagaaataataataataataaaatattcaaaagtaagtaaatataaattaaaaagattaacaaaagaaaaaattaaaaacttaaataaaactaaaatgcttgtaatatttgaatataaaaaattaaacaaaaaaaaaaaaatatttcatgttggaaaaatgttgaatagatttaagaaaattataatttaaatcaaacattttcctaaagttgtgatcacttgttttgataatatcaatgatcgacgacaatttttgcttgccgtcactgaccttggcttggctggcaaaaacacagagtgccattttaaaattttatttttaaaacatttatttttggcaaaaacacagagtgccattttaaaattttatttttaaaactttattttcttttttagattcgcttttatcatcggttcaatgaggggactcggaatgacacagccgggtgaacaatttttcaagcagattcttgaaacaataattatagcaaatagaatagtttactaaattattgacagtgattaattgggtaattgtggtaattaggcaattattaattgaatgagttgagcgagagggcatgataaaaattaattcgggaataaa

SEQ ID NO: 63562 - DNA, 675 bp, Heterodera glycines
  Genomic contig location: Contig_ID=SeqID_7010; Location=1124..1798; Strand=+
  SCN-specific regions: Sequence locations=1-206,229-252,281-650
atgcacccacaattttctgcgccaatccaccatcatttaatcactgggactcaacccaccaacattccaatcaacgggactcaatccaccaacatttcaatcactgggactcaatctcatcaatccttcagcaacacaattaccgggactcagttctccgacatttcaatcactgggactcaacctcagcaacggaatacagaactatttaaaaggaatccagaaattgaaatataacccataaatcaaaacactatggtgtacatttatattgctttttctatccatcaaaggatttttctttcattttttattactatcataacatgctttttattcaaaacaaatatcaaaaaccaaatcagattcttttcatattataaacaaggaaaagtacaaaaaacttttttaagtaacaaacctttttcattcaaacgaattctaatgtatttttttaatcaaacaattctccattatcgtttacataagcaaaacaaaaagctttcacatcaaaatggaaatcaattaacaaaaacgaaaatttagacaaaaaataataataacagcaaaaccacaaattttttcttacacacaaaaacagaaacttcatataccggattttccactcaaacaaacacaaaaatgtgctcattattttattaattattttatata

SEQ ID NO: 63563 - DNA, 1550 bp, Heterodera glycines
  Genomic contig location: Contig_ID=SeqID_7011; Location=171..1720; Strand=+
  SCN-specific regions: Sequence locations=1-199,221-233,371-463,551 -705,958-972,1058-1114,1136-1147,1170-1188,1212-1215,1240-1255,1283 -1407,1429-1493,1532-1550
atgacggacatcacattttcatcccaggaaaccttatcatggcaaattggatattttgttttcacattttgtacggttttcaaccgtcggatttgacagacggaaaatttaaatccgacaaaattttgattaaaaaaattcatttacgacccacttaaaaaatgattaagacgaagcgaagccccatttattccaagtgagaagaaaagagaaacaaggaactgcgaaagttcaattaaaaaaaatttaattttcaaaaattcatttaaaaatataaaataaaagacataaaaaattaattggtactgaaaatttatttaactaaattaattatttaaatgataatttaaaataaattttaattttaaatggttctcaatttctttttgcaattaaaattatgagtcactaaggcttgggtttatcaattttaatttcattaacaaaaagcccgagatttatctttaatttattaaagaaatattgattcaaatttattttaataattaatttattttaaaaataattaatttttttaaaaatttaatttgtaatgcttcagcttggccccagctcatcggcgtcgggcagtacaagcagcagttcggcggacagtgaagcaatggtggcaccgaaaagcaatgggattgaagcgccgccaaaaatcagtgaaccatttcagttggcacacacggcaaatgggggtaatttattaaaaaaaacaaaataacaaaataattttttaaatttattaccttttgtaatttgataaaacattttttaatattattttttaaaatttctttatttattaaaaagcactttaaataaaaaattttatttttaattataatttgacaaataaaaaaaagttttagaagaaatgaatattttctctaaagatttttaaatttattgattatttaaaaataatttcaattaatcatatatttttttcaaaaaccttttggcaaattaaaaaaaaactttttaaaaaatgcgaaaatttctaacatttaataaatatttcatattttataggatttaaatattttaagccttttaaaatccaacgatttcatttttaaaatattcaaatatcttttctcttttttgaaaattctgtattaaattatgtcatttaattcatttcaattatttatttttaagttcacaatttaaattggcaatttaaattatttattttaaaactcgcttattttattgtaattgttttaaatttctgaattttcccaaattaatattaaaataattaaataaacttttgtccccctctttcagtcaatggtccatttcatccgtgcaaattgctcaacgagccaccaattgtgatgctcggcgatggcatcagttgcagtgccattggcggcggcgctggttgtgttgcgggctctgctcgccgtcgtagccgttcgccgggcgcgcgtcgcaacgcgcattcggtgcaacaaccgcagcccatccgcgcagcgcaacaactccaacaccaacaacagcaacaacaataccacggggcaaacaatgggtaa

SEQ ID NO: 63564 - DNA, 624 bp, Heterodera glycines
  misc_feature (621)..(621): n is a, c, g, or t
  Genomic contig location: Contig_ID=SeqID_33522; Location=244..867; Strand=+
  SCN-specific regions: Sequence locations=1-470,492-624
atgcctgctgaaacagctaattctaattcgaacgttaattcatctgcaacagcaaataataacgcaatttcaactcatatgcttcgcgagaaaaacagcgacgaggcaatggtaagtgaaattgtctaattggacaaatggtattctcccacccctcttctgatttaaaggaagttgaccagaaaatcgtgactgatactgccgacattttgcagtctgtgctcgaattcgcttttggcgtttcaatcgacgacaacaatggcattgcacaggaattctcctcatctcccgaattgcttttacaactgcaggattctgtgcgcacaattcttacgtctttgtgcctaaaaagtgtttcgccattgaaacaaataattttagtttctttttaagctgacgaagtcagtcaatcgcttctgttggatgaactgatatttacggcggtcaatctgataaagccgagcaatgggttcagctcctcaaattccatcccaaattccgacgactctttggccgtggtttttccccaacgcaatttgccgaattcattcatcgcctcttcagcctttgattatctcattggaacacggaaacgatgcaaatgtctgctcgaccaatcgntaa

SEQ ID NO: 63565 - DNA, 1219 bp, Heterodera glycines
  misc_feature (1093)..(1094): n is a, c, g, or t
  misc_feature (1162)..(1162): n is a, c, g, or t
  Genomic contig location: Contig_ID=SeqID_33523; Location=193..1411; Strand=-
  SCN-specific regions: Sequence locations=1-2,25-519,576-609,632 -1153,1177-1219
  Gene Ontology: Mol. function=profilin binding; Cellular component =cytosol; Biological process=cell growth and/or maintenance
agggtttgaaagtggcacagaacgcagcggcacaagccaaactagccgaacagcagcgacaaacggccaacagcacacaaaaaacaactccgacaacacaaacaactccaacggtaacagcagcgaaagttgggaaggaaaaagtgagggaacaacgggacagcagcaaacagcggacaacgcaacagactgacaaggaaatggtacggtgaatggggaaaatgttgtaataattaggtaaattaattaatgcacgatttgttacggaaaagcattaaagcacggaaaagggacacttggcaaacaaaagaaagtatttgaattgttggagaattgttttaaatagtcttatattaccaaatatgatttgttgcctttacaggattccgttgactccgcttctgtcaattccgcaccacgtacaaatccgtcacagcagcagggtaacaaaacaacatttaaaggtctaaaacttcaaaaaaattgcttacaattaagcacctccgaaaaaagcggtggcacctcccccaccgcctcctcctccgccgccaccattgtttgtacagcctaaaaaagttgtgcaaaatggccctaaagcagcgggaggaatgccgccaccgccgcctccgcttggcttattcgtctcaaccgctgaagcggtgccgaagaagaaaattgcgaaaattggcagcaaaatgccaatgatcaattggacggcgctgaacccgaaccaagtgaagggcaccgtgtttaacaacatgaatgacgagtgggtgatcaaaccgtacatataacatgtattttttccttttttcagaaaattggctgaagagcttgacctgagcaaattggtcaataattttcaatttttatttttaccattttctatgcaaaatatgaattcaggaagcaatgtttagtctggacgagaagaagccgtcgtctgaatcgcaacagcaaaatgtggacgcaaacgcagcggtcaaaccccgtggacagccgtcaccaaatgcgaccgtaaattgcggaaaaaacactgttctctcaactaaacggcttcaaaacatcggttggggactttttctcacactgnngagggcggaatttgcaatcattaagccatagaaatttaaaaatggatttttttgcccacttaatattnattttatttttttacagccataattcgtcggaagaatcgggaaaagggcaatgggat

SEQ ID NO: 63566 - DNA, 270 bp, Heterodera glycines
  Genomic contig location: Contig_ID=SeqID_33529; Location=36..305; Strand=+
  SCN-specific regions: Sequence locations=1-76,109-270
  Gene Ontology: Mol. function=ubiquitin-specific protease activity; Biological process=protein modification
caattcttcttccaacgatctgatgcgtggcgtgtgcggactgcaaaatttaggcaacacatgctttatgaactcgtaaattaaaaattttatttttataatttttttgctcatttttcagtgccatccaatgcctcagcaatgtgcctgagctgaccacctatttcttggaggacaactatgtggacgaggtgaacacgtccaacccgttgggcaccggcggtcgtctggtgaagcagtacgcggacttgctcaaggacatgtggtcgg

SEQ ID NO: 63567 - DNA, 2094 bp, Heterodera glycines
  Genomic contig location: Contig_ID=SeqID_7012; Location=113..2206; Strand=-
  SCN-specific regions: Sequence locations=1-129,167-229,286-734,778 -1007,1033-1125,1150-1286,1321-1412,1460-1552,1577-1686,1714 -1719,1741-2031,2053-2094
  Gene Ontology: Mol. function=phosphatidate phosphatase activity; Cellular component=integral to membrane; Biological process=germ -cell migration
atgggcaccgaactgttgcgttcgttggtttgggagcgccaatgtcctgacgagtttggcatgtaccgctacaaaaagtacaatgttcatcgactgattgtccgcttttatgtgtttattggtcggaaaattaattttttaaatgaattttggcatcttttaacttaatagcatgaataatttggttgaaattaagatttacggaggctaactgttctaaaaaaatgccaaaatttattaattttattggaatatatatttttttttttgtaatttcaatttttaggctattttttccttggcatttgctttaaccaattgatggtcgacattgcaaaggtagattttaactgaaaatttataattcactaaataaaaaatggaattaattgtaacattaaattcctaagttttgagcgtaattacgtcttctaaaaatttttggcctccgtaactaccattgaaattcattttgttcgtttttttgttgtaattttcgagtttttggggccatcgggcctccaaaatcaccccttgcgtcaacacttaaaatttaaaaaaaaactaagaacttctcccatttcagtacaccattggacgtcatcgtccccatttcatggacgtgtgtaagccggccacacaaatgccaatccgttcaccggacggcagcacacaaatggtgttgaaggagtacagaagcaactgtccggctgaagagcacaggtcagcaaaaattttgggtaaatgtttttaaaagaaaattttatgcttttaaaattccaataatttcaatgtcataaaaatttgttttagtggattttccgggtcgctgtcccgaacccgaattcgaaccaaaagccaaaacttttgattctgaggttcatgattcaatattggtcaaaatgtttgccaggatcgtgatagcgcgaccctgaaaaccccataaaaaacgttttcccgactaaaaaaaatttgcaatccaaaagggtgtccgtacctctatggaatcatttttaaaaaatgttttgtttgtgtgagtcacctcccttaaaatttaatgaaattttggcgcatttcaaaattttttggacacacgagttacaccaatgacatttttttggtttcaaaaaaatatatttaaatttaatacacctttttcagttatgtaacggattttgagtgtttgggcgacaacaaatatttgatccacgagtccatgctgtccttctattccgggcactcggccttctcattttatgccgcttggtacacagcggtaaggaaagaaaattttttttttaatttaaatttaaaaattttgcaataaatgggtcgtacataaaagttaaatttgccatctaattgcatgtaatacaatttaaacctttgagaaagtttcagcaattttgtagaaatttaaaaaaaaaattaataatttatcataaaataatgaaaaaatcgctatgaaacaaaaattgtttcacgagattttcgtataaaaaattttttctaacaatagattttatttcgaagaattctaattgtacgtttcaaatttttttttttttaaatttttcggggatgaaacggacccgtttttacgctcctttttgaacaaaaattttgaaaataacgcgggagggggcggcgagggcggtgccaaaaagaaaatttttgaagtctctgtttagaaattttttaaaaaatgcaaattttgcctaaaaattttttattttttttgtaaaagaattattcgattttctgttgtttttttgtgccagttgtatttgcaagcacgcatttatcgtccactggtcagcaaattggtgctgcctgctgtccaatttgcgctgttcggcggtgccgcgtttgtggcgtacacgcgggtcagcaactacaaacaccactggtccgacgtgttggttggcacactgatcggctcagcgatcggcctgatcaatgtatgtgtatttggtgattgtggaccgacccataaacccaaatcccggacctgaattcgaacaaatgtcgttttttacaaggttattttttggcaacagtacatttcccactcgccgtcccttttcaattaaa

SEQ ID NO: 63568 - DNA, 1643 bp, Heterodera glycines
  Genomic contig location: Contig_ID=SeqID_7014; Location=57..1699; Strand=+
  SCN-specific regions: Sequence locations=1-1115,1151-1643
  Gene Ontology: Mol. function=phosphoglucomutase activity; Cellular component=cytosol; Biological process=carbohydrate metabolism
atgtccacaacattgtcaactccgttcataccatccactgtgcaaacaaaaccttttgctggacaaaaaccgggcaccagcggtcttcgaaaacgagttagtgtgccatcttttcaaaaaagcctcgtaattcggtggcttttcgcttacaaaaggacacataaacttcaaattttcgaatttcgcactttaaaatggttggatcttttattgcatgagtgctagctttcagtttgttccgtatatttaaacagtttttagacgaaaaaatacgaaattccaaaattaaactttcgaccttttattcgaattcgggtccgggtttcggtattgatcggaatgggtgacatattcgtgatcagtgacccagaaaaccctctattcacactcgactttttcaggtgccggagttccagcagccgaattacacagaaaatttcgttcaatgtgtgctcgacggtgggcttggcgaagcaaaacgtggcgccgttttggtggttggcggtgatggacgctttttgtgtccacaagcggtcaatgtgatcatcaaaatcgcggctgctaatggggtcagattaaaaaaaacacatctgggggctttagggtttagtgacggtaagggcttaggacgattattcagtaaaaattttttagccgtggcattacaaaaaggggcgttttcagactctcagtttacgactaaaaaaccatgaatttttcaatgggtcataactttttcaagaagtctccgaattaaacattcttggtatcattctagagctgaaagatttctctattggcctacgaaaaatgaaaaaaaaattgtggccaaaaaatctcgtaaaagcgaatttttaaatttattttagtcataattttttttcgaaaacaaaaaaggctaatttcaaaggccttttattacaatacctgaaaaaatgaggaggatttgtctattcggcgtgccaacaaaatttggtcaattcgaaaaaaataataattccgtcttattgttaggtgtccaagctgatcattggccgtgacggaattttgagcacaccggcggtgtcccatttgatccgcaaaggggacaatggacgacaaatcaacggttggccattttttatgattttttaaatctaaaaattttttaggtggcataattctaacagccagccataacccgggcggcccaaaaaatgacttcggaatcaaatttaattgcgaaaatgggggaccagcgccggacaatgtgcgtgaaaataaaaaaaaacattataaacaggccccagaaaaggtccctcacatttttgaaggattttcaaaaaaaattttaaagtgcgccatattttgtcttatttaatttttttaggtcaccgaacgcatttatcagctgagtacaaacattgccgagtttcgcatttgccccaatttggacattgactttggccaaattggcacaacaattgccaccattgagggcattggacaatttgttgtccaggtttttttcctttttttttttgtaaaaaaaaataagtaatggttcaaatttgcaggtgattgacagtgtccaggactatgccgattatatggagaaaatttttgactttcctaaggtattggattcaaaatgggctatttaa

SEQ ID NO: 63569 - DNA, 415 bp, Heterodera glycines
  Genomic contig location: Contig_ID=SeqID_33532; Location=1..415; Strand=+
  SCN-specific regions: Sequence locations=1-415
ttgctgctggccaaacgtatttgatggtgcagaacattccggccgccgccggctgtttaaagtaattttttttcaatttttggccaaatgtaagagaccgaaccccacaaagacctaagattttactggtttttttggggggggggtaccacattagaaaaaaaactgggggttgttctattttgggaggtgtagaattcacctgtttttttcgaagaatttgataggaaattcaaaccaaaatgcattaagtccgtaaccagaaatgggagaaggaggccctaaaacttggagtcaaaatctcttaaaaaaatcggactgagcgccaaatttttggtaaatttttaactagtttttttccttcctccaaggcattgtctgacggcgaatcccttctgttccgaggccatccatt

SEQ ID NO: 63570 - DNA, 56 bp, Heterodera glycines; identical to SEQ ID NO: 52733
  Genomic contig location: Contig_ID=SeqID_33535; Location=722..777; Strand=+
  SCN-specific regions: Sequence locations=1-56

SEQ ID NO: 63571 - DNA, 67 bp, Heterodera glycines
  Genomic contig location: Contig_ID=SeqID_33537; Location=675..741; Strand=-
  SCN-specific regions: Sequence locations=1-67
atttgatctgctaattgatccccgatcataattattattcattaattatgagtgcttgggcgaatgg

SEQ ID NO: 63572 - DNA, 105 bp, Heterodera glycines
  Genomic contig location: Contig_ID=SeqID_33540; Location=157..261; Strand=+
  SCN-specific regions: Sequence locations=1-105
tgtccgtttggggtactcaaacaattatggggagcaaaaatccaacgcagaattaaagtacaggctatagggaagctattcccgaaggattcggtctccccataa

SEQ ID NO: 63573 - DNA, 215 bp, Heterodera glycines
  Genomic contig location: Contig_ID=SeqID_33540; Location=422..636; Strand=+
  SCN-specific regions: Sequence locations=1-65,95-215
atttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaattttggtaagcca

SEQ ID NO: 63574 - DNA, 367 bp, Heterodera glycines
  Genomic contig location: Contig_ID=SeqID_7015; Location=767..1133; Strand=+
  SCN-specific regions: Sequence locations=1-209,231-367
atgaaagacaatgaattctggatcaagggagtttcaattagaggcaagggagctgatgaacccgatgatggtgataaagccgaaatttggcgagacttagtcccgatgaagaaatgcccgaagaatcggtgaatttgaatcccatgtaatagccgcgagaaactgatctccctatccatattaaggcttcttaaaggatgcaagattaattacagaaaatctttatttaaaatgcattatttaaacgttatacaagaaattctgaattttcaatttgcgattgaatcatgtctaaaattcgcacatctgaatatgtctatgggaataatagaaagaaaatcaatttaaattaggacataaggaaata

SEQ ID NO: 63575 - DNA, 230 bp, Heterodera glycines
  Genomic contig location: Contig_ID=SeqID_7016; Location=964..1193; Strand=-
  SCN-specific regions: Sequence locations=1-38,79-80,102-230
atgtaccacggacaaattgtgtgaaagctgaattatgaaattctaaatgaaaatttgtgaacaaataattttatattaacgaatttcaaatttaagttccagcagctcccggttcagaccacgacgacaacgacaattgcaacagacacaaaaactcagccgaatgttaatcctgtaaggttttgattattctatgtaaaagcaaaaattgaacgcaaaaagagaataaa

SEQ ID NO: 63576 - DNA, 563 bp, Heterodera glycines
  Genomic contig location: Contig_ID=SeqID_7017; Location=2062..2624; Strand=-
  SCN-specific regions: Sequence locations=1-317,455-511
atggcaattatggcaactgtgtggaaaacaaaggcaccaaatccagtgattgctgttcggccaattacgactttaaatgttgtgtgggacaagtaaggttaaggcaattacagtgggagggataaataaataagagtaataaaaacataaaatttgataggaaaaaattaacaaatgaagatttgagcaaatgtcttttttcttccattatcctttttattcattatcttaagaattaaaaaaaaaacaaaatgggcacccactttaatttctcttttgttttcgaatttcttaaagtccacttaatttaaagcatcaaaaattcaaatataataaaagaaatatgaaatttattttaatttctttttttaaattcgattcaattaaataaaaattcatgtttatataaatgatagtaatttgatcataataagaaaattagttttaaattaatcttcttttaggcaaacagcggcgacggaactgcaaccatcaccaaccacaacaaccgtattttatcataaaatatattttataacaaaaacttaaaataatttaataaa

SEQ ID NO: 63577 - DNA, 815 bp, Heterodera glycines
  Genomic contig location: Contig_ID=SeqID_7017; Location=3407..4221; Strand=-
  SCN-specific regions: Sequence locations=1-251,288-446,482-547,606 -636,658-815
atgctttctttcgtcgtttttttgttgtttgccgttggccttgctcaggtatatgtgatgttttacaatcaattaaatatactatttctcgcattttagacagctgatcaaccgcctccggtaatttataattttctcttggttttgattggttagggattgtgtggttctttggcttgaactgcctcggcatttaagctttggcatcggtctctagttttgcgtttttggagcagtatatgtttagtgtgaaatataattattatttttaattattcataattattggtttcagttaccttccggcattgtccccgcatgccgagagaccgtggaaatgttttgccaatgtggagccgtttgcgttccaaaagcgggttgggccggtgataaatgttgccccgatggattttcaattctgtgcgggtgtccggtaagttaattacataattgtctaagattttatttctattttctttttgcaataataaagaatttgtacggtgtttttgggaaacaatttcggaaattgttccaaaaaatgttcaaataattaaattttattaaatttatatttgctttaattatttattaataataaattagtctgaattaattgggtgtaactcttcaggtaaaagaaagaaatggctcccagacaatcggacagttgacaattcgacagcggacaatccgtcagaagtggattagactattggacagtgaatagtctgacagtaaaatacacaaaaaagataagaaaatgccatagccgacctgcccgattgtgccaaatcaagaaaaaggaaaataaa

SEQ ID NO: 63578 - DNA, 785 bp, Heterodera glycines; identical to SEQ ID NO: 33546
  Genomic contig location: Contig_ID=SeqID_33546; Location=1..785; Strand=+
  SCN-specific regions: Sequence locations=1-222,246-573,595-785
  Gene Ontology: Mol. function=translation initiation factor activity; Cellular component=eukaryotic 48S initiation complex; Biological process=regulation of translational initiation

SEQ ID NO: 63579 - DNA, 590 bp, Heterodera glycines
  Genomic contig location: Contig_ID=SeqID_33548; Location=61..650; Strand=+
  SCN-specific regions: Sequence locations=1-320,342-590
atggcgttctctgaagacccgttgatcaaaattgaagaggacaatcctcgagctgacgcgtcaactcacaatttgcctactaatgagaagctgttgccacaaaataatcattttgcaagcaatgttttgaaagcgcaaacggattggcactcacaaacggaacaacaacagtatcaaatcatcaattttgttgacaacaatgcaccaccacatagtgaattaacgtcgagctttaatgattttgctgatttgctgtcaaacacgaagacaaatgacgtggtgccggattttggaatgactcaaatgcgcaaaatcgagccaaaacattttaatgaaccaaaaatactgaacaatgttactcatttaaatcaaacagcggccagtcaagtctccaacaattcgaaacagttccatgaacttggttggttacaaaaaaaagttttctaattgtgttttatatagggatgtatgttgcaaagctactttctaagacacctcaaaacggaatcgcagaagctattcgcttgaaaggccagattttctcaatgtgcaccagcaagcaaattgatttgatgagtgaaagtatgtga

SEQ ID NO: 63580 - DNA, 249 bp, Heterodera glycines
  Genomic contig location: Contig_ID=SeqID_7018; Location=631..879; Strand=-
  SCN-specific regions: Sequence locations=1-249
atgcgtttgattcgaatgaaactgaacagtttggagaaggggaaaatggacaacgcttacgacgaggcggtgaaacgcgttcagtgcgttattttcttatttattcgctaattacacacatttttcatccttaaggagtcttgacgaaatgcgcaaaaagcttgaggatttgaaatgtaacatggaaaacggcgagacggaggcgagcggagagggcacgacgaaggcacagcttgagttggaggaaag

SEQ ID NO: 63581 - DNA, 887 bp, Heterodera glycines
  Genomic contig location: Contig_ID=SeqID_7019; Location=1446..2332; Strand=-
  SCN-specific regions: Sequence locations=1-121,143-456,478-544,566 -855,886-887
atggacttggacccaaaagctcacgcaactttaagtgacatgacaactcaggacaagttgggcatggcgagggaactcattgaccggattaacaagggcgacttggtgaggctttggcgttcattcatttgctgattatattaatatttgaggtgacgaggcagcgatttgtgattgaccgtttgggtacgatcagagttgggaagaaaaagattttgaaccatttgcaaattctgaaatccaaggaggaaagcggagaggtgctgaaactctctctgattactctacttaaaaaatacaattaaacagtattcgaatcgtgcacttgtcagcaaattgattgagtcgtacgacggtttgatggcccaggaaaaagaattcatcgctttgatgcgcgacatcatcaaatcgtatcacgaagcaatcgacgccgtcacatccgaactcaattccattcagcaatcgcaacaaaagcaacaaattgccgaagtgagcgtggtggaggaggacgaggaacagagtaggcattggaggaaaagccaccgaattaagtccttttaagaaaaacttgagaacaatgtcagtacgcaattggatggacttgtgaacggattcacttcattggaaaatatggtcactgaaatggaaaagacttcgctgatggacgaacagttcaaaatttgcattgaattgcattatgagcaggtgaagaagcattttgtctaattgacagaaaaaacaccgagggacacgttcagaaaaagaaaatggaactgatgcatcaaatccacatgaaggagaaggcttcgctggagttgagcaccaaggatctcaccgaccagacaaagcgtcgaggtgggccatttgttgtttaaagaagaattaaa

SEQ ID NO: 63582 - DNA, 2270 bp, Heterodera glycines
  Genomic contig location: Contig_ID=SeqID_7019; Location=2505..4774; Strand=-
  SCN-specific regions: Sequence locations=1-810,832-1267,1289 -1579,1601-2270
  Gene Ontology: Mol. function=DNA topoisomerase activity; Cellular component=chromosome; Biological process=establishment and/or maintenance of chromatin architecture
caacgttccaagggatcagtcaaacttttgtgttcacaagcgttactggacatcttatgaactataatttccatgaaagctataaacaatgggtcgaaagtcgcatttatgacttattcgaagggcaagtcgttctcgacattgacagcggaatgcgagacattgaaacaaatttgaagtttaattttgtcctttttacttctaacaatgagaatgtgtttaaggagagagagccgaaaagcccacactttgctcatttggacggattgtgacagggaaggcgaattcatcggcaacgaagtggtcaaagtgtgcagaaaggagaacagtctcctcacagtccgtagagcgagattttcggagattaccgatcaggcgatcagtcgggcgattcagaaccttacagcaattgaccaaaattgggtagatgcggttgactgccgaatggaattggaccttcggataggtgggccattcagttgatctctgctcccgtagaattatgaaaccgttttaggagctgccttcactcggctccaaactttgtacttgaagaaaaatttctaccaatttctccgggacaacgacccgaagtccgtgatcagctacggaagttgccaattcccaactttgggatttgttgtagagagatacagggagaacaaagaatttgtaagccaagaattttggaaattgagcggcaaggacgggagcacaaacattgaatttctatgggagcgggaggggctgtccactcagttgttcgatcgagaggctattctggtcggcaatccatggtttatgtccaaatattcttttttctcttaggctctttacgaagcgtgcactgctgttgtccattcggctcgcgttaaagaggtggactcccatccgaagaccaaatggagacccccgccgatggacaccgttcagctggaaaaactcggcagcaagttcctcaaaatgaacgtaaaacgcatcatggaatctgcagaaaagctttatcagcacgggcttatttcgtatccgcggtgaattttactttgaattaattgatttggaatatgggacatttgtaggacagaaacaaattgctattccgcagattttgatttggattcaatagtcaacagactaacagagaatgaccaatggggggattttgcgatgaatgatgtgcaaatgtgtggaggtgcaaaaccgaggaatggacgaaaaagcgacaaggcgcacccgccaatacatcccgtcaaaaatgccaacaggtggcaaaaagggggaaagggcacacgtcgcttttgtcggactaggcattttaaggaatgaaattgcgagtatggacgaatggaaagtctacgaattggtctgtcggtattttctggcgtcagtttctcgcgatgcaagtggaagagaaacgaaagtgaaggtgagtcatcttcccgatgccatttgtagcattttaagtgccaagaaattttgtcaccgaagtccttttgtttaggcggaagtcaacgaagagattttcaccgccacgggccttataatcgacgaccggggctatctcaaagtttatcccttcgaaaaatgggctgacaaagaacttcccatgtatcgaaatggccaaccgttgccgaatttccaaattaggatggctaatttatcgactcaggttttataaccgaattaaggacgaacatataattgaatcaacacaacttgcttttagcctcctccccttttgaccgaagctgatttgatcgctctaatggacaaaaaaggcattggcactgatgcgacgcatgcagaacatattgagcggatcaaattcagaaagtatgtcgtattgaacaatgccaataggtttgagccaacgaaagtcggcttggccctgatcaatgggtacgatcggatggaacaccgacacaaagtgagcaagccgaatttgagggcggagttggaagcagaccttgtcaaaatatgcgaaggtgacgacgggtgggggagagacttattggtttaaaaaaaaagaaaacagcaaagttgggggaaggggtatatcaccgttccttaaattttagtcattttcttaaaaagttgcattaaaatcagtaaaaaatttaattgtaggggcaaagacgaaacagactgtgttgagagaacagatcaacatttacaaggaattgttccggaacaccgaattgaaagtccacaaattgggcgagtctctgcgcgcaatttaccaacagaacaacaacggtctcatccgatga

SEQ ID NO: 63583 - DNA, 498 bp, Heterodera glycines; identical to SEQ ID NO: 61407
  Genomic contig location: Contig_ID=SeqID_33554; Location=260..757; Strand=+
  SCN-specific regions: Sequence locations=1-107,134-217,239-263,292-498

SEQ ID NO: 63584 - DNA, 389 bp, Heterodera glycines
  misc_feature (25)..(25): n is a, c, g, or t
  misc_feature (63)..(63): n is a, c, g, or t
  misc_feature (110)..(110): n is a, c, g, or t
  misc_feature (112)..(112): n is a, c, g, or t
  Genomic contig location: Contig_ID=SeqID_33556; Location=531..919; Strand=-
  SCN-specific regions: Sequence locations=1-276,298-389
atgccaaacaaaaacgaaatcgttntaaaatattcctttctggacttgacttggtttctgatnatcgaagctgttttctacgctatttctaaaacggttataccaaaccncnagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 63585 - DNA, 516 bp, Heterodera glycines
  Genomic contig location: Contig_ID=SeqID_33559; Location=307..822; Strand=-
  SCN-specific regions: Sequence locations=1-206,228-476,498-516
atggcacccaaagtttgtgccgatggaattattggctctgacgattctgagcacacgcttccaacaggaccaacccacccactcgaggagcaattggatacacaaactgtcgaacaacggcgtgccgtgttggagttggtggtcagccgactgctgttctttgtcggcgaagtggtgctcaagttcctctcctacgccgagtgcactttttctgtccacatcaaagacaccattctgagacgggtgggcgttgacgaaagatttctcatgaaaagtgactccggaaaacaaaaaagatcgctttttggcttaattggaatagtgtaaaaatgggtcggcgtattttggttttacatttcctttgggtgtttttaattgactattttaaatgcctttagggtctgaacactcccaaccccaaacggcctccatcacgtcatagcgagctgaattttgaaaacaccaacaaaaacaataatggggatgaaggtggaaacgatgacgaactttgccaag

SEQ ID NO: 63586 - DNA, 524 bp, Heterodera glycines
  Genomic contig location: Contig_ID=SeqID_7020; Location=55..578; Strand=-
  SCN-specific regions: Sequence locations=1-229,266-524
atggaaatggaaatgatgcagcgaagccaaaacgccaaattggcggccgtccgaaatttgcacgactttcttttaaatgggccaaaggagccgaggtttgagttaagcaattcgaaattcgcacaaaatgattgttggcatttcatttgtctcttttagcacttcgtttcggcaccctttcattgtcagtgccgaggcccgtgccgaatgtgaccaaattttgagtcattttgagaagagaatggaggaagaaataaaaaagacaaacactttgttaagttcgaccagcaaagccaaagaaagtacgaacgaaatcgttttatattttaatcatttttaattcattttaggtccacaaaagaccaaaaacgagttggacgcattcaaaaagctttacttgcaaattttgtttcgcctttttcgagaattgtatcggcaaagtgccgaaaaagtgaccaaaagtgggcagaaaggcatacggaggcaaagggcggagaaggcgcagctgaaaacgatgaacgaag

SEQ ID NO: 63587 - DNA, 1120 bp, Heterodera glycines
  Genomic contig location: Contig_ID=SeqID_7022; Location=864..1983; Strand=-
  SCN-specific regions: Sequence locations=1-65,87-1120
atgtctgttcatttcattgatcgccaggacgccggacaaaaattgtacaaagcattggcccaacttgaccttcagcagcagagagacaaaatcgtatgacgaacaatgcttctgtcgtaaagtttgatgacgtgcggttcaggtcattctggcacttccccgtggcggagttccaattgcttttgaaattgccaaagcaatgcgagtgccgttggatttgttgttggtctgcagaagagcgtacataatcttagatttttcttatgaattttaggttcgaaaaattggtgccccggacaacgatgactctgcgattggtgccatagccgagggattggcacggccaattttggtaatggaaagtgtccttatgataataatgcaaattaaaggacaacgaaacggtggccgcggttcttctgcccacttcgacgacagctgaacaatacatacagcaggagacggagagacaaatgaaagaaatcgaacggcagaaaaaggtcgaaatgacgagcagaattaattgagcacgaaggcacaacgattgattgcctttcagacttattttggtgagcatcgaacgccaattccgttggatggacgcgtcgcaattgtcgtggacgatggcattgccacgggtgcaactgctcgtgctgcgctcgccgttttgcgtcataaaaatgtcagcagaattattttggctgttcctgttgggccgcccgaaacaattggtgggaataaaagtaaaattgaaagatgaatgattcttttcattacatccagatcagtttcgtgccgaaggaatcgaagtgatttgtgtggcgacgccgcccactttcaacgccgtcgggtccttttacgtcaaattttgccaaaccaccgacgaagaagtgatcagatgcattgagaaggccaaagaatggatgcacggagaaaggtcgaaatgatgcagcagcagaaaagggggaaaaggcgaacaaaattgaaattgcataacattgtgttgtatttatgtatgttgattagtgtgaacatattcggaaataaccgttgttgtcttatgttgatttgattttgcatcagaaacaaagttttgtgataaaatgatcttcctaataaa

SEQ ID NO: 63588 - DNA, 1230 bp, Heterodera glycines
  Genomic contig location: Contig_ID=SeqID_33565; Location=27..1256; Strand=+
  SCN-specific regions: Sequence locations=1-67,89-137,282-342,364 -369,599-653,675-681,704-834,856-864,886-1099,1135-1230
atgtcaattgacaaacaatcaaacattgatattgatccatcaagcaatgaaattgttaaaatgtcaattgatgacgaggaaaatgatgtaaatcattaattaatttatgcattcaattttttaaatggatatgaaacttttaaattttaactcaattataaattaattttaaaatttcgccttattaaattcaattttaaatgaatttttaaataatattatgacgcatttaaaatatatttagattttaattcagagaaattaattaaaaaatatatttagccaagttcaagcaataaaagagccaaaaatgaacattatcaggaaaacgatgtaaaagcatattttgggctttcaatttttcaaacgatttaaaatttttaaattttaattctattaaaaatattatatatatatatataaattaatttttattttaattaaaattaaatatttatgtatttgataaaagaagaattatattttgggcttttcttttttaaatgattaaagaataattatatttaaatttaactgaaaacgagtaaaaagattattttaaattttattcaattaaaaataaattatttaaaaatatgtctagccaacttcaagctataaaagatcaaaaaatcaccaaacatcaaaaaatgaatttattcaacaaattgattcgctgctggaagcaaaagaaaatcttacacaaatttacatggacaattggtacgttgtggacgacatggccaaggaatatttttcaattgtcatcaaaatgcttggccaaatgccaccgaaaattaaaaatttgttcgaaaatgacattgaaattttgaatttcaaatttaaaaacaaatatcaacaaaacattggtggcggaggtggtggaacaattaatttggacaaaattttggtggaaaatgcgatggattatgatgaggacacacttcgccaaactcatcggagtttaattgaacgtttcgccataaaaattggcagaatgttggagattacgataaacaacgcttttgtgccgtcgaatggcataatggcaatcattgaactgcacatttatcaaacattttcggaaggactcaaaaagtaattttgttttttaatatttaaattctaaattaagaaagaattttagtattggctggaatttttagcacaagaaatctaggaaattttttttaaatccaaaatttggtaatggaaaaattaattaggaaa

SEQ ID NO: 63589 - DNA, 664 bp, Heterodera glycines
  Genomic contig location: Contig_ID=SeqID_33567; Location=26..689; Strand=+
  SCN-specific regions: Sequence locations=1-66,147-258,284-418,461-664
atgcgtgaatgggtggcgagtggctgctgtccggtcggtacagcttcaacaatgttgtgtcacgggtaaataaaattctattgaataaaagaaatatttaatttttaaaaatttttaaatgcaaaaaatcatttaaatttttttttgaaaggcgttgccaccgcctattcctggataaatgcaagaattccgggcaccccggatgatcggtcttcttgagccctttaacaaagcggaagtgccaactaaaacatattgatttaaattattattttttaaataaccatattgatttttctttatcaaccaacattctcacttacaaatttccttatttttggttttactaattaggaatatttaattattgttattcatttaattctcttaacctctacttcattttgactttttcctattttattgaattaattttagaaaaataaatgctggtgcagaaataattattggtttgagagagaattgctgttattgatgttactcaaaaaaatcaaatgaattttataaaagttttggatacaagtgttcgaaaaaccagatttattgagttcttcttggcataacttttttaacggtcaatgaaattttttgaaattttgcagttctaatagagaacatttagggcaatcgaatgatgtcatga

SEQ ID NO: 63590 - DNA, 535 bp, Heterodera glycines
  Genomic contig location: Contig_ID=SeqID_33569; Location=332..866; Strand=-
  SCN-specific regions: Sequence locations=1-87,109-203,225-272,362-535
atgaatttattaagtgcgctgaatttatatgcaactgctcaacaagatgctgtacatgctttggtgaatgtatgcaacttacttaaaaatgttaacacatctctattaaattaagatggagcttcgtcgaagggtagcgctacatgaagccggccactttataacaaacggggacctaacgaaattttttggaaatttgcaggcaaataaagaatgattaaagcgttgaatttatcaattcggttaagtatacgtgcgagccaaaagatggagaggaagaggaggaaaagccgaagaacgaggagaaacatgaagtggaaaaagaggaaaaggagtcagagaaaaagcaggaaaagaaaaacatttcttcaaaatgaaaaatgtttttataatttagccataattttttttgaaaattctttaaatttctaaagaattcttaaaagaacatgactattaaatcagtgaagtttgaaaaaaaactgatgtaaattatagtaaacatagttgactttatatgtttgcatttaataaa

SEQ ID NO: 63591 - DNA, 490 bp, Heterodera glycines
  Genomic contig location: Contig_ID=SeqID_33570; Location=126..615; Strand=-
  SCN-specific regions: Sequence locations=1-260,293-332,365-490
atgaccttcagatgccaactccgtgtggaaaagccgcttaatgttgtggtggaaatggacgaaacggagaagaagagaatggagagggaattggccgaggaaggacagaacattttggagaaagtgatctgtgggagagcagcaaacgcattagaagaggtggcacaacagaaacaaagggacggaagggagctaacaaaggggggggggataaagccaagggtaaagggggatgaagctaatccaagcgaatggggagggagtgatggaaagggagagggggtaagggagatgaagcaaagtaagctaatggtgtgaggatgaaattggccaaaaaatcttttaattaatttaattaaaaattctttgccagcgaataaatcggcgcttcgctttgcttcccaccaaaatgacactgtccaatctgaacgcttcgtacgttgtggaggaggtgatgcgccgcatgagaagggttcgacggcaaaagtaa

SEQ ID NO: 63592 - DNA, 375 bp, Heterodera glycines
  Genomic contig location: Contig_ID=SeqID_33571; Location=205..579; Strand=-
  SCN-specific regions: Sequence locations=1-253,276-375
atggcctccgagccatgggtaagcaaaggaaaatcagattattatctaatattattattcaaatttagccacgggttggataagttgagtatgcaaattttcatttgatttcaggagcagcaagccaagctaagcgagaagtactacccgaacacgccaatgctccattacctcgtcaaaatgctgaaactgcacggcctgtacttcgacgagcatctcgtttggcgcgaagttcaggtgaaatgtgatgggcaaaaagaagtttattttctcatgcaaaagaattattttcagaatgaaattcgtatttcaaagggtaaaatcatttacccgccaatcggtgcaggaaaacagaagatgaaagccaaaatataa

SEQ ID NO: 63593 - DNA, 4451 bp, Heterodera glycines
  misc_feature (4410)..(4410): n is a, c, g, or t
  misc_feature (4421)..(4421): n is a, c, g, or t
  Genomic contig location: Contig_ID=SeqID_7023; Location=4..4454; Strand=+
  SCN-specific regions: Sequence locations=1-684,706-1000,1022 -1022,1052-1096,1132-1299,1322-1474,1496-1587,1609-1725,1749 -2112,2134-2394,2417-2499,2525-2657,2679-2713,2736-2920,2942 -3281,3319-4451
atggacacggtcatccaaaacttggacgtcgcgcaaggaacggacgtcacaacattgtcggtttgtttccgctcccattcagctctcgtccgctgtacggaggccgtcttttacaaaccgcacggcgagcagttgacagcaagacgcgacgacgccgagcgggcactgatgaccgaccaaacagcgttcaagttgccgaaaaagggagtccccctaattttagtccatcagaacacgcctgcccagcgcgacgaagtgtccacctcgtcagccaatcctggccagaccgacacagcgatgagagccctctggcgtttggcacagaccttccccggcatactcatccgctgcatttgcttctacgccgcccaagccttggaaatcgaacggttggtggcccagcaagaaattcccgacattttagtgaccatggcggacgcaacacaggggcacgaatcgtcacttgtcgtcgtcgtcacaacatgttccgtcttcgacagtgcagctgactcacagccgttctgggcggatgccgcgcagggtggacgtcgccatctcccgcgccagccatggaatgatcatcattggcgatttgctgctgctcaaccggacggatacgtggcggcgctacctggaccaagcgacaacggagacgacagtggtcggcccggagtacttcgacttcgagcagttcaacaaccccgacaactattacgacaaggacggacagctgatctcagccaacggtggtgcggtacggtcagagcatttctacagcaagtacggtaaaaatgtgtggtacaacaactccggtgagtcaaggggggcggagaacagatatcaaccttaccttcctcaaggtggcactcgggaacgcactcgtggccgggcctctacttctggtgcgcgcagatgaaagaaggccaagctgtacgccttcagccatggacggcagccgcgcatggacctccttctttcttcattccccttcctcacgttttgcaaatttctttttgttttgactctcttctctctcactctctctctctcttgtccatttctatttaaaattatcattcattttccttttattccgaactgttaatggcctttctttccccccaattcaaaattcttaaaatgcgtcggtttcctcacactttttctgacccattctttctcttctctcatcatgcttttacatctcgtccccaaaccggaatgacccctggttgcttttctccgatttcccttgccatccatccgagaggaaggtggaccgctgttcattactgtaatgcgcagcttggccgtggaagttcggattggagagacgaagggcgaagccgagagtttggacccattcattcattcacttcattttttcttttaaggatcggggacgatcctaagggaagggggaagttgtaaggattattcgacgcatttccctcatttaattattccttattggccattatcaattcaatcacatttatccatttttcacacgtttttccttttctcattgtaatgtctctccgcccattctcttcgcatttctacttccccagtgatcagttagtcagttagtgatggaacagacttcaattattattccgatttctcgcttcgtttaaatccaacatcgaatgaataaacacatctttaacagtcaatgagtcgtttgggggttcggggcttggtcaaaggcgccttggcttttccccattccctcccaaattccatccgggataaacggtgcatagttggtctgggggcacagtgcgcatccctcattgaattaacaaatttattggcactgaatcaaaagctttttcaaaatctataaatattatatcaactttttgctggtgacagcattggggaagaagaaaatgagcgcggatttttaccaaaacggcttaggcctccaccacggtttccgagaccacgcccgacgagaccacggccaacacagccaccacgcccagtgcctatgacgaatgcttatacaccggcaccgtcgccagtgccgcacccaactcaggcaaaccatggcgattacccagcgggtccaccatataatccgcattggaaaaatcaatgcaattaactttaattaattaattagtcgattcgataatctcaacaaatgttataagatttgcaataattaaatgtaattgaccagctagtggacaatgtcggattgtttggttcggttgttacaaatatgccgtcgatattatgtgcactgaatccacaaaagtacatgtatcaaccgatgaatccaggaagtcaatgtttattttaacgaatttcaaatttaatttgtaaattacaaacagtgggaggacaagcaccctatagtatgtttacaaatgattttcattaaatttatttaaatttctaaaaacccgtaaatttttttgtcaaaattaagatgacaaccaacaaaatcctgcgcagccaaacacatcccctcccgacagtaaattctttaaaatgtacaattaattattaattgttcggatgagcctatttgaattattatggcaatctgtccattcaaattccccgccatttttgttgttgtcactcgcccataaatagacggtcattccctccctcctggtctttttcccctcattttcattttattttgttattttcctccgaccaaattgtcttcgcttttttttattgttcgtcaataaacatttatttattgatcgtcttccttaaaccctcggaccgaacaattggcgcagtcacaaaaatttggactttgctcacatcttcgggtaagaacaattgagagcattgatctttttaggactaaaagcaaaagccgagacggcacaacaaattcaccgaaaagccgggattggctgtgaattttgattttaaagccgagttggcaaaattcttcaacaaagcagtcaaagaaactgctcagtcgtcaaaagcctggtcggcaaattcttcaatttaagcagtcaaagaaactgctcttcttctaaagccgggacggctcgacatttcttctagccgagtcggctctaaaattcttcgaaagccgagtcggctcgccaaattcgttaaaagccgggttggctaaatattaaattgacacctattggtgcaatacttcaacgtttattggtttcgggtcgaaacaataatcgtcaacaatgacgtaacctgccgcgactcaacaaccaaatttgcaacaattaatcgacgtaattgctcagcaacagacgcaaatcaaccagctgataaatgttcaaagaaacaatcagccaaatccagcaatcatccaaacaattccgtcaatgccggacgtcgcaattttcgaacaatgcgacgaaaagcatcgcatcaccgaatggcttgagcgattcacttttgccattgactcgtgcgcaccgaacgcggccgatgacataaaagtcaaggcactgattaacaaattgtctgaaaccgcgttcagcgagtacagcaaatttgttctcccggccaaggtgacggatttcgactttgatgaaacaatttcgaaattggagaagctgtttgccaaaccacaatcaatatttgtggaccgatttgcatgtctgatcgccaccaaagacgatggcgaagaatttcaccaatttgtcaacaggcacaaacgacttttgaaagattttcagtttgacaaattgaatgaagaacaattcaaagggctcatgctcctaactgcgctgaagtcttcaaaagacgcagttcttcggcaacgcattctcgccaaacttacaaaggatggcgacgccgtcaaatatgatgaactgattgaggagtgcatcaattttttgtctacaatccatgaggcaaaattgatcgaaacaacttcggtgtcatcaaggacagtgaatgcagtgaagccaaaccaaagaagggaaagaccaaagccacaatccaagcaaggccaaccaagcgcaactccaaatcagcttcaatgttggagatgtgggaaaacgaaccacacccacagagaatgctcgcacaaatcggctaagtgtcccaaatgtcgctacaacggccacttggagaatcaatgcgaaaaagtgcaagagtggcgccgcaaaaacttcaaagtgaagaaagttggaactcttagtattggaatagcactgaaatcaatcaacagcgcttctcttataaagataaaagtcatgctgaacggaaggatcgtgaagtccattctcgactccggagcagagattaatgtcatcgatgaggaaacttatcgacagatcggacagccaaaaatttggaaatgtgccgaaagaggcagaatgttcgacgggacagaaaaatcttttatcggaaagggagaaggacacttcgaattccaaggcgtanaagtaaagaanatttttatgtcgccgagaagggatcgatga

SEQ ID NO: 63594 - DNA, 1116 bp, Heterodera glycines
  Genomic contig location: Contig_ID=SeqID_7024; Location=36..1151; Strand=+
  SCN-specific regions: Sequence locations=1-277,299-670,692-978,1000 -1116
cgcagggaaagaatcgagaggcaaaaatgccccgatcaatccaacaaaagttgacggcacgccaaataaggacgccgaaaaacaaatcagtcagctaaagcaggagtacaccaatgtcttaaaaaatgaattgggactctgcacaaaggtcaaagcgcatttagaattgaaacccgacgcacagccaatatacagaaaggctcgtccggtcccgtacaacgccaaaaatgcagttgacggagaattggatcgttgggagaaaatgggagtcatcggcaaagttgagcacacagaatgggcagcaccgattttggtcgtcaaaaaggtcgatggtagcgctcgattgtgcatcgactattcaaccggactcaacaatgcgctaaaagaccaccagcacccgttaccattaccggaagacatttttgccaccttaaatggaggccagtacttttcacaaattgatctccgggatgcgtatcttcaagtggagctggacgaagcatcgaaaaagctgtgtgccattgccacccatagaggaaattataaagtcaaaagacttccctttggcatcaaaacagctcctggcattttccagtcgataatggaccaaatgttggcagattttgacttcacgacagcctacctagacgacatcatcatcgtcagcaagggccaaaaagaacattctgaacatttgaaaagatgttctcgcgatttcaagaatggggatttcgcgtcaaacgggaaaaatgttcgtttttccaagatgaaattaaatatctcggacaaataatcgacaaaaacggacgcagacctgaccccagcaaaatcaccgccatcagtgagatgccagaaccgacggatgtctcttcacttcggtcatatttgggaatggtaaaccattaccaacaattcatcaaaaacatgcgcttcgtcagaaagcctcttgatgatttgctgaaaaaggacaccgaatggatttggagcgacaaatgcaaaaatgcatttgacaaaatcaaaggaattttgtcatcagaattgttgctcacgcactatgaccctctaaaagagatcatagtagctgcagatgcttctgatcagggaattgggcagtga

SEQ ID NO: 63595 - DNA, 890 bp, Heterodera glycines
  Genomic contig location: Contig_ID=SeqID_33573; Location=19..908; Strand=-
  SCN-specific regions: Sequence locations=22-148,171-591,614-783,805 -890
atgaatttggtcagcacaaaaccaattatacatcatgaaaaatgcattggagacccaatagaaaaattgagtgttgagcaaattgataggcaacaaaggttgaaaatactcacatgcacagaaaatataaaaaccttatggagagaggtaatttaaatattaaaaattaagaaaattcacttttataggggtttcaaaaagccgaagaatttgacattgcaacagtggcagaaacagatacggaagaatctttaacatataattaccctacctttgactcaattaggcgagcttataattaatagaaggagacagcaaaaacatgggatttcgaccgattcctatgatataccagagcaattattattaacacgacaaggagcaattaaattgttgttaaataagccgctaactactaatgagaagttgttgaatatagtaatcctaatttccaaaaaatgagcatatattatttttagttgggtaatttatcgaaatagagatgaaggaattgtaatatttgctacaaaaacagcaacacaagcagttgaaaattgccaaattttggtagtcgatgggacattcgaagttgcccctaaacctttcactcagctatatattgttcacggattggtaattagatttatttttcgtaaatttaaaactcttatagtttggcgatgccactttatcggctgaaaatggcgaatggataccattagcgtttgctttaatgaagaaacggtttttgcctttggctaactttttaaaaatttttttagcacaactgtttcttataacattgtttggcgagaaattaagcttttatggaaagattacactttaaatatttcaagaattcatgtagattatgaaacagcgcaaataaa

SEQ ID NO: 63596 - DNA, 617 bp, Heterodera glycines
  Genomic contig location: Contig_ID=SeqID_33574; Location=135..751; Strand=+
  SCN-specific regions: Sequence locations=1-219,241-520,542-617
ccttttccctcaacatcgactgacccatcgacgattgatcttacgattcaaaagcatgtccattcaattgtggaagagcaatcagagcaggtaaacatttttatgtcaattgctatgaccatgccttattttgatttatttgtctaaaactaattttgaaacggacaaaaaggtatccgcctacgaatcggaagaaattgaagtgaaacgaagaaaaattgtggtggaggaggacgaatcggaagagagcatcccgacacttccgccaaagttggacgaggagagcgaattgtcgcgactgaaacttcagtaagtgggcaatttgtaatgcattttttcgctgggtttttcaataaattaatttgtactgctccataaaggctgctgctatcgaacttttcgcaagaacaattggaccggtacgaagcaatgcgacgggcgagtttaccgaaatcgatcattcgacgggtcaaaaaatcggaaatgcttctccccccccccctcaccaccatttgttcagttgatccatcagttcactggtgtgaccgtcaaccaaaatgttgtaattgcaattgccggtatggccaaagtgttcaccggcgaactcattgaagagg

SEQ ID NO: 63597 - DNA, 405 bp, Heterodera glycines
  misc_feature (43)..(43): n is a, c, g, or t
  Genomic contig location: Contig_ID=SeqID_33575; Location=53..457; Strand=+
  SCN-specific regions: Sequence locations=1-65,87-405
acaaaggcacggcgctgaaactgaacaggcgcgcatttattgnccaggaagtgggctcagaacgaagagcgaaattgaggaggaggtcagaaatggcattgatacttaagttaagcaatttatccgtaataaaaatttcagtttaaatgtgcccgcgacggcaaatacccagaagagaatttggaagattggtcaatcacaggcaaacggagtttgactcagaaggcgcttttccattacacggaccgtcgggcgggcaaaggctattccgactttggtttcgtttcctccccattaattcccaaccgaattcgactctttcagccaccaccctttactacggtcgcccttacatttggccgcccgttcgcgaaattaaccgatggcactttttcatttgtgtga

SEQ ID NO: 63598 - DNA, 346 bp, Heterodera glycines
  Genomic contig location: Contig_ID=SeqID_33577; Location=316..661; Strand=+
  SCN-specific regions: Sequence locations=1-113,142-346
atggacaaaattttgccttgtcaaccttctactagcaacacaagttttacaaacaatgaaaataatgacaacaacataaaaatagacagtgacaaatgcactgtaacagaaatggaagaagacgaggaagaggacgaagagtttcaaccaaacgagacggacctgagcagtgatgatgtgattagtcagccaaatgttgagagtgatcaggtttatcaagcggcaaaaaaaaattgtagatcggtgttaatttcagctagattctgtttatcatactccgaattgtgaaactcagtggccaaaagagaatgacgaacaggttgcgatgttaataaaaaaaatgtaa

SEQ ID NO: 63599 - DNA, 216 bp, Heterodera glycines
  misc_feature (191)..(191): n is a, c, g, or t
  Genomic contig location: Contig_ID=SeqID_33578; Location=19..234; Strand=-
  SCN-specific regions: Sequence locations=1-216
atgaaaaataatgaaaaagtggaagaattgacaccaaacaaaagctcgcaagaagaaaactttgaggacgaattgtttgggcagcaggtgatttaatgtaaactcaagaataaaaaatacagttgtccttatccactttaggattcggatttgagttttgttacgacttgggaccccattgaacgatttgngaaaaagaaaatagcgacgaaatga

SEQ ID NO: 63600 - DNA, 190 bp, Heterodera glycines
  Genomic contig location: Contig_ID=SeqID_7025; Location=426..615; Strand=-
  SCN-specific regions: Sequence locations=1-17,39-190
atggcattggcattggcaattgctaaatgccaaaaagtgtgtgagggggcgaaaaaaacaaaattgattttacagggcgtgaaccaaaggggaaaagatgaactgattgaacgccacaagagcaattgattaattatttagctgaaatagagttgaaaaacagcaaaattaactattaaatgaaaataaa

SEQ ID NO: 63601 - DNA, 56 bp, Heterodera glycines; identical to SEQ ID NO: 52733
  Genomic contig location: Contig_ID=SeqID_33582; Location=255..310; Strand=+
  SCN-specific regions: Sequence locations=1-56

SEQ ID NO: 63602 - DNA, 72 bp, Heterodera glycines
  Genomic contig location: Contig_ID=SeqID_33585; Location=136..207; Strand=+
  SCN-specific regions: Sequence locations=1-72
gtgccggctccacaaacacaatccgtttgcagaaagtcgaataacagagggacgtgtccaatgagcttttga

SEQ ID NO: 63603 - DNA, 362 bp, Heterodera glycines
  Genomic contig location: Contig_ID=SeqID_33585; Location=311..672; Strand=-
  SCN-specific regions: Sequence locations=1-15,62-131,153-212,235 -262,287-362
attctctcatataagataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgta

SEQ ID NO: 63604 - DNA, 304 bp, Heterodera glycines
  Genomic contig location: Contig_ID=SeqID_33586; Location=314..617; Strand=-
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacccaagcgcttttgtgaggtataaaatttctcaaaaaaagagatagccatttttctgggatagagtataaatttaaaaattccctcaaaaataaaagggctattgcgcaccgccctccctatcatg

SEQ ID NO: 63605 - DNA, 144 bp, Heterodera glycines
  Genomic contig location: Contig_ID=SeqID_33586; Location=821..964; Strand=-
  SCN-specific regions: Sequence locations=1-144
acagccctccgtctcatacgcaagcgcttttgtgaggtataaaatttctcaaaaaaagagataggcatttttctgggatagagtataaatttaaaaattccctcaaaaataaaaggtctattgcgcaccgccctccctatcatg

SEQ ID NO: 63606 - DNA, 351 bp, Heterodera glycines; identical to SEQ ID NO: 53910
  Genomic contig location: Contig_ID=SeqID_33587; Location=499..849; Strand=+
  SCN-specific regions: Sequence locations=1-20,51-351

SEQ ID NO: 63607 - DNA, 432 bp, Heterodera glycines
  Genomic contig location: Contig_ID=SeqID_33589; Location=392..823; Strand=+
  SCN-specific regions: Sequence locations=1-118,393-432
atgatgctaatccaacgccacatccgcggttgtcgctggagtagtcgcagcgggcgcctcagtattggtcgccgcattcgtcgtcggagtagtcgccgctccggttggatcattgttagtcgccgccgctccatccgcggtcgtcgtcggagcagtcgcagcagcgggcgcctcagtgttggtcgccgcatccgttgtcgcagtagccgctccggttgcgtcagtgttagtcgccaccgcgccatccgcaatcgccgtcgttgtcgccggagtcgtcgcagcggtcgcctcagtattggtcgtcgcagccgtcgtcgtcgtagtcgcaacgggttcgttggcgttggtcaccgtcgctccatccgcgttcgtcgttgtcgctggagtagtcgcagcgggcgcctcagtgttggtcgccgtagtcgcaccggg

SEQ ID NO: 63608 - DNA, 536 bp, Heterodera glycines
  Genomic contig location: Contig_ID=SeqID_33589; Location=377..912; Strand=-
  SCN-specific regions: Sequence locations=1-129,404-536
  Gene Ontology: Cellular component=cell wall (sensu Fungi)
tgtgacaacggaccgcggggaacactgcgattactccaccgacaacgacgaccgcggggccggagcgacggtgaccaacgccaacgaaccccggtgcgactacggcgaccaacactgaggcgcccgctgcgactactccagcgacaacgacgaacgcggatggagcgacggtgaccaacgccaacgaacccgttgcgactacgacgacgacggctgcgacgaccaatactgaggcgaccgctgcgacgactccggcgacaacgacggcgattgcggatggcgcggtggcgactaacactgacgcaaccggagcggctactgcgacaacggatgcggcgaccaacactgaggcgcccgctgctgcgactgctccgacgacgaccgcggatggagcggcggcgactaacaatgatccaaccggagcggcgactactccgacgacgaatgcggcgaccaatactgaggcgcccgctgcgactactccagcgacaaccgcggatgtggcgttggattagcatcatggcacaacaacagaa

SEQ ID NO: 63609 - DNA, 616 bp, Heterodera glycines
  Genomic contig location: Contig_ID=SeqID_7027; Location=112..727; Strand=+
  SCN-specific regions: Sequence locations=1-318,341-616
ccggcaccgatcacagcgatccgaaaaacccttgaagcaaagatggaggagctgagaaagatacgagagcaggtggagcaattagtctaatttaacttcgaaccaattaaaattcttaaggaaatggtggcgcaccaaacggagaaaattgagtggcaaagagagagagaacaaatgggcggaagggcgcataaaatggtcaattaattaagggttgattatggcaaatgacaactgaaaaaaatttgtgcagaatggcgccgcttcgcatggccaaggcgtggattataagcaaatcgcggacaacgctttgcgagcggcggaagagctgcagaaacagtaccgcgagtatcaaaggcattacacggcggaggtgcagcggctgagcggacagctggtcaaattggagcaggaactggcgacacgacagcaaaaaattacggtagtggcaccgacggaaacggtagctgaacataaacaggacggccacaatgacgacaatgacgcggtcaatgtcagtgccgttataaaaatgccgacgcaacaccaggcacagcacgtgacacgaccacagaggggatatgaagtgaaacaatgccgaaagcgaccaatttaa

SEQ ID NO: 63610 - DNA, 1445 bp, Heterodera glycines
  Genomic contig location: Contig_ID=SeqID_7027; Location=2854..4298; Strand=+
  SCN-specific regions: Sequence locations=1-322,411-617,640-987,1009 -1122,1145-1445
atgggaccaactcaaaagaaggcgaggctcaacttcaccatcgaccaactcatcgtccgtccgttgcgcgactcgcaacgcgtcaacgtcgttcctccgccgaccgtaacaaacgcagcacagcaaacgcagcagccgccgttggctgcacttcagcagcagacattgcagcaactgacaaatggtacaaattgaggagggaaattggcaaaagatgactcccgcttcaaaaagaaaaaactgtttttattttcaaaatccgaatttgcgtcttcctttttcagtgcgttggccctctcttccgtcgtccgcctttcgacccctttttccccctcctctctccgcgccgttcgctttttctcccttcgctcttccgtctctttttttctcttctccgcccttctctcttccgattccgtcttctttgcccaacaatttgtcttcatcgtttcatccgtcaccttttttgatgctcactccgccaactcgcgccgctttgatggccatcgccctccgaagacaacagcagcagcattttggaagtgcgggcagttcaacagggcctagcagcacatgctcatcctcacagtcagcggacacgacggaggtgggaaacgaaaaacaaacaataaactttatcatgtttgctatttggatttcggattaacaaaacttttttctgtatgtcgcacatttcctcttcagtgtgttgccattcgtaccgaaaatcgcccatgcgttgtttctccggcgttgcgacacaaaaatttgacgcttcatgagacaccgaaacgatcgaacagaaaaagaggactgactaatcgcacgcgatttatcgcagcgggcgacgactcgacgaaagccgaatgcgaaatttgtcacaaaaaatttggacgcccgtggctgctgaacggacatatgcgaacacacagtgatttataataatcattccaagccacaaattaacacttgaaaagtattttaggcggggacaaaccgtacagctgcgaaaaatgtgacaaaacatttgcggaccgcagcaattgtcgtgcccatgaacgaacacacggaggtatttggaatttggggctaccaatttgaaaattatttataaatttcagcggaaaaacccttcgaatgccctcgctgcaagaaagcattcaaagtgaagtcttatctaacgaaacacaagaaatcatgcgggaaaagtgaatcgaaatttgatgattgatgttttggtgtacttcgtctgtttgacctttttacggactttattctcatcttctcacaatttgttctttttttcttcatttgtattatgtgaatctcttttatgcaattacggtttttgttttgtgtttgaatacaattctgacatgggttcgtccatagtcgcccccgcaaatcaccccgattcgtagagacataaaaattcattaagctga

SEQ ID NO: 63611 - DNA, 347 bp, Heterodera glycines
  Genomic contig location: Contig_ID=SeqID_7027; Location=4320..4666; Strand=-
  SCN-specific regions: Sequence locations=1-309,331-347
atgtcgaataaaacgaatgttttggatgcgaatagcaacgccaaaggaaacactttgggatttgtgctaatagcgggtggagtgttgtaagtgccttcttctcacaactttgcctcctctattacacttaattattcagcttgctccttcttctactgatcaattcggttgtgcttctgatttaccgtcggcgccgacaacggacttttgtttataatgttaacagcgaagggaagcggtcgacgaaaacgaattcaccgcccgcggatctcacccttatttcttacaaggcgtttcagtgatcttatgtattttctgtgtgtattagttgtataaaattgattaaa

SEQ ID NO: 63612 - DNA, 735 bp, Heterodera glycines
  Genomic contig location: Contig_ID=SeqID_7028; Location=101..835; Strand=+
  SCN-specific regions: Sequence locations=1-283,305-735
  Gene Ontology: Mol. function=transcription factor activity; Cellular component=nucleus; Biological process=regulation of transcription, DNA-dependent
ggtgttgccattggtaccggaaaatcgcccatgcgttgtttttcgggcgttgcgacacaaaaatttgacgcttcatgagacaccgaaacgatcgaacagaaaaagaggactgactaatggcacgcgatttatcgcagcgggcgacgactcgacgaaagccgaatgcgaaatttgtcacaaaaaatttggacgcccgtggctgctgaatggacatatgcgaacacacagtgatttataataatcattccaagccacaaattaacacttgaaaagtattttaggcggggacaaaccgtacagctgcgaaaaatgtgacaaaacatttgcggaccgcagcaattgtcgtgcccatgaacgaacacatggaggtatttggaattggggttatcaatttgaaaattaaaatttcagcggaaaaacccttcggatgccctcgctgcaagaaagcattcaaagtgaagtcttatctaacgaaacacaagaaatcatgcgggaaaagtgaatcgaaatttgatgattgatgttttggtgtacttcgtctgtttgacctttttacggactttattctcatcttctcacaatttgttctttttttcttcatttgtattatgtgaatctcttttatgcaattacggtttttgttttgtgtttgaatacaattctgacatgggttcgtccatagtcgcccccgcaaatcaccccgattcgtagagacataaaaattcattaagctga

SEQ ID NO: 63613 - DNA, 347 bp, Heterodera glycines
  Genomic contig location: Contig_ID=SeqID_7028; Location=857..1203; Strand=-
  SCN-specific regions: Sequence locations=1-309,331-347
atgtcgaataaaacgaatgttttggatgcgaatagcaacgccaaaggaaacactttgggatttgtgctaatagcgggtggagtgttgtaagtgccttcttctcacaactttgcctcctctattacacttaattattcagcttgctccttcttctactgatccattcggttgtgcttctgatttaccgtcggcgccgacaacggacttttgtttataatgttaacagcgaagggaagcggtcgacgaaaacgaattcaccgcccgcggatctcacccttatttcttacaaggcgtttcagtgatcttatgtattttctgtgtgtattagttgtataaaattgattaaa

SEQ ID NO: 63614 - DNA, 244 bp, Heterodera glycines
  Genomic contig location: Contig_ID=SeqID_33593; Location=1310..1553; Strand=-
  SCN-specific regions: Sequence locations=1-93,122-122,147-218,240-244
ttaaggttttgtgttttgactttgcttttttttccattttttccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaaaatattacttttttaaatttgtataaagttccta

SEQ ID NO: 63615 - DNA, 244 bp, Heterodera glycines
  Genomic contig location: Contig_ID=SeqID_33599; Location=601..844; Strand=-
  SCN-specific regions: Sequence locations=1-115,145-176,199-244
atgcgcactttttggctgctccgccgtgacaattacacattcttcttgaagccgccgggcgaggagaacgccgagcataatcagcaccaaatgggcaacaccgaagaatgggaggacaacaacaacaacaccaacgacaacaacgagttcaagcccattttggacccagaaatattcccaaggccaaagcaaaacgccgcggcacgacgccatcaacagccacgggacttttgctcgtcattaa

SEQ ID NO: 63616 - DNA, 510 bp, Heterodera glycines
  Genomic contig location: Contig_ID=SeqID_33600; Location=62..571; Strand=+
  SCN-specific regions: Sequence locations=1-163,208-384,427-510
atggacgactcttcaacgctaatcgaccgtgatgaagtgatgaaaaatttcaaggaaaacttgtcgttcgtcaacaacaaatatcaaatcgcattaccatggaacgacagcgaagcaccatcacgaggccgcgaagaggccgagtgagtaccttcggtgcaggaaaattattaaattttaaaaattttttaatttctttttatatatgccaaataatgtaggcttaccttttttagtgaaaattcgatcactcatattttttgatacattgagcagaagcgttccaaactttgcagggatactccccggtaaaggactcacttactctgaaatgagcaccgagctagctggctcaaaaaaattttcgaaaatctgagtctttcgtttttatttattttttgcaaaattaattcttaaatattttttcagaaagggttgtgaaacgctccagattttatttacatgttagtttaggcactctgatgctttttctatcaaaaagggagatga

SEQ ID NO: 63617 - DNA, 814 bp, Heterodera glycines
  Genomic contig location: Contig_ID=SeqID_33600; Location=437..1250; Strand=-
  SCN-specific regions: Sequence locations=1-501,523-654,681-763,806-814
aatcgattttttcaagtgtccgtttgggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcaaggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcatgtttaaaaaggaattaaaaatttttaaaaattttattcatctccctttttgatagaaaaagcatcagagtgcctaaactaacatgtaaataaaatctggagcgtttcacaaccctttctgaaaaaatatttaagaattaattttgcaaaaaataaataaaaacgaaagact

SEQ ID NO: 63618 - DNA, 3399 bp, Heterodera glycines
  Genomic contig location: Contig_ID=SeqID_7029; Location=1934..5332; Strand=+
  SCN-specific regions: Sequence locations=1-139,178-832,854-934,961 -1012,1055-1105,1139-1276,1300-1931,1953-2503,2525-2652,2685 -2717,2739-2826,2853-3247,3335-3399
ccgatgaacacatcattgcaaacaaattctgaatctgttgaatcgactgatggcgatgagtcgagcagtgaattgagagacccggtttgtcgattttttttccaactaattataagaaacaagatttaccagggccaacaatttatatatatgacttttttaaaattaaaaattatacgactaaaagtttttttaaaaattctctgattctcatttttaacattttacttacagtttttgtcgtgcatttttttacattaaaaaaattccatatctgttaaaataggaaacatttcacttttagcattctgcgctcggcgtggaagaaattgtgaatgaggaagaagcgcgcaggcgtcgcgagcagctgaatcgacgcccgtcctacaggtgtggcaccagggaagatccaagccagccttggggaacgaagctggcctgttttccatctgagtcatagttttgggccataattttccaaaataggccaaatttttcaaacgtaatttgcaaatttggtagatttttaaatttgacccgaaaaattgcccattggagataatctaaataaattttaaaaaaagaaattaagagacagaacatggcgctagggtaaaattgaagcgcatctttttaaaagtttgtttgtacctttaggatgattctcaaagatttggagacagtgggagacaaaccgatgaaaaaggaaatgcacgacgatggcaacaacaacacggccaacacattcaaccatgatcggaatgaccgaaacacgggcactacattacatcaattgggtgaggagactgaaaaaaagaaaaaatcgaaatttaaaccagccaaaaatgtcaaagttgacgaattcttcatatttatgttttacaaaaaacgaaattgccactttaaaaaatgaaatcacaaccttcgacgagttaatttttgtttaaaatttattgggtaatttaaatggtaaaattctttttatggttttctgggtcgtatgcaatatttctaatagaaaaaattcttccaaaatttaaaaataagtttcttatatgtttttccattctgccaaggttcgccgggtgaaaatcaagcatttgcaagcagttccaacaacagcagcaacaacaacaatgttggtgttggtgggctaaagccggcaaatttgccctcagggctccgtgttggagttgtaggaacagctgcagcttccaatcagccgcttactcagcacatttcgccgccgacacaacaaaatttggcggcacttggtatcacttactattttcaaaacataaaacatgcatttttttgttattgcctatttagggcccaaaaattaaaatgaacaggttttgacgatgaaccggggcattcctggaccaaaagtcctcgtttggtcgggattcccggtcttgctgttttccctccatatacccgggagttccagaaaagtgccgacggggccctggtcccatccatgcgttatattgccgagtctgggttcaacttgacccggtcatcgggcacttttatagtaggctaaaagttggcagcagttcgggggggggggagtatgtacccccactttttcttccttggataaaaggacctgacgttagttaaatgcaatttaccaatttgggattcgaaaaaattcagaattgaatagagagcaatacttttctctatctctctcttttctaaaaaaatgtacgcttcaggacagttaaatttgattggcaatccggccgcatcgattgcccaccaacagcaacaaaatcgcctgatggcaactgttgctgaaatgccgtcacagccgcaaccccaacaattgtctgccgcaacaaattcggcaccgccgccccaaccgttgctagccgccgtgaacaacctggaaatgttgggactcaaagcgccggatgcacttggcactgccgcatttggacccaatggtaaagctgaccttatcagacaaaaaacatggaaaggaaggcctgatttaaaaaacaaacaaacaaaaatttagaattttcaaacctgccagtgtgtgagggatttaactattcgttgcataaagaatccactttttttagttttagttttttcttctttttattgaaattaaagttttgtgaatgtaatatgacattcagttaaaattgtcgaaccaaatgaaaagtttcctaactcgttgacaaaatatgacttattgttaatccaaaacaaacactaaattagtttttatagcctcagtatgtctctaaaggtataaatattctcagtttagaaaaagcacccaaaactttattatgtgacatggtacggatttttgaaaactgtggcaaaggaagtctttggacaacggggttttcttaaattttttgataactttttccagtgctgtttttaaatttagtttcttaaatttgtacaaaatccaaaaaaaaatcatttttttaatgttttagattggcaaaacaatttgctatcttcgtatggccgaacccagcagcagcaatcgccccaggtatcgctgatgcagcagcagcaacagcagcagaacaatgctgccggcgctgttgttggcacgatggcaaacagtccgctcggcatgaacaacattggcgtcgttgccggacacgcagcagcactacagcagcaccaccagcagcaacatgtaacaccgccaccgcatgggcttggtaaattactagaactatccagaaaacagattcgggaggggcacccgaaaaccttttttgtttattcgacacagtgggaaatataggaaatttttttaccggttttcgcaaatttggccatttgggatcaaatttttcaaaaccatgggatcaggtatgcgatagtgaattcaagactgaacatttcccgatacttgcttactccggcactcgacacgaaatcgagattatcggataatttttttccattaatttttccggagaggggggggggggggaggaggtctggtcccgcgttcaatgacattgtttttgttacttaatgcaattttgaatttatctaaattaattctcattatgcattttgctgtgcctttcttttaaggttcgcgccaagggtccgcatcactcacttcattgtacgttaagtgccgacaaaatcgctgtaattgactgtttcagctccccaaacgttaggtcagagggcggcgatgacaacacccggaaaagacaagtgcgactgctcaaaaacaggtggcataatttaatttgatttaattttctacaattttttgttttttttttcttataattttcttacaaaaaaattattcaataattaaattccagggaagcagcaaaggaatgtcgtcgtaaaaagaaggagtatgtcaaatgcctggaaaatcgc

SEQ ID NO: 63619 - DNA, 499 bp, Heterodera glycines
  Genomic contig location: Contig_ID=SeqID_33603; Location=472..970; Strand=+
  SCN-specific regions: Sequence locations=1-107,134-263,292-499
atggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgatagtgaaagcatctgagtgcctaaaataacttgcaa

SEQ ID NO: 63620 - DNA, 253 bp, Heterodera glycines
  Genomic contig location: Contig_ID=SeqID_33605; Location=26..278; Strand=-
  SCN-specific regions: Sequence locations=1-253
atgtattctccatttgatttgtttttggtttcttcgggtcgtcaattatcttcattcgctcatctctttgtgccaattaattgccggatttttgcgccgaatgttcgaaccatgtcgacaaagcctcccgctgataatgagtccaacaatgaaggtcaacagaagagcagtaactcactcgcacgagacgggaattatgaagatggaaatatgaagaatagagacaaacaaaaagagttcggaggacctgctg

SEQ ID NO: 63621 - DNA, 253 bp, Heterodera glycines
  Genomic contig location: Contig_ID=SeqID_33608; Location=920..1172; Strand=+
  SCN-specific regions: Sequence locations=1-253
atgacgtcgggcgctactgtaaaagtgacagtttttgaaaattttttcactttttttggtaatttttttttgtttatttacacataatgatgtatattaagcattattgtcatattcttgatcagcgacctctaaaacccccgggtatttggtttcatgactttttaaacaaaaaaaaatttaccaaaaaagtgaaaaaattttcaaaaactcacttttacacacaccatcccaaaaaacgagatgtgtacca

SEQ ID NO: 63622 - DNA, 461 bp, Heterodera glycines
  Genomic contig location: Contig_ID=SeqID_33609; Location=99..559; Strand=+
  SCN-specific regions: Sequence locations=1-461
atggacgaaaaaattgaattcgacgccaagcaggcccatttcaagcgaaaacttgggccgctgcgttatggcaaccggatcccgaaggccgaaaaggcccactacacaccggaacagcgagaggccgaccgctggttgtccaaccacgcttggccgcccccagcgcccttcaagggcattcttttccccgccaagagtaagtgctttaaaatttttagtctgggactggaacaaggcttttaagactgtaatttctgtacatttacatgggtacccatataaatgtacattaagtattgctttttatgtaatgtttgatttttagtctggcactggaaaaagggggccgctgcatatgcttcgcactggcgagacgagttcttggggtccaaaaacccggacgtcaaggcagctgcggacgccgctgccaagggcgactttctcaaactcggcatcaacga

SEQ ID NO: 63623 - DNA, 649 bp, Heterodera glycines
  Genomic contig location: Contig_ID=SeqID_33610; Location=423..1071; Strand=-
  SCN-specific regions: Sequence locations=1-72,94-176,222-520,543 -555,577-602,631-649
atgacggaaaaattgtccggactttccagctctgttagctcatatctttcggtaagtgatttcagcaccaaattccgtttaaccaatgaaagtttttatattaacccctcaattattacacattgttttagaagaccccagcaaaaagttgagatgtaagcttttgattttcaaggctttctttgttcttttgcttctttcctttctttctttccctcttttgttcgcttttttcgtttttctttttccgacttttttgtctttccaccagaattagtgaaataacactaaaaaagagtggcggggggggaatgctcttttcttgatgaagttggtggaaattcgaaaaagtccggtgggtttgttgagggcattctgtccattttgctacttaaaatcacaaaatgatttgtataaattgcaggaccggtactgactgatccgtccgagttttgtgcgatgagctgaaaaagggcgacgaagaattaaggaaattttgttgtatcgtttcatccattcccaccactcttttcatctgttgttgttgattggacaattcataacaaagtttcatatcttatcacattcgcctatatgtactgtattattattatttgtattattgtacgacatggacagaacaaataaa

SEQ ID NO: 63624 - DNA, 4790 bp, Heterodera glycines
  Genomic contig location: Contig_ID=SeqID_7031; Location=1..4790; Strand=-
  SCN-specific regions: Sequence locations=1-62,84-223,245-819,841 -947,974-2268,2291-2311,2333-2421,2443-2834,2856-2925,2947-3071,3093 -3560,3584-3816,3841-4008,4030-4790
tcatttcaaaaagctggcggatattccattttttgtgaatgaacaaaattgcatttgtttgctataaattttcaaatattttcctttcgtcatttcttcaatcacaatatttctgtccgtattaatttttcatattccataagcattggccatgttggcatccgccaattggtcctgaattgtttttttagtttttccgtataaatgccattcacctcaagcaatcggatcctcctctcgtgctgtcgtaagaccactttgattttggccaattcgtcttcaacgcttccactgacctacaaaattgaaatttaaatgagtcattcactaataatgatttattagctaatcaccgcggcagcggatgaattgctcggccttcgcgatgcgttcggtgtcgttgcggcggtgctttgtccgtccgcttctccgcttctgttctgttcccgaaggattccgtccgattccgctacgacattggcggacgttaagaaacatccgctcggttgaggcgatgcagtgggagaggaagaatggcaaatcagcaactcttttgccactaaaaaacgtttatttatgtcgcattttcagatttcctttaagccctctacgacgtccttcaacattggttttgtcctgggtactgttagaaattgttgaaactgtcccctgcccccctctcactcccatttatcaaataaaattttgccgtaccgtccgatttgccatcattcgcctcgccatttattacattctgttgctgctcttcgtctttgtcgcgatttgcgaaataatttgtatttcctccctccgcccccttgacaaaataaatcctttattttacaattatcccccctccttttttcgcttcattacaccacttccgttcccgacggccgactggccataaaagactttgatttccctgcggttgcttcttcttgccttttcattctttcccttggatccttttgtggacttatcccccttttcttcgccgttcgctcgcctttgctttcgcatagccttcgcctttgattcatcgctttttttccttggacttaattggtggagataaagagtttttgaaagcgatcttttgtttggaattcgtttgtctttctgattttgtcttaatttggttttaattcggaattgggtcagcactcattggccaattccgacacaacggccgggaaacctcccattccccccctttttttgtctaattgtaccccattggtttttcactttgttctctaattgccctttccaatttcttttgtaatccgcttttcacttattctcgtattcatgtctgcccatttccgtgcgcaacttaaattggcttatactgaagccgaagagcttctctcggacgaccgacaatttcccatcccagcgcgtaataatcagcctgattctgtttttctcctaaccgttcgttcatgtatccaatctttaaatgatcatgtttccgatgtccaatcaattttttctgttcttaatgacaattctgaccgatggatggcccttagaactaacatgactggggccgagagaatccaagataatcccatttatgacaattttgtgatcgaatgtcccttcccttcgactgtttccaacctccggaagtaccttcggacccttcgagaccaaggccgtgccttagaagccaacctccctgccaaggttcaaaatactcaaaatgccgcccctccctccctcgttcatttgcccaaaacgacgctaccgactttttccggggattgcacgacttatatgactttttggaacacatttaaagcgggagttcatgacacgaacatcccgaattctctcaaatttacgtatttaaaacaatgtctttctggtcccccattgactttgattaattccctcccagtttttgacgattcatatgacatagctctcgcccttttgtcaaaacactacgagaacccagaggaagttgctcgtgcccttcataattctcttagaaagctcccccaaatccgaaccggtgaatttttttgtgatgaccttcgttccctccttgaccaattggaatgtatttgtgtacaaatgtcacaacaaaattgttcctatgatactgtggcagtccaaatggaagttgaggagagacttccccgcttcattctcgacgaaattttcatgtcaaaggaaaacgacgacgattggtcaacggacaaactgaaggcacgcctttgggccattctcaagcgaaaagagcaaattcagacgcttcaccccaaagttcctgtttctccaaggcacaaattccaaacgaccccttcccccctttccaaatttggcaccccttctcattcgccccccgaattcccaactcttacttttcattccaagagaagtcaacagtctaaccacaaacaaacaaatgaaaaatccaatcctaaacccaaattaccatgccttttctgtgacaatcctggtcacttttcaagtttttgtaccacatttactgatcaaaaaacacgcctcgagcggcttaaggctctcaactggtgtttcaaatgcttaaaacccggccatttttcccgtcaatgtcctgctccagcccaatgttctaattgtaagggatctcatcatcgagtgctctgttttaatcgatcggaaaatccccatcgctccaccaatttcagttattcccaaccgaccccaacttttcctcagttttcgccccctgccccgttaattcctccatttcaataccattcttctccgccccctatcattactcacagaacgtctcattcgccttctatccctgataacccctccggcattacagcacacatcaaccaaacaaatacggccatcaccactgctcatttggccaccctcccttgctcaaatgtgtgaaggtcagaatttttcaccctcaaaattacaaaatttcccgggaaggcatcggtcttttggaagacgcaagtacccactcgtacattaattttgacgaagccaaaacccttaatttgaacttggcccccgtttctgtgagattaggtgtttttaatgacccaaagtccagagtcatccagactttttcgaaccaatttggcctacaattaatgaatggacggtccctaattgtctctacaaatgcaattggctctcttacccagcccacctcatatttgccattttcccctgaattgctttccaatgttgaattggtccataaattccgctcaactttgccatcacatgtgacattgagaaagcatttttacaagttgctgttcacccggaacaccgggactgcgcacgttttttatggcttaaagatccccatcgcccattttccaagtccaatatgcaaattttccgcttcacccgtgtatcatttggtctgacttcttccccctttttacttgccgcaacgatacgccatcacttatccaaatttccatccgaattatcacaagaagtggccctaaatacttatgtggacaatattctcctttccgtacaaagtcccaatgaagcccaaattaaagccaaatccattatttcactttttcaaagggcaggaatgacactccgagaatttgccagtaattccgaaaatgctctatccaaactccccgacgacataaaactctcaggttctgaacaaaaatttttgggtcttaattggaacacccaaaccgactccttggaatttaatttatcccctccgaataatgattttatcccttctaaacgctccattctgtccttcattgcgtctcaatacgacccccttggccttatttccccactcattctcccattaaaaatttttctccaatcaatattccaaaatggcagcgattgggatcaaactctcccaacccaaattcaaaacgactgggattgcgcaattaaaaattggaaaaatgcagaaaaggtgtccattccccgttgtcccgttacactcccattggagggaagaaattatcagttacattgttttactgatgcctcctctctcgccatgtgtgccacagtgtatctccgaattacccatccctctttctctcaagcagaagtgtttttaattttttcaaaaaccaaagtaaaaccgactcataaaggcacgccactgaccattccacgactcgaactcattgccgtagaaattgggacgcgggctttaaaatttacccaatcgcacttttcctccttaaatttggaccccgaattaaccatttggtcggactcttcaattgtcctttcctggttaaattctccccaaaattcattggaaatttttgtccaaaatcgaattaagtcgataaaaagtacatcaaatttggtaatccgccatttaccaggttctgaaaaccccgccgacatcggcacaagaggcctgaactccgcccaaattctttccaatgcctcagtgtggtggtcaggtccaaaatggctcccccttctcccaattaattggcctgataaccgccaaataaaacactttcggaactctaaatccgaatcgtcttcaattttggccactccactgtatacttttgcgacggaacaactttccgataagcggttaattgatttatctcatttttcccgcctcccaaaggcacttcgaattaccgccctcgttttccgttttatcagatttgtccaaaagaagcaaaatccaaaacctaactcagcccctatctcatttattgaacttaaaaagtcatttaaatttcttattgctcaagagcaagcccatcacccgccctcggaccgagacactg

SEQ ID NO: 63625 - DNA, 894 bp, Heterodera glycines
  Genomic contig location: Contig_ID=SeqID_7031; Location=3768..4661; Strand=+
  SCN-specific regions: Sequence locations=1-50,77-183,205-779,801-894
atgcgaaagcaaaggcgagcgaacggcgaagaaaagggggataagtccacaaaaggatccaagggaaagaatgaaaaggcaagaagaagcaaccgcagggaaatcaaagtcttttatggccagtcggccgtcgggaacggaagtggtgtaatgaagcgaaaaaaggaggggggataattgtaaaataaaggatttattttgtcaagggggcggagggaggaaatacaaattatttcgcaaatcgcgacaaagacgaagagcagcaacagaatgtaataaatggcgaggcgaatgatggcaaatcggacggtacggcaaaattttatttgataaatgggagtgagaggggggcaggggacagtttcaacaatttctaacagtacccaggacaaaaccaatgttgaaggacgtcgtagagggcttaaaggaaatctgaaaatgcgacataaataaacgttttttagtggcaaaagagttgctgatttgccattcttcctctcccactgcatcgcctcaaccgagcggatgtttcttaacgtccgccaatgtcgtagcggaatcggacggaatccttcgggaacagaacagaagcggagaagcggacggacaaagcaccgccgcaacgacaccgaacgcatcgcgaaggccgagcaattcatccgctgccgcggtgattagctaataaatcattattagtgaatgactcatttaaatttcaattttgtaggtcagtggaagcgttgaagacgaattggccaaaatcaaagtggtcttacgacagcacgagaggaggatccgattgcttgaggtgaatggcatttatacggaaaaactaaaaaaacaattcaggaccaattggcggatgccaacatggccaatgcttatggaatatga

SEQ ID NO: 63626 - DNA, 364 bp, Heterodera glycines
  Genomic contig location: Contig_ID=SeqID_33615; Location=140..503; Strand=-
  SCN-specific regions: Sequence locations=1-364
atggctgaggccagaaatattgctgccttaagcttcaccgtaacacacgatggcatttccgtctcttatgaccaggaagttctgcgggacatttggcacgcgttttcacgcagttataaaaaacgcatcgcaaaattcgaggtttgcttttatttttgatatttacttttgtatttttcttgtatttcattaactttcgtgttttccagaatgatttcttcgctgggattttcccggccaatatccgttcgttggccattgtcattttccttgtggccgcattgaatgtttcattcggaaatgacaaaactccgttcaatcttgccgataagctcaattactacgtcttttccaatatcaccac

SEQ ID NO: 63627 - DNA, 512 bp, Heterodera glycines
  Genomic contig location: Contig_ID=SeqID_33620; Location=119..630; Strand=-
  SCN-specific regions: Sequence locations=1-87,109-117,148-512
atgagccacccaatttggcaaatcggtctttttaaatgcattaaagaagattcagtcgattgcttggagtgtaagcaaaaaaaacgttattaatttttcatcttcatcattttttggtttaaaaatatattttaatacttttttatactttgaaagacttttttattaatacagattttgaattccaatcctgcaacaggacccgcaaatttgaaatttctggtctctagccgtagtctcgccccacctactggccgccgtagtcgagtgtgcggcggtttttagcgcaataagcaaaaaatttgacgaatttttgttattttttgactgaaccgggtttgaggaccaataacttttgttaatttcttttttatctaaaaattcctttggattcttgattaacagacgatgaggaatcgattgataagtattttgccgcaattccatgcattttaagtcagtggacgattcagtcccaaagtcatttggccatttcagtcccgggtctgtaa

SEQ ID NO: 63628 - DNA, 164 bp, Heterodera glycines
  Genomic contig location: Contig_ID=SeqID_33621; Location=135..298; Strand=+
  SCN-specific regions: Sequence locations=1-136,158-164
acattgacacatgaaattggccatttgttgggcttggaacattcatctgatccgagggctgtgatgtatccaagaaaaaaggagcaccagccgggctttgaactgtccgacgacgatgttagggctatacgatttttgtacaattaataaaattcaatatttaa

SEQ ID NO: 63629 - DNA, 3042 bp, Heterodera glycines
  Genomic contig location: Contig_ID=SeqID_902; Location=614..3655; Strand=+
  SCN-specific regions: Sequence locations=1-516,539-885,907-960,987 -2853,2876-2929,2951-2994,3018-3042
atggaaaacttggaacggacactcaatcatactcgtttgactagacagcgagctcaaaatgaaggaatattgctcgacagagatggaaatgttttttttcgggagaatccaccaaatagaactttaggcgtgatgaaccaaaacgtggtggtggcggatcccaatttggagaattcggagcagctggactcgatggaaatgagacggcgccttttgaacccgaacaatgacagcgcacttggacagttgcgacaaaatgaacgtgccagccttgacgaaaacgaagaagaggaggcaaaccaaggttttatgcgaaaccgaacggactggacacaaaatttgggagagagggcaggcccaacccaacaaatttttcgaaattttgtctttggacattcccaaaatgaagatgacttcttcgatcatccaaacattagaagaacttcgactccggtcaatgaaaaccgctgtgttggggttggcccgcaaaaccttaatgaaatagggttgttagccgaacaaattgggagggtcatcgttggtcagctaaatagtgctcatcaaaatccgaacacaaacccggcaccaaatttgacgcaacatggtgttgaaatccaccagcaaatacaccattcggctgtttttgcgcgtcgagccaataacataccgtttcgaatgccgggtcagcaaaatccagcagcgattcaacaaaattttggtcgccctcaatctcaacaaattcaaccaccaaatttccaaccccgtcagccatatgcttggcaaatgaacgaacagtgcgttcaagtgcaacaaccaccaatgccgcagatgaactatcagccgcccccgacctttaacacacatcaaaatcagcctaattttggcatgggaaattttgattttgggattgtattggagcggatccctgacctctcaggcaccgaaggatcggatggtatcaaaaaattttttaaaaagtttgacttttattcattgaattggtcggatgcgcaaaagattagggctctagaatcaaagctgtatggtcgcgctgagcgcgcattccaaactgcgcaaagtacgcaaccctttcgctacgaaccaattaagcgcgaaatgcttaatctcctggacgaaactgacgcacgcaatttgaatgcgtttgatgaactgatgcaaggcgtgagacggggaccaaacgaaagcattgacgagttagcgaaccgtatttcaggcttggtacagagagcttacaacggtttgccacagcatttgagcaacgaatacgccattaagtttctggttagagcgatgggcaatcctgagctcgcgttaaacctcgagcttgtgagaacgccaggcatgaccctggaccacttcgtgtcacttgccgcgcgtgctgaatctacgcaaaaggcaacacaacgattttcgaggccggacaacagagaaaggacttggagaacgaacacaccgcaacatttttcccagacgaataatgggccctcaagaagcaattttgaggaacggggccagcaaatgcaaaaatttggaacccaatcaaaccgaagttggagttgcttcaactgtaacagcccaggacatttggccagagattgtccccaaggaaaaatttttcgcgcaattgagcgaactaactcttctacgacaatgaatcaacaaggcaaacaacaaatgggttataatcggcagcaaatgcctgagcccaacgaaaacccaccaaatcggcactaccagcaaaagaattatttgaagcaaaattgcttagttctgcaagaggaacaagttcatcaaaacaatttcattgttggtgaattgaagcaggacctggaagatttttttgacgaaataaggaaatgcgcgacggaagacaaaaattcaaatttttcaaaagtcggaaaagtaatggcagttttggttgaagtttttggaacgaagacgaaggcaatgctcgacggaggcgcacaaatttctgtaattgaggcaaagttcctctacaatttgataagggacaaaaaattggacgttcggaatttgagtgttttgaaagcggaaaatcgcatttccgatgcgaatggcaatcctttggaatgtttaggagttatttgtctgccgataaaacggcatgagaattcgagcgaggtcaaagtcgcgatgcatatcgccaaatcgtcgattggatttgaccttctttttggcacgaatgcgcttaatgaattgggctataaaatgtacgatgccatcagcgacactataattgattttgaaaaagctaagcaaaacaaaatcaattcactcgctgtgatctataaaacggtgctagaaccacgagccacgaaatttaatggatatggcgagccggatcaatatgaaggcagagaaatgttattgccgtctgatcaaggaaacgatcaaattcggttggagccaacaatcgcgattagccgtgacaagcaagtaatggtgaagaaggaagggaaaggtggagacaaaccgccaaagaaagggcagctgcagaagagacggacaccttatgacgttcgggaggacgaaggcgagcaaattactgccatcaccaaatgtaaacgcgtgaaaaatgtgtcgaatttgctcccggctgtggtgccgccacccgagggaatgtcttacaacccgccgattgacggttatttgagaatggccgtaataaatgcgaacgaagaaagacaaattgaaaagaaacggcggcggacagagcgaaggattggcattggcactgacgaagtgtcggcattgccggctttgcgggaagaagtgacatattccgtcagaggaggagtgaccgtgagaatgaaagaggaaaaagtgaaggaaatggcggggggagagaacgaaaaagttagtcccaatgagttgcgacttcaaaagcgaaaaaccacaaaaggaaagaaacggcagaagttgcgaataaaaaaaagagagaaagaaaacggtggaaaaggaagtggagggaaagatgagaagacaattggacagttttga

SEQ ID NO: 63630 - DNA, 1256 bp, Heterodera glycines
  Genomic contig location: Contig_ID=SeqID_904; Location=1006..2261; Strand=-
  SCN-specific regions: Sequence locations=1-100,128-198,221-246,369 -400,435-459,498-786,839-855,877-1137,1174-1256
atgtacattgagcagataggcagagctcaattaagcaccgtatcgatccaaggcggatggacctgtcgctgctgtaataggcataagtggcagggaaatgtgggaagtgggggagggggaagggaagttacgcattttgccgaaaaatgtgtcaagaggggatatgttaagagtgagagtggcgtggcagcagcagcgatatttatgtacattattatgtacatagtgagtgagtgcattgtgtgggagaaaaaaagaataatgacgaagggataaaagcagggcaaaaggagggaaaggaggaagagtggggggagaagaggaggagcagggtacaaatgagagaaaaaagaaaaggaaaaaagagatttttgctacacaggaggagcaaggataggatgagagagagagagaaacaaagaaagaaagaaagatcgatgaaaaaatacctaaaaggaatgaatagttaagcaaaaaggaaaagaaagaaattttgcgtacttgatacgcatagataagcacacaaaaacgcgttttccgcttggtttggggtgtctacgatgacttttataatgcctatttcggggtttttgtgcctattttaggatttttgaaaaaaaatccttaacaaaaatgcaataaaaacgaaacacacacccctaagaaatgacccaaaaaaaattttcagaaaatacaccccctaagaattgaaaaaattttcaaaaattggtcccaaaacttaatattttttcttaattttttggtttaaaaagttgttcatattcgaaaaaaacattaaaatatttaataatttctattgaaatatttaagatttaaagtgttttgttacctaaaaagcgttaataaaaaattttatatgcctattttagtgcctatttgaggatttttgtgtctattttgcgatttttttatgcctttttaggtgcctatttcgcgattttttgtgcctaaaaaaggaagtcctagtaattaaaaaaacgaatcgcaaaaaatatggacaatcatggagaattgtgtccctaatttaactttgtattttttttaagcaaaaaaatggtatatggggatattcgggatgctgatcacgaatctgatattggatttgccatataatttttctgcttttgaagggttaaagctgatttctttgttgaaatgctgattctttgacgaaaatgactgatttttttcaggcaaattttgttattaacttaaggaaattgcaaaaaaataaa

SEQ ID NO: 63631 - DNA, 882 bp, Heterodera glycines
  Genomic contig location: Contig_ID=SeqID_904; Location=3656..4537; Strand=+
  SCN-specific regions: Sequence locations=1-169,223-355,377-417,440 -681,703-769,803-882
atgatgctgccgtcattcaatgctgctccgatcattggcatctgtttgctgttggtgttcattccgtgttcaacagcagcattgacatcacaacaaccgcatacaaaaaacaacaccaacaacgacactgacaataatggatcatcaacagaatcttcggtgttagggccaccatcacggccaccgtcatcatcggcggcaccatcatcctcatcatcatcaatgatggtgatggcagcacaaaaatcgcagctgacggtgaccaatgaggacaagctgtgtgtgatgcgcaaaatttgtggcaaggacggtgaactgcgtcagaattgcccgtaagtcagtcgatgatgtattactggcatgagcgtgcatgtataaatttgcaacaaaaaaaaatcactaaaaatttccattgtcttaattttttaaaatcaagtgtggcttgttttttcaggttgaccaaattcaagtccgtagtcagaaaacaattttggaaggaggatttttttttttttttggttgctcttcgggccaaaatttttttctcttgaaaattttttcattttgcgagggagggagaattccccccctggctactggcctgtctaaattgtccgtcttattagacgtggagtctgacattcatttcgcaccattccaaatctcggatttggatttaagcaaaattcgaatttaaaaattgctcaagacttacaaaaaaaaaaaaattaaaccaaaaaaaaagtcgacagacatatttgcccgtaacataaaaatattaaaaaaaaaaatttttttttttcagttatccttaccaacccttccccatcaatttgaccatggaaattgaatacaaagaattgtgcccgcaactgtttaaag

SEQ ID NO: 63632 - DNA, 1203 bp, Heterodera glycines
  Genomic contig location: Contig_ID=SeqID_905; Location=1148..2350; Strand=+
  SCN-specific regions: Sequence locations=1-96,118-516,548-653,677 -748,785-910,956-1032,1076-1087,1112-1128,1150-1203
atgccgacgaactatttgattcatgcagaaatgtaagcgcgccttttttaaatttaaaactcttaattatttattgaatttcccaattgatcagccattaaaaaaaaatttttttttggcaatttgtgccatttccaacttttgtttcgtacaaattcaaattttctctttttaaaggtgcgcacttcgtccacggcctttgtgttaagcattctttgcggcacttcaattgaactgtgcacgccgaagaagttcttccaatacattggcacgtacagcaaggtcacccatgtgccgttcaccatcaacgtggtgatgctcaatgacagccatcctgtgaaacaaaacaacaaaatgatacgcccgatggacacgtaaggattttctggctatattatacaattaatgaatccgatcattcaatttacagcctatacacaaaaaaaatttttttttcaaatttctcacttttttgtggaaaatttttactctatttattgggttttttaatttcggatttaaaaaaaaataataatgataatattttgttattggtttattcaaattgcacaaagattcgaatgaattgtttcgtcagtgtggatttaattcaaatttacgaaacgtctaaaatttggccaaaaaactgcgcaaaaattaattttttggagaaattacgttttttttaaaattttgtaatcatttgtgcattttttgctttttgttatgtgtagtataaacaaatgagaaaataatgttataataaaatgatttttttttttttgccagggtcacttacaaatgcaacgaagtgccggataaattcgaccactcatgcgcttgcattgattgtcaacacgcctgcacttcgtccgcaccattcccacttctttttcatgtgagtgaattcaaaaaaaacaaatttaaatttttatcaatgttttttaaaaaatttgtttttccaattgagaacattttctaaactaaatttttttttgccttgaccccccaccaaacggatccgaaaaaaccaataaaatctttttattaatatgttttttattttgatttattactacaatttgtcaattttatttgttttttagtatttgatcgattaaaattgagaaattttaaatatttatttatcaggaaagctgcaaagtcgccggcatggattgtaagacggcaatcagagttttg

SEQ ID NO: 63633 - DNA, 847 bp, Heterodera glycines
  Genomic contig location: Contig_ID=SeqID_905; Location=1245..2091; Strand=-
  SCN-specific regions: Sequence locations=1-160,197-268,292-397,429-847
aaaacattgataaaaatttaaatttgttttttttgaattcactcacatgaaaaagaagtgggaatggtgcggacgaagtgcaggcgtgttgacaatcaatgcaagcgcatgagtggtcgaatttatccggcacttcgttgcatttgtaagtgaccctggcaaaaaaaaaaaaatcattttattataacattattttctcatttgtttatactacacataacaaaaagcaaaaaatgcacaaatgattacaaaattttaaaaaaaacgtaatttctccaaaaaattaatttttgcgcagttttttggccaaattttagacgtttcgtaaatttgaattaaatccacactgacgaaacaattcattcgaatctttgtgcaatttgaataaaccaataacaaaatattatcattattatttttttttaaatccgaaattaaaaaacccaataaatagagtaaaaattttccacaaaaaagtgagaaatttgaaaaaaaaattttttttgtgtataggctgtaaattgaatgatcggattcattaattgtataatatagccagaaaatccttacgtgtccatcgggcgtatcattttgttgttttgtttcacaggatggctgtcattgagcatcaccacgttgatggtgaacggcacatgggtgaccttgctgtacgtgccaatgtattggaagaacttcttcggcgtgcacagttcaattgaagtgccgcaaagaatgcttaacacaaaggccgtggacgaagtgcgcacctttaaaaagagaaaatttgaatttgtacgaaacaaaagttggaaatggcacaaattgccaaaaaaaaatttttttttaa

SEQ ID NO: 63634 - DNA, 1004 bp, Heterodera glycines
  Genomic contig location: Contig_ID=SeqID_7032; Location=383..1386; Strand=-
  SCN-specific regions: Sequence locations=1-200,272-491,513-514,536 -560,613-1004
atgaattatgtatgtttaattctaattttaataaacagatatttaaattagattgccacgggacctggaccgggacgggaattccccgtcctccgaggtcacggtccaggttcccggtcccggattttaaaaatctcaagtcccggtcccgatagggaaaccgggaaaaacaagcactggtatttcaaccatcaagaaggttattaatttaattaattttttattttacttaaaaatattaaaaaattaaataaccaaaaataatatttttcagatatgcaaaaatccattttgccttctttgattgtggaatttaagaatgataattgcaccaattaagtcatgtaaaaattgttgaatggaaaatgctgaaaatggcacttttgaaaattggagaaaaacaaaaatggaaaaaattggcaaatttacgagaaatggggggaaaaatttaatgagtcatttacaaaaaaatttgaaaatcagtcaggtaaagatgacaatgaaaattttgaagaagaaacgaaaaaattggaaaaataatgggaggttttgaaagaagtaaattttgatgagaaaaagaaaacgagaaaaagtgatggataaaaattgttgaaagaatggacagatgagagatgaaaagaaagacagaaacactttttttttttgcttttttaaatttattaggatttatctttatcttttttttttggtgatttagtttttcagtatgtaataattgttactcttcatttattctcggaattatgaaaaacaaatgaaaattttattttacatttttgggattttcatttttccctttgttaagctgtttgaatgagttatgaaatcagtgttcacactaattttttgtttaaaagatccttatacaatggcaaacttgaaaataatttaaaatctaaattcagaatgaaaaagttatttcagacccaattaaaaaatggttggaatttcatataattaggaggcgatttttagtgaataaa

SEQ ID NO: 63635 - DNA, 2757 bp, Heterodera glycines
  Genomic contig location: Contig_ID=SeqID_7032; Location=1394..4150; Strand=+
  SCN-specific regions: Sequence locations=1-135,157-359,383-695,717 -925,957-1111,1145-1533,1577-1769,1793-2033,2104-2287,2368-2757
  Gene Ontology: Mol. function=protein binding
atgtatacatcatattttctcatcagcagttagttttattaaaaaccaatatttgtttacatttgaattgatttggaaaaaaatctttccctgtggcaaaggggggggggggggggcacaataaaacattacactcttctgacacaatttcctttacatatttgcatttttttccagttttattcctccaaataatcaatgtgagccttcgccatttagttcattgttattgggcttggaatgggattaacccatggctgccaagtgtccttatttataagatttgtccttatttggaggggccggtaagatttgtccttattttcaggcttccccaaactttttaaattttttgtcttaactttcttttcttaaaaaattcgctcaaaatcgtaaaaattggtcatttttttggtgaaaatctgttaacaaaatagtgtaattgcccaaaatgttttaaagaacaatcacaattttacatttttctgaaatttttttgcaaaaaaatcacaaaatttagacaattttttgggcaaaatctgttaacaaattgctttaaatttttaaaaaaattccccctgcggcgcctatcggcaccgccggaccaccccccccccccccactttaagtttgttgggataagcgctccaaaaaagtgcatatgcggtcaaatgagaaaaatggtcaccggaaacaaattaaattgtttttatgttaataaaatgttgttttaagtcgtttcatgtattttattgcgtttttttttcgcgcaatattagttttcgaaaaaatcctatttttggggtcaaaatcttagcacttagcttcgtttgtccttattttgaaaaaaaaaacttggcagctctggattaacctgctgaattagtccagcagtacataaagattttgccgattttgttttgtgatttttatttattttttaattttaatttattgccaatgattttccacatttaaatagaaaattacgaatttttacattgcttatcatgtccaaacctttggctaaacgaatgaagcttttattgagcgcgggtgaggatgcggatgtttattttttggtggggaacggagacgcaaaagaagcgagtttttaaattcaaaatatattaattatttaattgaaaattggggaaattttatgaatttaatagtttttttgattgttttttacttatattttaatcctctttagcttttgcaagcccataaattgattttgaagcacgcttccgatgtgtttgaggcaatgttccgttttgatgccaataaggaaaaagcagaattcggtaaaaatattacggaatggcacttataatattaaagcattaattatcgattattctctgctaattaacctcattaattttgaattagcctctactaattgccctgttgtggaagtccccgatgttgaagcatcagcgttcaaagtgatgttgagcttcatttacacagaagatttaagtgaattggacggagataatgcaatggcagtgctttatgccggtgaaatttatttaattttacaaaaaacaattaaattatttaattagccaagaaatacgacatccccgccctggttgaccaatctttgcaaattcccatttcaaaactgcgcaatgtgttcatggcttatgtcctagccggactttttggattggaggtgggtacgaacaatcattagaatcagattcggtctcgaatttcactggtaaacaaaatttccctaaacttcgatttttagcaaaattttttttaaattaatttagagcgtatagtaaattaagtattttagaactcatttattagtgctatccaaggccaaaaaatccatgaattttagaatttcgcaaatgattgtttgttttacattgacaaaaatgcagacactttgttcgaatcggaggaatttttgaaaattgaccaaaaaatcttatgtgaaattttggaacgtgacgaattgcaaatcagtggagaaatttcaatttggaattcggtaatttacctacttataaaattaaattaattctaattaatacatttaattattctctattaaatattaatttaaaatttaaagtcgctccgttgggccgatgcgaagtgccgtcaaaatggcatcgaatgctcagcagagaatcgtcgtgccatgctcggtccggcactgctcaaaattcgctttccgcttttgtcaaacgaggaattttcgaagaaaattggtaaaagaaatcaaatttagtaaatctttttttttgagctatcctaaaaaataataattatttttaagaggatttaacttttttttatattttttaataatttaaaataatattttattttattcctttcattttcctttgttttacagttccatctggtgtgttatcaaaagatgaagtgattggcgtttatcaattcaattcccttctaaattgtcgtgagatttccgatgtcttacagttcccaatgcaatttccgactaatggacggatttctgatcggaaaaagggcacacttttgatggacattgaaaaagtgtccgaatttgcacgagaggagcttgagagcagtcggcacagcgaaaaagtgttcataaatggacttccattgaaactattggcacaaataaaaacgaaaacggaaagcactgacaatgagaaatgtttgtgctttttccttttgtgtgattctccagaaaaaggtgctaattatctgttcattaatgctaattaa

SEQ ID NO: 63636 - DNA, 679 bp, Heterodera glycines
  Genomic contig location: Contig_ID=SeqID_33623; Location=48..726; Strand=+
  SCN-specific regions: Sequence locations=1-316,338-496,518-679
gaaattgatttacaaattgacgtaagagactgcagtggttcaagttcggctggggatattttttctcgttttgaaaaggatgcagaatttgagcaaatactgaatactgtaaataaactttatatacccctcataataattaatttaaggcaacatcccccagtccatctgccttggagacaagacaaaaagccgaagttgaagtaaatgaatatttgcgggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgatatttgaatgatttttgttttaatgcgactaaaaattttttaaattacggattacagattgcggattacgggaaattacggggtttttggacccccgtaattacggattacggatttccgtaactgagaaattcgccgcaattacggattacggatttccgtaattgcaaacccagttgcgtgcagccctgtttccgactgtccatata

SEQ ID NO: 63637 - DNA, 146 bp, Heterodera glycines
  misc_feature (108)..(108): n is a, c, g, or t
  Genomic contig location: Contig_ID=SeqID_7034; Location=41..186; Strand=+
  SCN-specific regions: Sequence locations=1-79,113-146
atggctatctctttttttgagaaattttctatgcaacaaacgctctcgaacatgaaacgaagtgcggtgcgccgtggccattttatttttcaaataatttttaaattnaatacatattccagaaaaatggctatctctttttttga

SEQ ID NO: 63638 - DNA, 146 bp, Heterodera glycines; identical to SEQ ID NO: 57273
  Genomic contig location: Contig_ID=SeqID_7034; Location=293..438; Strand=+
  SCN-specific regions: Sequence locations=1-79,113-146

SEQ ID NO: 63639 - DNA, 411 bp, Heterodera glycines
  Genomic contig location: Contig_ID=SeqID_7034; Location=672..1082; Strand=+
  SCN-specific regions: Sequence locations=1-140,176-240,263-411
atggctatctatttttttgagaaattttctatgcaacaaacgctctcgaacatgaaacgaagtgcggtacgccataattcccctgatcgaaatcatttcgaggagggctctggaatttattaaattaggatttttgatgcataaattattgttaaataattaaatttctttttttctgtttccatgttctaaagcctaaataattcccctgattgaaatcatttcgaggagggctctggaatttattaaattaagatttttgatgcataaattattgttgaataattaaatttctttttttctgtttccaagttctaaagcctaaataattcccctgatttaaatcatttcgaggagggctctggaatttattaaattaggatttttgatgcataaattattgttaaataa

SEQ ID NO: 63640 - DNA, 1640 bp, Heterodera glycines
  Genomic contig location: Contig_ID=SeqID_7034; Location=2190..3829; Strand=+
  SCN-specific regions: Sequence locations=1-156,178-811,833-885,907 -919,950-1401,1423-1640
atgcagcaacttcgccaaaacaaaacatcggacaaaggcaattttgtggaacaaccgcagaggcaagaaggtctgcaaattggcgcgttagagttcgtcatagcaatggaacgactccccgaactgaatggaacggaaggaccgaaccaaattcggaaatttttccaaaaatttctgttggcaacagaagaatggccggaaagtcgccgcgtttcggcgctggaaagcaaaatcagtggaaaggcagaacgcgcttttgacgccgccatgaaacatcgcccggaaaatttcaacgaaatttgctgcggaatgaaggaaattttgagcgaatgggattggacagaaatgcgggcattcaatgaattgtgggaaggagtgaagcgacgatcggacgaatctttggatgaatttgcggaacggctgtacggcattgtcgagtgcgcttacccaggtttgccctcaaatttcgtcgacgactttgcagtcaagcacctaattcgtgctatggaaaatccggaaatttcggtgggattggaaatagctcgccgtccaggcatgagcttcgacagtttcgtcgctctcgcagtacgcgcagaggcagtgcaaaaagccactaaatcggctggatttggaaaagagcaccggccaaattttcagcaaaaatcgacagttccgccacaaaaaattttcgcgccaaggacaaaccgagtcgtctgctacaactgcaataaaattggtcatacatctcgcaattgtatactttcccctggactgaagcatttcgaccgtccaccaaaatcgccacagcatcaaaaatttgttaagaaaaatgccggttttcggaaattttctccagctgagaataaaccgaatgtttttcggttggacaaccaactagcggcacaacgaacgaacgcggaagctggaaataaattgaaggcacccaatcggcagcgaaattcgtcgtcgttatgcagtgtaaaaagagggaaaatggaggaaaaatcggcggaaattccaaaatggtttttgaatgctattttcgctgcgttggttgtgttcgccggcgtattttcgaaggaaaagtcaaagtgtggacaaatttggaaaagtaaaggctcaatgagtcgcaccgacgaagtgaaaggacggaaagcattcggaaaattggggacaattttttcgccgaaggccggggaggaattggcggatgtcgcagccgccaatcttgaaaatttgttgaaaatcggtaaaagcctgaattttccaaatggccatcgcaggtgtgcgcaagaagctaccgctgatgaatttataaggccagatgaaaagtcggaattccgttttgtccgttgtttttacaggtctgaccctgcaacgcgactttatgccgaaccggtccactgctgacacccttgccgcccctttcaacgccgaatgcactaccgatgagcccaaagcgctgaggacatcgcttcttagagggcgaggatgtgctaatattgtgattttaaaatatatttggcgttttgttatttaatttgtttcatttttgtttgtgatttttgtggagtgttggttgttagtttatgctgtcgcagttttcctattgattgtcctcgccctaattttatttggaa

SEQ ID NO: 63641 - DNA, 883 bp, Heterodera glycines; identical to SEQ ID NO: 33634
  misc_feature (852)..(852): n is a, c, g, or t
  Genomic contig location: Contig_ID=SeqID_33634; Location=1..883; Strand=+
  SCN-specific regions: Sequence locations=1-459,481-645,668-883
  Gene Ontology: Mol. function=glycine-inhibited chloride channel activity; Cellular component=integral to membrane; Biological process=cell surface receptor linked signal transduction

SEQ ID NO: 63642 - DNA, 391 bp, Heterodera glycines
  Genomic contig location: Contig_ID=SeqID_33636; Location=399..789; Strand=-
  SCN-specific regions: Sequence locations=1-391
atgaacagatgtgtgagcaacaaactgacattattccggctaaaatcccaagaagcatccaatcttggaaacttttccgcccaaaatatatgttaacttttcgtttatgtgatggtaattagctactttaaacttaattttagaaaaatcttttaattaagagtgtctttcgtgtctttggggaaacaaaaacaagtacgagacgaacgaaggaagggccatcatcaaatttgaattatgcgagaagtgcacgatcgacaactgccgagccactgacattcttgccccgttcaaaccaaagaaataatcagaatgaggagtgataatgaatgatacaaatcgcaagacaattaaatcaatagctttatttcgatttcagtacttaaataaa

SEQ ID NO: 63643 - DNA, 385 bp, Heterodera glycines
  Genomic contig location: Contig_ID=SeqID_33638; Location=62..446; Strand=-
  SCN-specific regions: Sequence locations=1-60,84-385
  Gene Ontology: Mol. function=small monomeric GTPase activity; Cellular component=cytoplasm; Biological process=phosphate transport
atgtccaaacggaaagttttgcttatgggaaagagtggagcgggcaaaacaagcatgcgttcaatcatctttgcaaattacattgcgagagacacaagccgtcttggccctacaatggaagtggaacatgcgcacgtcaagtaactgcaacgcattcttgaataaccaaaagaagcaatttacagatttttgggtaatatggtccttcatctgtgggattgtggtggccaagaaacatttatggaaaattatatgactgcacaaagagaccaaatttttaaaaatgttcaggtgatgttattttagattttagtgctttagcattttagtgtctcaaattgaattattaaaaaaattaacccgaaagcaaaaaagcatgaataaa

SEQ ID NO: 63644 - DNA, 90 bp, Heterodera glycines
  Genomic contig location: Contig_ID=SeqID_33639; Location=572..661; Strand=-
  SCN-specific regions: Sequence locations=1-90
atgaccgagattaaaactgacattggatttgctcgcgcatttgtacggttggcattggagcgaaagctgctttacctatacctaaaaaag

SEQ ID NO: 63645 - DNA, 899 bp, Heterodera glycines
  Genomic contig location: Contig_ID=SeqID_33640; Location=41..939; Strand=-
  SCN-specific regions: Sequence locations=1-14,36-175,197-353,375 -441,484-610,632-695,734-768,800-899
atggacaataaaacgaggagtgagaaggagaaagaaatcactatgacctttggagtgagccgaacgacgattgccaaatggaagtgccaattgagaaagagagggggtaagaaagtgccaaaaaagaaatcaaaaactgaaaaagcattcaacagatgatcaatggtcggaagaggaagcaaatgagcacacatcggacgaaggcaccgaaaatttggacggaggagaggatggacagcaaccaatggcacatgaggacaatgccaatgaaaatgatagtgaaaatgccaattccagtgaaaatgatagtgaaaatgccaatggccgtaaaaacgatagtgaaaatgccaattacagtgaaaatgatagtgaaaatgacactaaaattggagccaaagaatcgttgggtgagttatttgtacagaacccttattttgtatgttaaaataatattaaatttttaatacgaaaaattaaaaattaggtcaaaactacccaaaaagaagagatgaatgggaaaaaattgtgaaaatatttgatgaattaaaagaaaaattaattcgtaagaaaagtaaactttgtaatcgtttggaaattgaaaataaaattgccaaaaaattgggcacacatcgattaataatttataaatggaagaataaatttgaaaatgacagtaagtgattggaaaattaggcatttaaattttaatgtaaaatttaaaattattaatttagaaaggaaagtttattattccgaaaaagaaaagagaaaaataataaaaatattttatcaaataaaagatgaaaagagagaaacggaggaaaaagtggcacaacgaatgggcataaatcgagaattaatttaccgatggaaaaaagagttgggagtgggacaaaacg

SEQ ID NO: 63646 - DNA, 158 bp, Heterodera glycines
  Genomic contig location: Contig_ID=SeqID_33641; Location=336..493; Strand=-
  SCN-specific regions: Sequence locations=1-158
ctacgaaggcgcaccactcagcacaaacatatgccatttacttgggaagcaaaaggaatttagacgaaatccgagccaaatatttcaagggaggtgaaaggacggtaaaagaaacggcgagaatggtcggattggaagtgcccgaagaacaacaatgg

SEQ ID NO: 63647 - DNA, 231 bp, Heterodera glycines
  Genomic contig location: Contig_ID=SeqID_7036; Location=470..700; Strand=-
  SCN-specific regions: Sequence locations=1-231
atgccacaggaccaaaccattgcgagtgtaaagaaagaggatgatcagcaacggaacgcagtaccaaaggacgaaggaggaggtgacgatgtttcgggtgctcatcagactgatcggagaatgccagtgaaagcgggtacacaccgcaacattcttgtaaaagatgtaactggtgaaaatgtaatagggcaagctgaacaggagagaaacggcccaaatggaggccattag

SEQ ID NO: 63648 - DNA, 1705 bp, Heterodera glycines
  Genomic contig location: Contig_ID=SeqID_7036; Location=1..1705; Strand=+
  SCN-specific regions: Sequence locations=1-314,336-391,413-880,902 -1705
  Gene Ontology: Mol. function=tachykinin receptor activity; Cellular component=integral to membrane; Biological process=feeding behavior
tcgctcacaggcaatttgttcgcaattctcgtcatttgtgcccaccgttccgtgcgcaccgccaccaatttctttttggctaatctcgccgttgcggaccttttggttgccattttttgcattttccaggcaaactcttctcccgaagcaataggcattctcactttgttgtagaatatgttccatttggttggcaccaacgacggacgttggcttttcggtgagaatggtcaaatggcgtgccattcactcatccttcgctttgaggtgccactttgtgcaaattgtacgcgttcgtgcttcacctcttcccctgcaccagcattggcattctcgtctgcgcctctgtcgagaaatacatcgccggtttgctttccaagtgtgccttccccttttaaagtgaacattcgttttggtgctccacccgcttttggccctcaaagtgttcaccccgcgcttccgcgttttgctaatggcctccatttgggccgtttctctcctgttcagcttgccctattacattttcaccagttacatcttttacaagaatgttgcggtgtgtacccgctttcactggcattctccgatcagtctgatgagcacccgaaacatcgtcacctcctccttcgtcctttggtactgcgttccgttgctgatcatcctctttctttacactcgcaatggtttggtcctgtggcatagtgcgccgctgaagaaactgacccaagtgggcaaattgcgaaccaacagcaacggttggttaagagaagggaaagcaaaggatcagcagaaaaaggcgattgatcattgatcagagacgacgacaattgcctcggggataggcagtgccaaaacaagagccaaacgaagtgcgacgcatccgccgccgccgccacaaccgacggatgacgccgaggagagggccaaacggatgaacaatgccaatgaatgtgcaatggcacatttacgaagggcgacaatgagcagcgacagcgaaacacacggaagcgaagaggaggacgagcggaaaagggatgaagaagcattatttgggaaagaggggacggaggaggaagccgagcgagaggaggcacagcagggagacgcgagaatggtaccatgggatgacggacaaagctcgtgccaaggactggctaaggcgatgaggaacaacgaaatgttggcactgccgacggcaaagaatgacattaccacgaccacgctgggcacacccaacggcacagtgctcatgggcacggtggagtctcgtaaaaaggtgctgggaacgaaacaggatcgcagcaccgtcgctgttcaggtgatccgactttggagcgccattgttttttcattcgccgtgctcaccctcccccaccacgtccgtcttctctatacggtcggtcggctcccttttcgaccaatttcgaactcttttcgtcatgttgaaggtgtggaccgagcagatcatatgctccaacagtttggaggcgttggttcagccactcacttaccttttgctgtttctcttctcctcttgcaaccctttcctttacgcggtattccgccgaattaatccgcagattacatcgttcgttttttttagtttatgagtcagcaatttcggtctgccatccgcgatattttcaagtgcaggtgaatcgaatgggcgcgtgggactgattcggcggcggaaattgaaacattg

SEQ ID NO: 63649 - DNA, 602 bp, Heterodera glycines
  Genomic contig location: Contig_ID=SeqID_7036; Location=2367..2968; Strand=-
  SCN-specific regions: Sequence locations=1-307,332-602
atgcacgaaatgccaaaatatgcacaaatatgcaaatatgcacataaatcgcgaaatatgcacaaatgtgcaaaatatgcacatgtaagtacgtcctagaagcttcaaaccaagctaaaaacatgtttttcgtgcgtttcagacgtcccacagtccaggaaaaaatatgcatgtgcatataattttatgccctagttatgacatcgaaggtcaaaaaatcaagttttttggtcataactttcttgaaactgaacgaatttttttgaaattttctaggctaataaaaaacacttagggcaatcgtatgttattaatattttaaaatttgattgcttatagatcattagtcaaaattctcctttatttttgcatttggctgccatatttattcaatttttaccatcaatgagaaaaacattcgacgattctcgctttttgagcatggccatcttcataatggtcaacactgtatcctaaatgcaattctttcgtaattatacaaggacttaggtattacagaaaatctaaaacattttgctaaaattcaccggcgaaaatttcaataatttaatttaatgcgcagcaaaaaattactcaataaa

SEQ ID NO: 63650 - DNA, 507 bp, Heterodera glycines
  Genomic contig location: Contig_ID=SeqID_7037; Location=522..1028; Strand=-
  SCN-specific regions: Sequence locations=1-373,395-411,433-507
atgtgtagagatgcccatcatgctgtagctttgacctgtttcttttggtgtcaatttgatgttgcatacggtacaaatgtaataaatagtgctgttcgagactctcggtctcgagtctcgactcgagaaaagtctcgggttttttttggtctcggtctcgagttttcaagtctcgggttttcaagtctcggtctcgattttcgagactcgagaccgagactttttatgccaatttaaaataaagatgaaatattttattcatttcacgcacatattttagttgtagtccttaattttgaacttttttagagtaatggatccggaaatttctgataattttccggctgaaaatgagcaaagcgaagaagtgtttattgatgaaaatgaaaacaacctttcaaaacttgaaccgactgaaccctccgcttcatttttgcgttattaccaattcaataagggtgacaaaaacgcaaaatgccgaatttttgtttaattttcttgaataaa

SEQ ID NO: 63651 - DNA, 275 bp, Heterodera glycines
  Genomic contig location: Contig_ID=SeqID_33642; Location=1..275; Strand=+
  SCN-specific regions: Sequence locations=1-275
attacgtggtcagctggcagtgcttggacatcatccgcaaggacatggtcgacccgttgagcggcaagcggatggccgagtcggacatcatcgaactgcaacggggcggcacgggctacgcggctacaaacaagctggacgccaagctgatcagaccccaattggaactgcaataaatggatgattgttcatgttgctgacttgatcatggatttgccaaatatttgctataatttctgtgtttgtaccgttttgcaatttacaagatttgatga

SEQ ID NO: 63652 - DNA, 401 bp, Heterodera glycines
  Genomic contig location: Contig_ID=SeqID_33644; Location=119..519; Strand=-
  SCN-specific regions: Sequence locations=1-17,56-62,84-218,240 -255,300-365,388-401
atgaaccgacggtaaagtatatttaaaaataaaattttgaatgaaataaaattatccaaccttttttcttatttttcacaatttcagttggatttgtagcgatgtttggatggacattctcccatctcttgaccgtgctcaactcggcctcaaaatggcattgctttccgaccgtttcgatgttatggtggacgcgcattttgatggcaaaagcgaattgacactttggaaggaaattgtcatatttaaaaacggtatttttcattaattaaaatattttttaaattttgaatttttaagtggcgggggtgaggatgggaagtgacccgcacgctatcgaagaattgccggattatgctctgcgcaaccaaatcatctttcactccctcggaatttcgtaa

SEQ ID NO: 63653 - DNA, 308 bp, Heterodera glycines
  Genomic contig location: Contig_ID=SeqID_33645; Location=307..614; Strand=+
  SCN-specific regions: Sequence locations=1-169,193-252,294-308
ttggagcatgatgaggatttcgagtctccaccacactcgtcggacgaggaggcgccagaggacgaggtggattcggactttgacaaagacgaggaggaggatgagcccacgccggcggaagaggacccggaacaaattgagcgacgacgaaaggttttttttttggaaggaaattaattcataaattcacacctgacaaaaaaaaagggtttccgaccggagacaaaaaaaaaaattcttttaataccgtccaaaaaaacaaaaaaaaaatttttttttttttgaaaaattttcagtaatgttcatga

SEQ ID NO: 63654 - DNA, 207 bp, Heterodera glycines
  Genomic contig location: Contig_ID=SeqID_33649; Location=46..252; Strand=-
  SCN-specific regions: Sequence locations=1-207
attaaaattgtcccctcaccgaaatccggaaaattccctaaaactacaacaacaaataatatgaaatacttgccgccggaacttttggacgaaatgactttttacatatatcctaaccaaaattattcgagaattctgacttcttcctggctactcatggaatttttgaggccccatatcgaaagatggcaaaaaatatttaaatta

SEQ ID NO: 63655 - DNA, 709 bp, Heterodera glycines
  Genomic contig location: Contig_ID=SeqID_7038; Location=558..1266; Strand=-
  SCN-specific regions: Sequence locations=1-158,187-208,231-290,312 -410,455-459,481-560,593-709
  Gene Ontology: Biological process=negative regulation of gluconeogenesis
cttattgtcgcttggttgctgaatttccgttaaatttgcttttcaatgcgtatttcgaaataataattctcaaaaagcaaggggacagcggcattgggtaaattaacacaaatcaacaaattttcattagtttttttctgtcataattattgtattggttttaaattttaaataaattctatttttcagtacaattcacttcggtctttgggccaaaaaagaaaatgcttcttatcaatattggaataatggtataattattggcacatcgtttggcatcgttggaggctttcccgcgttcggcggcggcgacactgtcgggtgcggtgttaatatgacatcgaaggagatgttttttacaaaaaacggcatccaattgagtgaggaaatatatatccaataaagtcaagaatttattaattttaaaataattttatggaattaaaatttaaaagttgttggccataaaattttcttaagggtccaaattcttaaaccgagcttagttaaattaaactaattaaatatcttaatatttatgttttcttattcttttgcaaatttatttcatttttaaaaaatccattttttatcagatacgacaaaaattgatgtatcggaaaccgaattggtgccattcgtcggtctgctaactcccggagacattatccaagccaattttggtccaaactttgtttacaatctctga

SEQ ID NO: 63656 - DNA, 554 bp, Heterodera glycines
  Genomic contig location: Contig_ID=SeqID_7040; Location=111..664; Strand=-
  SCN-specific regions: Sequence locations=1-455,478-554
atgcaaaaatactttcttcttacctttctgatcatctgccttatacagccaatcaaatcacatttgccaccagccgaggccgagggtaatttcccatttaactaaagagttttggccataattgaaagatgccgaacaatgtcattctttgattagattggcattgggatggttttgcgatattttcgagataataaatttttcggaaaataaatatctttatgattttaaataagcagtttttgagttaaaatcgcgcagctacaaatttaacgctttttttgtttcaagaatttgctcctaatgaacaatccgccgttggacaacttgcgacaaaggaaatgaaagtggcccaaagtctcaccgacgaaaaagtggaaaataatgccattatgaaagatagcagaaacggcagtggaattggtcagattttgctaaattcaagaaattatgtgaaattaattattattatttttacagcggcgcctgtttcggcggaggaaatgcaaaaactgcgcgatcaatttgctgagatggtaattgaaaatttataa

SEQ ID NO: 63657 - DNA, 899 bp, Heterodera glycines
  Genomic contig location: Contig_ID=SeqID_33653; Location=6..904; Strand=+
  SCN-specific regions: Sequence locations=1-899
atgtttgcttgccgttttggaccgatcctaccaattgcggcattctttttcgatccgacttacgccacagaatacggcaacaaattggatgctttattcaaacaatggcccgagccattattaattaatgagacggaagtgagtggcggaaaaacacttggccaaaaaatcattggaagtgttctacaaagaggaaaaagcccaacaaaaaagggcaaagaaaaggttaatgaggagagttcatcagcagcagaacaagaagcattcgtcatgaatcgtgcaaatttcgaaaatttaattaaacaaaactttgaaactgtaaaagcattgatggaacaaaacagcgcataccaagtgaatcgaatttatgaatggctttattcaacgacgacaaatcgacagcaagaaatgccaaaatcacagaccgaaacggctataccactcgatgatgactacgtgctcatgccaaaatcacagaacgaaacggctataccactcgatgatgactacatgctcgtgccaaaatcacagaccgaaacggctataccactcgatgatgactacgtgctcgtgccaaaatcacagaccgaaacggctataccactcgatgatgactacgtgctcgtgccaaaatcacagaacgaaacggctataccactcgatgatgactacgtgctcgtgccaaaatcacagaccgaaacggctataccactcgatgatgactacgtgctcgtgccaaaatcacagaacgaaacggctagactactcgatgatgacgacatgctcatcgcatttgtaacgaaagattatgccaattttgagaaccattgcattgaaatgaacaaacaggatttgttggcgcatgttggattactatcaaagcgaaagggcaaaggcag

SEQ ID NO: 63658 - DNA, 794 bp, Heterodera glycines
  Genomic contig location: Contig_ID=SeqID_33655; Location=31..824; Strand=+
  SCN-specific regions: Sequence locations=1-186,209-328,351-794
caactgctccgcgaggcgggtatcccgacaactgaaccggaatacgatgcagaaatatacattcatcaagtgcaagggttgtggaacgtcaaatatcccggtgagtacaaaattttcatatttaacgattaccagatgagcccaatcaccaaatctgatatcaccgattaccaattccctattcttctctaccacaacaacaaccactttgacggcatcaaaactctttcaaaatttttcaacaaaaagaactactgtctctcctgcgagtcgccgtactacaagaaaatcgagcactcattaaaatgtacttcactctgccacgggtgccgtgaggtgggagtcgactatccatgtgagccccaacaaggatacagcaaaaaatgtgagcactgtaacaacaccttttacaacaacagctgttatgaacgccacctccacaaggatttgtgcaccaaatttcaacgctgtgaagattgtggggtaatttataacataaaggttcatgggagtgttgggcataaatgtggggaacagttttgtaaactttgcaagcaatttcatataaaagaagacgaagacgacgggatgaacccctgtacgaaatgtttcatccagcccctaaagcaacaacgaattaagtcatacaggatcatcgcatacgactttgaggcgacacaggacaagaaggtggagaaccggttcgagcacgaggtcaactttgcagcggctaccatcatttgcaccgactgcattatcaacagcgactggaacaaatcacttcagggaaaaaa

SEQ ID NO: 63659 - DNA, 271 bp, Heterodera glycines
  Genomic contig location: Contig_ID=SeqID_33657; Location=35..305; Strand=+
  SCN-specific regions: Sequence locations=1-216,243-271
ttagtacttatggggccggttgcgtctcaaacatttggttcggaaaaataattttttttgatttatccgaaggcgcaaatattaataatttttttcttaaaactcatacgtatgaaaaagttacaagcattttttgagaaataaaaaaaatacggggttaactaattcggagtgaaattgtgcggggtggaaacatagtgctcccatatcagaaaattgtttttgcatttttatacatttcatttgttttaaatcttttaatatagcccga

SEQ ID NO: 63660 - DNA, 76 bp, Heterodera glycines; identical to SEQ ID NO: 53797
  Genomic contig location: Contig_ID=SeqID_33659; Location=97..172; Strand=+
  SCN-specific regions: Sequence locations=1-76

SEQ ID NO: 63661 - DNA, 393 bp, Heterodera glycines
  Genomic contig location: Contig_ID=SeqID_33660; Location=75..467; Strand=-
  SCN-specific regions: Sequence locations=1-66,88-356,378-393
atggctgtttccatttctaacgaactttccaagttggaatttgctgctcaggttattatggtatgactattgtttgctgtttttctccattttcctggttttcaggcccctccaaatcaagtgacgtcccaagaccgcaaagatgccgaggcactctttatgagtctgcgcgaaggcgtaatttccgtggagcactgtcggcaaagcttggaggccaccaaaaatcactttctcatgttcgagttgactcgcgctttggtcgctcggctgttgaaagaatgggcgcaattttccctcgacgatgtgagcaacatttgcgattatttgttcaattttccggccgtgcacacagagtattttttaaaagttaaattattcatttctcctaattaa

SEQ ID NO: 63662 - DNA, 158 bp, Heterodera glycines
  Genomic contig location: Contig_ID=SeqID_33661; Location=1..158; Strand=-
  SCN-specific regions: Sequence locations=1-58,80-127,152-158
attttctaagaaaaaataggagttttggggggcgcaggcggtgccgataggcgccgccggggaaaaaattggaaattttgatcatttataaacagtttttcactgaaaattagccaatttataggtaaaattttgaaaaattttatgggaatttatcc

SEQ ID NO: 63663 - DNA, 306 bp, Heterodera glycines
  Genomic contig location: Contig_ID=SeqID_7045; Location=768..1073; Strand=-
  SCN-specific regions: Sequence locations=1-83,105-306
acttggtagcaatttgtgatgcatcattagagtataaaacaaagttttatgataatgggtgcatcttaaagcatttttggatgaccacaaagaagataggacaattttatggcaaaatcgacgcccgttacaatggcgaaccaaagcattggatcaccgaaattgagcttggccctctgctgtggcagttcaagcatttgatcaatgatcccatggcggagaagcatccgatagaattggaaaatttatttgtgctggacccatgcgaagaggccaaactcaaattgaaacattccggaaattttg

SEQ ID NO: 63664 - DNA, 620 bp, Heterodera glycines
  Genomic contig location: Contig_ID=SeqID_33662; Location=1..620; Strand=+
  SCN-specific regions: Sequence locations=1-418,442-620
  Gene Ontology: Cellular component=mitochondrion; Biological process =aspartate catabolism
tctgccacgaccaggacgaggctgcccgagtgatgtcccatttcaaaattctaatccgcccgatgatttccaatccacccattcatggtgcgcgaattgcgtccaaaattttgtccgacccgaaattgcgccaacaatggtcagttgaaatggcatcatttgggggggggggaatgccaaaattaaataacttttcgtccaagtctttcaccgccttttaaaatagaaatcattcgtgatcatagactcaaaatccagatttatcactctatgcttaacaagtgtccaatcccaatatgttttgaggctgggcgatgtgaagggcatggccgaccgaatcatcacaatgcgctcccaactccgcgatttgttggccaaggctggctccaaacgcaattgggaccacattgtcaaccaaatcggcatgttctgtttcacgggaatcagtcctgaacaagtccgacatttctttgtgctattcccaatttccaatgattcaggtcgaccgactcgccaaagaattcagtatttatttgacgagggacggacgaatttcagtggccgggatctcatccaaaaacattgactatttggcaaatgcgctgcacgaagtgacgaaa

SEQ ID NO: 63665 - DNA, 234 bp, Heterodera glycines
  Genomic contig location: Contig_ID=SeqID_33664; Location=120..353; Strand=+
  SCN-specific regions: Sequence locations=1-175,231-234
aaatgttagatcaaggagacataattgtgccgataacacctattagctcaaatgtggcagacgcagtcttcaaccaatttatcaaagtagaacaaagtgtagcaagaaaaagtcttaacatttatggaacaccttttgtcattactgtaacagttcttaacattaatggattaagaaaaaataaagaataaattattattattttttttttgtaaaattttataaaaaatgtga

SEQ ID NO: 63666 - DNA, 476 bp, Heterodera glycines
  Genomic contig location: Contig_ID=SeqID_33668; Location=332..807; Strand=+
  SCN-specific regions: Sequence locations=1-100,123-476
  Gene Ontology: Mol. function=voltage-dependent anion channel porin activity; Cellular component=mitochondrial outer membrane; Biological process=behavioral fear response
gatttgactctgtttggtggcccactgttcaccggatcgtttgttgctaaaatgagcaacgattggctggttggggctcagctcaaggccaacctggaacagggcactgttggcccgacagcaatttcgattgggcgtaagacggcggagtactcactgcactcgcataccaccgacgggacggactttggtgcaaggtttgtatggaatggagttatcaaatttttgtcagggttttaaatgccgaagtagaggcctaaaacgtatacccaagattgtaaagtgaaagttttaatcaaatttagtattatttttttccattgtattcttttcagtctgtaccatcgggtgcaccaaaatttggagtacggtgtgcagatgggttggaagatgcgcgacgccctggcgagttgggcgattgccaccaagtacaacatgagcccagaattgacccttcgtgcaaagatggaccacaa

SEQ ID NO: 63667 - DNA, 705 bp, Heterodera glycines
  Genomic contig location: Contig_ID=SeqID_33670; Location=116..820; Strand=-
  SCN-specific regions: Sequence locations=1-705
tttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaac

SEQ ID NO: 63668 - DNA, 314 bp, Heterodera glycines
  Genomic contig location: Contig_ID=SeqID_7048; Location=136..449; Strand=-
  SCN-specific regions: Sequence locations=1-164,186-314
atgcaaatggattataaatttgatttaaaggattttaaatcaaataattgttacaacccttcgaacttaaattttgttgagcttgagtcagagttatttcgtttgacatgccatttcgacaggcgaattcggacttttgctataagcgcgttggagcaaatgtgcgaagatgcttcaatgaaaatgttggagaaggaatgcttgagcttggagtattaccctcatttggcaaacttatgcaaaaacagtgagcagaatgttcgtgtcgttgcgcttcgtattttgacaaaatttgcccttgtctaccctgaaga

SEQ ID NO: 63669 - DNA, 393 bp, Heterodera glycines
  Genomic contig location: Contig_ID=SeqID_33673; Location=922..1314; Strand=+
  SCN-specific regions: Sequence locations=1-88,112-393
atggacgcggagtcgcagcatccttttgtggtggataatgacagcgacggtttataccctcatttgggagttggcgacgtgaatttcctcttttttaaaattgttttatttcacttttcccattttaattcatccaaatttgaaaatattaaatttctacagcttgccttttcaatttggcgaaatgagttgctcatgccgttggctgctcagcttgtggcccatatcattgagctgctcggtcggattcgaaatggtatctctgcttcatttggcattcgaatttcggacctccgggggcgccgtcctctcttttggtcgatgtcaatgaatccatccatcgggagcaaaagcacagtttttgtgcatgtccattggtatccgacaacagag

SEQ ID NO: 63670 - DNA, 187 bp, Heterodera glycines
  Genomic contig location: Contig_ID=SeqID_33675; Location=103..289; Strand=-
  SCN-specific regions: Sequence locations=1-187
  Gene Ontology: Mol. function=UDP-glucose:glycoprotein glucosyltransferase activity; Cellular component=rough endoplasmic reticulum; Biological process=protein modification
gcctccaaggacattgttgcggtgtttcatcttcggcacattttgctggacggccattgttttgaggacccatcgggcaatccgccgcgtggactccaatttgtgctgggcacgcgcgctgagccggcactgttcgacaccattgtgatggccaacctgggctacttccagctcaaggccgggccag

SEQ ID NO: 63671 - DNA, 731 bp, Heterodera glycines
  Genomic contig location: Contig_ID=SeqID_33679; Location=87..817; Strand=+
  SCN-specific regions: Sequence locations=1-51,73-322,348-403,426-731
atgggtaattccggtttcaatgccccaggcgtttactgtgtgcatgccaaagtttgtggataaatgaatagcggcgattaatggtgcaaaatttgaccagcaatgacaaaattcatgaataacctcgcaatgcttatgaaattcttatcagtattttaataaaatttattacttcgaaaagtgtaaagttttaatgaaattttttctttttttttctctatctcaacttttgtcaagaatattcgaaattcaaattgagaaaattaagcgataagtttactgtttaagctttttttgatttttaaagtaaaatggctaacgatgttaacaaaaacaaaacctgaaatacaccacggcaaagaaacaaacaccaaacaatcccattttaagcaagaaaatttcgccatttatttgctcaattttcactgatttattttccattccaattttattattgtacacattttgtttgttttgtttgtttgtcgtcgtacaaaaaataatagtgcgaaaaatagtgaaaatgaacaaaaagagatttgtcagctcccccccccccccacactttagaaaaccaaacaaaatttgttagtgcaaaaaaagcaacaaaaaactacattttttgttggtaataaaaaaactaattgagaaatgtacatttttaaaatcgatgcttcaaattttcataaagtaagctcattttaatagaaatgaaaaattttcagaattaa

SEQ ID NO: 63672 - DNA, 1850 bp, Heterodera glycines; identical to SEQ ID NO: 7051
  misc_feature (896)..(896): n is a, c, g, or t
  Genomic contig location: Contig_ID=SeqID_7051; Location=1..1850; Strand=+
  SCN-specific regions: Sequence locations=1-51,73-147,169-187,211 -740,762-967,993-1675,1698-1743,1768-1850
  Gene Ontology: Mol. function=protein binding; Cellular component =voltage-gated potassium channel complex; Biological process=cation transport

SEQ ID NO: 63673 - DNA, 330 bp, Heterodera glycines
  Genomic contig location: Contig_ID=SeqID_33682; Location=520..849; Strand=+
  SCN-specific regions: Sequence locations=1-75,118-120,270-293,315-330
atgaaaggatgcttattaatttcttcattatttgcatttttgattaccatcttaattagtaataattatgttggatcagaaaataaaaaattggaacagaaatcatttgatgaaatatttggagaaaaatgggaagaaaaaagaaacgaagaacagaaaaaaagagaaataattggaaaattcaataagataaaagagaaaattaagcaaaaaggaagaaaatattcagcaaaagaatagagtaaaattgaaggaaaaatagcaaaaaaattgtgcacaaatcgccgatatattcaaaaatggatcaaagaattgggattaaatcagaga

SEQ ID NO: 63674 - DNA, 76 bp, Heterodera glycines
  Genomic contig location: Contig_ID=SeqID_33688; Location=329..404; Strand=+
  SCN-specific regions: Sequence locations=1-76
agttactggcgttagcatcatagcggtgcttttccttgtctttttgatgcccttgcaaaatctggtgcgcttctga

SEQ ID NO: 63675 - DNA, 850 bp, Heterodera glycines
  Genomic contig location: Contig_ID=SeqID_33690; Location=1..850; Strand=+
  SCN-specific regions: Sequence locations=1-83,106-143,166-471,495 -583,607-829
catttcaatcactgggactcaacccaccagcatttcaatcactgggactcaactcaacagcatttcaatcactgggactcaacccaccagcattccaatcactgggactcaacccaacagcatttcaatcactgggactcagcccaccagcattccaatcactgggactcaacccaacagcatttcaatcactgggactcaacccaacagcatttcaatcacttgaactcaacccacagcattccaatcactggcactcaattctcctgcatttcaatcactgggactcaacccaccaaaattcaatcactgggactcaacccaccaacatttcaatcactgggactcaacccaacagcatttcaatcactgggactcaacccaccagcatttcaatcactgggactcaacccaccaacatttcaatcactgggactcaacccaacagcatttcaatcactggtactcaacccaccagcattccaatcactggcactcaattctcctgcatttcaatcactgggactcaacccaccagcatttcaatcactgggactcaacccaacagcatttcaatcactgggactcagcccaccagcatttcaatcactgggactcaacccaacagcatttcaatcacttggactcaacccacagcattccaatcactggcactcaattctcctgcatttcaatcactgggactcaacccaccatcattcaaatcactgggactcaacccaacagcatttcaatcactgagactcagcccaccagcattacaatcactgggactcaacccaacagcattccaatcacttggactcaacccacagtattccaatcactg

SEQ ID NO: 63676 - DNA, 1159 bp, Heterodera glycines
  Genomic contig location: Contig_ID=SeqID_33698; Location=48..1206; Strand=-
  SCN-specific regions: Sequence locations=1-150,172-198,220-343,424 -432,455-831,853-954,988-1159
cgctaccgtaccgtgcaattggtccgcgtcaagtacggtattgagctggccgatgcactgaaaaagcacctcaccgactttgagcaactgattgatctgctactgatcagacagcttgagcgaatcacatccgtttatgaggaaaaacagattacaaaacaggtaaataattggttttattgaattataatcattcaaaagtacatcaatatatagagatgctcattaaattttatggttacgggaatacttttaatggatgatccattgggaatttcgagaaaccaaaataaaactaagagcagtagtcagaaatccgacctttctggcgaacaagcattaattctttattttttttcttccaattcttctattttttttgtttttttattatattttttaactattgtttttttgtattttaacattgtcttaaaattttacatttttagtacaatcgaataattaggttaattaaaaattacatgcgatttttcaatcgctttgatactttagcaaaattattttacagatggcccagctgaccactgctgttgactataaaatggtgtccaaattgggtgtgtccgcggacgaattgtccgccgctcgttgcttcctgctcaagtacgactgtgcccgtgaccaatatgttcgaccgttcaacttcaggcaagtgcatcataattgatgtcagaaataaattaccttaattacttaggcattaaaattggtgtctatttttttggtattctaaatctcttttagaggggattaaatcggataattctatggttttatcatttgtccaaacatcccaaaaaatttgtcaacaattcattgaatttatatcctcaaataactttcattcgagcgccttttgtcgaaacaattttttaaaatttaatggttttgcataaaatggtaagggaccaaaatctacccaattttcccataaatttttttaaaagaaaaatttattttaatcgaagaattatttgagacctatccccaattacaatacaaaaaaattttttgccgtccttcagcgggcaacgtgtttacaccggttatcagagtctgttgcattcgtcccgcgacgtgcaacggatgacggaaaaggacaagggggacgagtacgcgtacattgggaacgatg

SEQ ID NO: 63677 - DNA, 423 bp, Heterodera glycines
  Genomic contig location: Contig_ID=SeqID_33701; Location=273..695; Strand=-
  SCN-specific regions: Sequence locations=1-72,224-234,288-423
  Gene Ontology: Mol. function=protein binding; Cellular component =axoneme; Biological process=eye photoreceptor cell development
atgattgaagttagacagatggcatcttacaaacggcgacggcaattgtggaatgcagaaaatgaacggtttgaagaagagggggagaaggaacaagaggaaaatgaggagggcggaggaggagagggaaacgaatgggaaaaagaagcggcggaggaggaagtggagaacaatgaagcagaagaggaaaatgacgatgaaaacgaagaattggagaaggaaggagtggtgacagaggaggaggaggaagaaatgagtgaagaagaggacgaggaggaagaggaagaaatgatgggaaaagaagtggactatgagtcgggggatgagggaattgtattggtgagaaggaaagtgccagcggatggtttaaaggagcaaaaggaaaagccaacggacgacacggccaccaacagaaaactgtga

SEQ ID NO: 63678 - DNA, 300 bp, Heterodera glycines
  Genomic contig location: Contig_ID=SeqID_7054; Location=3108..3407; Strand=+
  SCN-specific regions: Sequence locations=1-120,142-300
atgctgaccattggaagttacgattacaatgatttttgtccaattcattcaacaaaacttactgacaaggatttcgtctccttgaatttctgccgggtcaccatgacgaaaaaaattgccagaaaagccaagcgtgaaatgaaagttggcaatgtgttcgcgcagtttgccctgcaaaatggacaaatagtccacgtcatccgcaaccattcgactgccaatggcaccaatgaacacatcgtcaatgtcaatttggacaaatctaaaaggaacaacactatgtacaccgaaaatgtttag

SEQ ID NO: 63679 - DNA, 3629 bp, Heterodera glycines
  Genomic contig location: Contig_ID=SeqID_7054; Location=860..4488; Strand=-
  SCN-specific regions: Sequence locations=1-111,137-750,772-1240,1262 -1394,1433-1470,1492-2056,2095-2741,2774-2902,3049-3073,3202 -3263,3303-3344,3375-3629
  Gene Ontology: Mol. function=heparin N-deacetylase/N-sulfotransferase activity; Cellular component=integral to membrane; Biological process= protein amino acid sulfation
atgacgaaccgctccatttcacattcaaacaacggcaaaaagccacagcaacggcacgatgcaacaacttcggcacaacgagttctgttactgcttcagcctgaccaactgaacacggacacacacaaaaccattttggattttttcaacaattttaaagtgccagtattagtggaggcgcatttaccgggtgaacgcttactgcttgaactcggtgaccggccacgctttggcctggtggtgttcaccgattaccgctccttccatttgctttcttcgactgaaaaggatgtgctgagccagttttgtgcgcgtcattcggttggtgtcatctcatttttggaacttccatctgatgaggagcagcaacatcgcacagaatttgccaatttcactgcatttggacgacaatcggtcaccaaaattgtggtttccggcacttcacctgtccacaatgttgccaaatcgggcacggaatattcggtgccgcaaaaggatggagatgccaaacttgcattcacattgttcaaacatgcactaagtcatatgaatccaattttggaagcggaaaatgaattgggccaccgtttttccatcgctttacaactggaagaacatcatgttatgtttggtgccaaaccaaaccaacattggttggttagagttgcacttttggacgccgtcacatttcttgcacccgccattcatgacgacgacttggaaaggttaattggctcttttgcagttctatctttttcacatttcgaattaaaatacaaattaataggttttcggggtcgctcgctgatcactgatcaggcatccgtgtcgactaattacgaaccccgggcccgaattctaacgaaaaatcagaaactcatttttttaccataattcacattataaaaattagaatttttgatcgagttctgatctgggcttcggcattgggcaaatccgagtttagcttcgtggtcagtatcttagaaaagccctgggaaactggtttttgagcctaaaaaagttaaatgaagacgcaattctttatcattaccgaaaaattgcctttgtataatagtaactaaacattttcggtgtacatagtgttgttccttttagatttgtccaaattgacattgacgatgtgttcattggtgccattggcagtcgaatggttgcggatgacgtggactatttgtccattttgcagggcaaactgcgcgaacacattgccaactttcatttcacgcttggcttttctggcaatttttttcgtcatggtgacccggcagaaattcaaggagacgaaatccttgtcagtaagttttgttgaatgaattggacaaaaatcattgtaatcgtaacttccaatggtcagcatttgtcatgttccatgaaaactgaaattgtttggaattttccaaattttgccgctagtttcgaaatcgtaaattaagaaaattattaaaagccagcaaggtgacccttttgacctgcaaccaatttccgaatcctttccctaaatttgaaaaaaaaaaactaattttcgaccttttgttagagtttggtttgagtgaccgggattggttgaggttgatttgtctgattcgtgacatattttcgtacccgaatttattttttttgcacttttttttgtacaacttctaaacgaaaatcatttgttttttttttgtcgaaaatttacattttgtctgtaataggcaatgcgaacaaattccactggttcccgcacatgtggcgtcacaaccatccgccagaattttctgcggattatctgcttgcattgatgacacaaaatcgtgtgtttgctgagaatgttggcatttctgccaatctgagctatgccgtttcgccacaacattctggggttagttgttgaaaaatggaattttcaaatgcaatatttttctactaaatttgccaggtttatccgatctatcagcctctgtacgatgcctggtccaaaatttggtcgatccaagtcacttctaccgaaggtggttaaaaggcgcagtaccacaatttttacttggagaatataaatttttcaagaaaatttttaatttttttttaggcctggtgacaccacacttggagaatttgtttttattttttgctaggcctattttagtaatttactacattttttaaaattaaaattgccaccctttttgggttagactcacatcagagtgcttgtttttgtacaaaaattttcgacatttatacaattttatcccctccagaatacccacatctgaagccagcaagcggaaggcgtgcatttgtccatggaaatattacggtgcttcccaggtttttttttttgaatttcttcgaccataacttctttttcctattcgaataaacgttcagtttgggtaccatgaaatttttttccatttccagacaaacctgtggccttttcacgcacacccaattctttcacgcttaccctgatggggtggacaattttctgcacaatgtgttgggcggcggtgacctgttcagctccattctgatgaacaaattctccgttttcatgacccatcagcaaaactatgcaaatgatcggcttggcggcttcacttttatgaacattgccaaatttgttggttgttggacaaatttgcgactgaaatggacggcaccgaaaaatgtggccgatttgtacatgaaacggtttccgaatgagcgcactttgctttacacggtgccaactttttcaaattttattatccataaaaatgggtgaatgaatgtgtgtattcagaacccgtgtgatgatcaacggcacaggcgtacgcttccactcaattacaattgcagtgcaatcaaattgccaaatctgatcattttgggtccccagaaaacgggtgggttttttcgtttaaattttctattgttttttgttgtttttttaatttctattgttttttttcgtttaaattttctattgtttgttttttgtagttgtttttttattttctattgtttgttttttgtcccgttttcgttttgtgttttgtctcatacttcactgtattactcatctcctttctctattctcattcactttccctcttttgccatctttcattcttgcttcttctttttttcattcactctcattctgtttcctctcttttttctctctgtctgtcatcgaactctctctctactattctcatgcttttctccgcatcctcgttttcttgtttatttaagcaaaaagtccccacttaaaaacaatttttttaaataattttaaacaaatttttcgtaagggtttcttgattttttttataccctaccattttaacaaaagagactaataataataatattccaaatttcagggaccagtgcgcttggtctgttcctgtcgttgcacccaaacattggcaccaatgtgcccattccccactcatttgaagaactccaattttttgctggtccaaattatgcgcttggcatggaatggtacgcagaacagtttgccaacaacaccgccgccatgtccgttctgtttgaaaagactgcaaattattttgacaacccgagggcgcccgcggcggtgcacgcgttggtgccaaatgcgcgactaa

SEQ ID NO: 63680 - DNA, 1149 bp, Heterodera glycines
  Genomic contig location: Contig_ID=SeqID_33704; Location=211..1359; Strand=-
  SCN-specific regions: Sequence locations=1-82,106-274,298-628,651 -723,745-1149
atgcaaatggttcccgcaaatactttatttgctcgcgtaggccttgatttggccgggcccttcccaatgactattagtggaaataaatatattttgaatattatttgctggttttgtaagtatgtcatttcggtaccattacctgacgctaaatcacacacaatagcgatagcctttttaaagaactgctatttaaaatttggtggctgcactgaattagtcagtgataatgccaccgcctttacatcggagtttttccgagaattttgttcactattatatataaataaaaaatatgctgtatcccattggtctcaaggcaatgctgcgactgaacgtacctttaggacttttcataatattttagctaagtacattacgaaagaacagccagattttgacgaattccttgattatgctaatttttgttataatacatcagttcattcttctactaacgagaccccttattttttaatgtttgggcgcgatccgatattttgcatagatcaaattttagaccctaaagttagagacccgatagcatttactgacgaaactgaatttaaacaaaaactagtgatctctcttcggagagcgtggaaaagtgcctcagaagtgcatgcagatgcacaagaaaaaatgaaaatacagtatgacaaaacaatgagaacgcctaagctaaagtaaggtgatagagttttgctaagaaattatgcgggaaaaataaatacatccaaaaaattccagttgccgtggaagggcgtctttaggataattaaaattgacggtatttatgttaccattgtaagttgcaattcgccccaaagcaacccgcgccgcgttcacattaatcaacttaagaaatgcgttgaaatcctaggaccagcttgcacttctccctggcttagtcccgaagaaaataatgctcttgtggaagcagaaagcgaagaaattgctgatttacctggtcattctcatccaattattataaaagaacaaatagagttacctgcgcaaaaccatgctaatgacctggttagtgatactcaaaacatagagaatgatacaagcgaaccaacacaattgcctcaatatgctttaagaaatcgtacaaaacttaacaaaccagcgcgatatttagattag

SEQ ID NO: 63681 - DNA, 749 bp, Heterodera glycines
  Genomic contig location: Contig_ID=SeqID_33708; Location=163..911; Strand=-
  SCN-specific regions: Sequence locations=1-279,302-353,385-749
atgcccacattggcggattacaaaatgggcacattggcggatttacaaaatgcccacattggcggatttacgaaacgagatagcactaaaaacaggcaccaaacaatggagttgtttggaatactagtaaaagataaattattggatggggtggcattctctttgggttctttttttgactctgtatttgttataatggtgcattagcccacgctcttttgtacactctcatcgtctgcctctttctctgtcattttcctaacactattttctttttcgtctttcccccaagaattttttgccaaatatgtattaactgatctgtaaaaaaaactctcttcaaaatttcatggtttaaaaaaatttttcaaaattttaattttacaccttttttcgagaaattttttgcccattgctaattttttttttgcatcagttgaaaacaaataggtttttaaatgagtctctgatctgattttgactaaaaaatggagaagcacttctgacaaaaaaggcaatcctaaagaatgggggtccctttaacttttttattttgggcataaatcagtttccggggtcttcgagggtgctgattatgaatttggactctgattttcccaatttcgaacccaggatccgaatttcgaacaaaaaagttgaaaatttttttcaaaatacgtgtaaaaatcgatctaatttttgcgtaaatcgcatatttttaataattgtgaagcaaaatgaaaaataaa

SEQ ID NO: 63682 - DNA, 258 bp, Heterodera glycines
  Genomic contig location: Contig_ID=SeqID_33709; Location=230..487; Strand=+
  SCN-specific regions: Sequence locations=1-147,170-197,219-258
aatgatcagtcacacaaattttgtgtgcacacccgcaggggagattttgttaaaatgatgttgggactcgaagaaggaacctacggagaaaggaattgatttcggatttgaatatttaaaggtgattcaaatgatgaattatctttcttaatttttaattaaaaatttaggaaaaatttgacaacatttccatttctgttgttttgcttggagaagacaaacaatttttggcgaatttatcattcaatcagcaggcaa

SEQ ID NO: 63683 - DNA, 2741 bp, Heterodera glycines; identical to SEQ ID NO: 7055
  Genomic contig location: Contig_ID=SeqID_7055; Location=1..2741; Strand=+
  SCN-specific regions: Sequence locations=1-492,514-920,949-970,992 -1600,1622-1686,1709-2062,2085-2304,2326-2430,2464-2741

SEQ ID NO: 63684 - DNA, 819 bp, Heterodera glycines
  Genomic contig location: Contig_ID=SeqID_7056; Location=379..1197; Strand=+
  SCN-specific regions: Sequence locations=1-336,358-529,551-655,689-819
atggcggcgatgctcatacccgctgacggacaataccaactatgcccgtccaagccgacagaagggattaccgttaccatgagctttccggaggaacaaaattgcactcttccggtggaaaagcctccactgacggtgaagtcaaatctttacataccaattcggattccgcgagtgtttcccgcatttaaatgctggaatgtgacaacagtcacatgcaccgagtcttttctccgaatcatgacgttggatcatcctgacaagaaaattgaagccgacgcttcagtcgaggactgtcaggcctcaatacaccattcgccgatgaacagagtaagtgagacaagatgggaaagtttggcgccaattcgaaaagagtacggatggtacggcgtgaattgtttcaacaatgtacagacagtgattgaagaaggaaaagcagggattttggatgggaaaagactgataacttcgtggggagactctttaaaaatcgacaaaagtctgggagaagacggcagctggatacgcctgaaataattaattcatttaatgatccgggtattcctttacatgtgttatgtctgaccacctatcttgactccctttcccttgttgtctctcacaatttctttttccctgtcgctagtcatcccaatttcccttccttttggccttttcttccacggggcgcccgacccgcccacctgttgccaatataaaaatttgggggagagatcggattgatcagtgtgatcggggactttgatcggcttgttgcgaacttttcctttttgcttttacacatatactcatcgctaa

SEQ ID NO: 63685 - DNA, 714 bp, Heterodera glycines
  Genomic contig location: Contig_ID=SeqID_7056; Location=1963..2676; Strand=+
  SCN-specific regions: Sequence locations=1-53,82-714
atggatttagacgctctgcggcgtcgaattgtgactctcgagcgagagatgcgtgaaaatggtggaactcgccctgggcttccgatgccgaccacatttgacgggacgactgatttgcaggattatttgaagacctttaatttaatcgcgaccgcccacaattggacacccgcgcgatgtgtgcaagttctcccgctgttcctcagaggatcggcaagggcaatttacgagagcatcgaaccggatattaaagacaattggcgaagtctaattgatgccatggcggataagttgaaacaaatgtctccgagtctgacagcaagacagaaattggcacaacggaaacaactgactggagaatcgctggaagaattcgcgcaggcgattcggaacctcgtcttacgtgcttatcccgacaattctctcgagatggactttggaaatttggtgctcggtgctttggaaaatgatgtgaaacaagcaaacgaagtccgacttcgacaattccgttcggaaattgcgcgagatttttttcgggcaaatatggcaccacgactgaaggaaagagtgatacacatggaagaaccgcaaacgctcgaggaagcagtggcccaggccagacgtgttgaacaagttcaaggaaatttggccgatgacatgtggaaaaatacacaagatgcaaaagccgaagttgctttagctgaagttaatgca

SEQ ID NO: 63686 - DNA, 136 bp, Heterodera glycines
  Genomic contig location: Contig_ID=SeqID_33714; Location=574..709; Strand=+
  SCN-specific regions: Sequence locations=1-136
atgaaggcgaattgtgcttccgactcccagaagaagctcccttccgcggatttgtgcaatggccgctgttcggccgagcgacggattcactgccgcgaattggccaaatggggacggcaactgacgacactcgtcg

SEQ ID NO: 63687 - DNA, 405 bp, Heterodera glycines
  Genomic contig location: Contig_ID=SeqID_33717; Location=200..604; Strand=+
  SCN-specific regions: Sequence locations=1-42,64-405
atggacaatcccggcccatcaaatgggattgacttaatcgaacttggagacagtgacgatgaaagaatggaaaagtttgcatttggtaagtaaatcccctcaaaaaagtatttctttttcaaatggcactgttttaggtggcaacgacacactttccctgatttcattaaaggtatttgtacgacatatggaatttaaaacttaatgcaatttaataatttttcagacggactttgaaaggccaccgaaggaagaagccatgttaaatttagtcgacgcttcctttgagctcatcgaccctaacccgaatgtccacgaacttttcgttacttttgaccaccaatttttctcgggaactttgaattcgaatgcgtgtgtcgtcgaatggagcaaaacgatgacatc

SEQ ID NO: 63688 - DNA, 415 bp, Heterodera glycines
  Genomic contig location: Contig_ID=SeqID_33718; Location=289..703; Strand=-
  SCN-specific regions: Sequence locations=1-11,413-415
  Gene Ontology: Mol. function=DNA binding; Cellular component=nucleus; Biological process=N-linked glycosylation
atgagagaaaaaggaaaaggaggagaaaaaggagaggaaaaggaggagaaaaaggagaggaaaaggagaggaaaaggaaaggaaaaggagaggaaaaggaggagaaaaaggagaggaaaaggaggagaaaaaggagaggaaaaggaggagaaaaaggagaggaaaaggaggagaaaaaggagaggaaaaggaggagaaaaaggagaggaaaaggagaggaaaaggagaggaaaaggaggagaaaaaggagaggaaaaggaggagaaaaaggagaggaaaaggaggagaaaaaggagaggaaaaggaggagaaaaaggagaggaaaaggagaggaaaaggagaggaaaaggaggagaaaaaggagaggaaaaggaggagaaaaaggagaggaaaaggagaggaaaaggaggagagt

SEQ ID NO: 63689 - DNA, 158 bp, Heterodera glycines
  Genomic contig location: Contig_ID=SeqID_33718; Location=725..882; Strand=+
  SCN-specific regions: Sequence locations=1-40,67-72,95-158
atggctaacttatgctccgccaaactcctcaaagtgttcgtcctcctcctccttctcctcctcctcaattcccttctcgttctccccgctcgcattctcgtcgctcttgctcccgacaacaaaagtcacctccgttcgatgctccctttgatcaatcg

SEQ ID NO: 63690 - DNA, 929 bp, Heterodera glycines
  Genomic contig location: Contig_ID=SeqID_906; Location=775..1703; Strand=-
  SCN-specific regions: Sequence locations=1-94,116-118,141-412,435 -681,703-929
atggcaaaccggatgcaacaaacatatcgtcgagccttctctgttatacagcagcgtgttgaaggtgtaataccaagcagttttatgctggattttgaacctggttatattgatatttaatcgattttattttaaatatttgatcatttagctgcgagatcggcatttcttgatgtttggccgaacacaatgatcagacattgtctgtttcacttggcccaatcagtcaacagaagagtgcagagggaaggactagcaccacaattcttagtagatatcgattttagaaagtctgtcagatcattgtcagcgatttcgtttctacctttaatttatgtggaagaaggttatcaaattctcagaaatcatgcgcctatacaagcgcatccaatttttgattactttgcatcgtaggttatggtcatgtttttaaataattctgatgttttttatagtacatatctcttccgtgttgatggaaatggaaatcgacgacctgctttatttgtgccagaaacgtggaatatgcatgattcggtccttggtgatttagggcgcacaaataatggcctggaaggctttcatgacagtttcaacaagcgattttcggctcctaatccacctttggcaacgtatttaaacattaaattaccaaaacagaaaacaattaaaggtttattagtcgaatcaaagatgaagatgagtaccaacgaaaccggatgagaccccatgaacttgatcaaactagacctgtatctgaagtacctcgttcgaaaaaatatcttgaaaacgaccgtgctattcgagacttggttgcccaatttgacgagcaagatccagatgatcgcaatgaacagcattggctacgacatctgcacgcaatttcatttcgtctgaccaccaaaggaattgataattggattgaataa

SEQ ID NO: 63691 - DNA, 681 bp, Heterodera glycines
  Genomic contig location: Contig_ID=SeqID_906; Location=2141..2821; Strand=-
  SCN-specific regions: Sequence locations=1-403,426-515,537-681
atgtatttcaaagtttttttttaattttgcttcaattatgtcatgttcaaccacaacaaggcaagttttgtagtttaagcaaaaaaaaaatcgaaatcaattttcagaccgattagaacccgataagaggacaacgaaaagcaaaacgatgactgtttttgaaggctatgaaatgcgtactgatagaataatagcagcaggccaaacccaggctatttttcagtacttgtatatattaaatattctatcttaaataggtatggagatgtgtcaagaaatcatgcccaggcagggcccattcacctatcgacagcacaaacttaattggaagaacaaatcataaccatttgccggacccagagtctaacgtggtgaaatctgttgttaaaattggaatatttcctatttaattttattaaattatagaaaaggcagcgtcaggaacagctaaaagacgctgctatggatcaacctgaagctgccccgcgcaatttaattggatcgtcaagagaaggactctctgatgatcaacttgttcgattgccaacttatggcgcaagtagaataaaaatacaaaggcaacgtcaaataccgggtcgagatgctgtaaatgcggcaaatcctttggaaatagagatagaagtgagccattaaaaaccaaaaatcgtgccaaaaattaaa

SEQ ID NO: 63692 - DNA, 737 bp, Heterodera glycines
  Genomic contig location: Contig_ID=SeqID_906; Location=3591..4327; Strand=+
  SCN-specific regions: Sequence locations=1-2,24-62,85-426,467-509,553- 576,649-711
atggcgagacgaaaagtgaaaaattcaagggccgatcttggcctactgatgctgtacgcagtcaaaggagaaggaaaacaagagctattcggatgtgcatgatgattttttaataatataatcactcccgttagcccttgggaaaggcaattttatgaatatattttttattcacaattggggcgcaaatgtgcggggcgcaaatgtgcggggcgcaaatgtaggggcgcaaatgtaggggcgcaaatgtaggggcgcaaatgtaggggcgcaaatgtaggggcgcaaatgtgcggggcgcaaatgtaggggcgcaaatgtaggggcgcaaatgtgcggggcgcaaatgtaggggcgcaaatgtagcagctccagataaataatattttgttattgtaagaaaaatttaacccataaaattgaaggataatgaaataaataaataaacaatattacattaaaaagaagaaacaattattaaaagatattaaaatctgtaaatgttggacaaaaaataatgtttaaattatgactaaataaaatattttttatgtcaaattgtcgactaatactttgaaaatttatttaattaataaataactataaaattttttaattaattagaaaatattactattttttttatttccagatgttttaaatgattgccttgttttgattatcaataatttaattgccatattttctaagttaagaattttttaaattattggtaa

SEQ ID NO: 63693 - DNA, 1213 bp, Heterodera glycines
  Genomic contig location: Contig_ID=SeqID_907; Location=1931..3143; Strand=+
  SCN-specific regions: Sequence locations=1-196,234-275,316-1175,1199 -1213
atgtcaaacattaccaaaacccttctcctgctgattttgctggtggccgtttcattccgtttttcggcttcgactaatggaaaaagtgagttatggaaaaattcattttcatttttagtctaatactcgcttgttaaggtctttagcttttatctgtagcaaagtcttttggcaatttcttctagtctcaagcatattaagtttcaaataatgttaaaattccattattttattggcacttaaaatattccccctaaatccatgtcctgtgggccttattaataattgaatataaataatatttattgaattaaagaaaatgctaatgatgggaatggtagcaacgcatccgttggcattgggacgaaaatcaaacgaattgtgaccgccggactgctcttcacttcactggcgacaggcggggcgggcgaaattcaacgaagcaatgttcagagaagaaatgtcatgggactgacgcacccaatggtacaaagaattatcagtaatagcaattaagcctaattagcatgatacgactgacactcaccttttctagcctcctcgacctccgccagagcttactccatttcaaaaagcaaaagcaatcatagaagaacatgctaaaaaaaataatttcactgagtcagaggtacaaattcgacttagccaattatactttttaaattacgatatatagcgcgagccaattatactttttaattacgatatttagcgcgagtcacccggaggacccgacccacaccatcatttcaatttcactgagtcaaatgtacaaattcgatttagccaattatactttttaaattacgatatatagcgcgagccaattatactttttaattacgatatttagcgcgagtcacccggaggacccgacgcacaccataatttcaatttcactgagtcaaaggtacaaattcgacttagccaattatcctttttaattactatatttagcgcatgggaccccaacgacccaatggacagcataatttcaaaaatcatactgattgagaggtacaaattaaacttttcaattatgcgtttttaattacgaattttcagcgcggctacgtatccggtggacccgactcactcacaatcattgaaatatagaaagaaatgatgcatcgagtgtgattagttcttttaagggtttattttctcttcttttcattataaactttctaga

SEQ ID NO: 63694 - DNA, 440 bp, Heterodera glycines
  Genomic contig location: Contig_ID=SeqID_908; Location=1620..2059; Strand=-
  SCN-specific regions: Sequence locations=1-440
atgttcttctatgattgcttctgctttttgaaatggagtaagctctggcggaggtggaggaggctagaaaaggtgagtgtcagtcgtatcatgctaattaggcttaattgctattactgataattctttgtaccattgggtgcgtcagtcccgtggcatttcctccctgaacattgcttcgctgaattgcgcccgccccgcccgtcgccagtgaagtgaagagcagtccggcggtcacaattcgtttgattttcgtcccaatgccaacggatgcgttgctaccattcccatcattagcattttctttaattgattacactttttaagtcagttatttacaatgttcacaagacatggattaggagaatactttcagaggcaaaaaatgatgaaactttcacataatttgaaagctaattgacttaaaactagaaaataaa

SEQ ID NO: 63695 - DNA, 236 bp, Heterodera glycines
  Genomic contig location: Contig_ID=SeqID_908; Location=138..373; Strand=+
  SCN-specific regions: Sequence locations=1-236
acttggacatttcgtgggctggacattttgtgggtcagcggaaaaaatgggccgcgctctgtttgccaactgtgtctgttctgtgctatggtcaactgggtcatctttcctatgcactctctccaccagtctctttctgcgagtcacccggaggacccaacccacaccaccatttcaattttacgtatccggtggacccgattcactcacaatcattgaaatatagaaagaaatga

SEQ ID NO: 63696 - DNA, 826 bp, Heterodera glycines
  Genomic contig location: Contig_ID=SeqID_908; Location=1487..2312; Strand=+
  SCN-specific regions: Sequence locations=1-826
ttaccaaaccctttctcctgctgattttgctggtggccgtttcattccgtttttcggcttcgactaatggaaagagtgagttataaaaacaagaattaattctcagccttttctatcatttaagttttggcaatttattttctagttttaagtcaattagctttcaaattatgtgaaagtttcatcattttttgcctctgaaagtattctcctaatccatgtcttgtgaacattgtaaataactgacttaaaaagtgtaatcaattaaagaaaatgctaatgatgggaatggtagcaacgcatccgttggcattgggacgaaaatcaaacgaattgtgaccgccggactgctcttcacttcactggcgacgggcggggcgggcgcaattcagcgaagcaatgttcagggaggaaatgccacgggactgacgcacccaatggtacaaagaattatcagtaatagcaattaagcctaattagcatgatacgactgacactcaccttttctagcctcctccacctccgccagagcttactccatttcaaaaagcagaagcaatcatagaagaacatgctaaaaaaattaatttcactgagtcaaaggtacaaattcgatttagccaattatactttttatttacgatatttagcgcgagtcacccggaggacccaacccacaccatcatttcaatttcactgagtcaaaggtcaaattcgatttagccaattatactttttaattacgatatttagcgcgagccaaccagacgacccaacccacaatatttagcgcgagtcacccggaggacccgacccacaccatcat

SEQ ID NO: 63697 - DNA, 615 bp, Heterodera glycines
  Genomic contig location: Contig_ID=SeqID_908; Location=2433..3047; Strand=+
  SCN-specific regions: Sequence locations=1-85,133-232,254-593
atggactctatccaaaaatttatgcttttattgaaactccttaagtaagtggctttgttgtgtgcaacatttgctacggtaaaccaataaaaataaatataaatgatttaaattactttattttaattataagaacacaacattttttgtggctggcgagaaataagaaaataaacaaattacaaaattgaggaaacgactagagaaaatttgggctaccaattataacaagaatgtaaaatttttcatctttaagcaaaattatgccatattttgtgccgaaaaaacagttaaaattgcggattttacgtaacgacccagcacgtttttaatactttctaacatttaaaaccttgtggtttacttgtttaaaagctgtctctaagctattgattgaccatttaattattattacactagagatcgacattttgaaaaaagcctggacctgggatttcctggataaaaatccaggaaaatccaggtccatgaaaaggacctggactttttttcatatagaacggctccattttgagcactaaagaccggaaaaactcccgaaaaaaatcattttttagcaaaattttctcaagaatattatttatttaaatttta

SEQ ID NO: 63698 - DNA, 802 bp, Heterodera glycines
  Genomic contig location: Contig_ID=SeqID_7058; Location=2186..2987; Strand=+
  SCN-specific regions: Sequence locations=1-237,259-802
  Gene Ontology: Cellular component=integral to membrane; Biological process=membrane organization and biogenesis
atgtcaaatcaatcaacttcttctgctgctgctgccggatcgacggcgccgccatcgccttcgaacgaagcttcttctccttcggccgctcaagcgtcaagtcagtcatcgtctgctgctggtgattcgtcagcctctcccaatggaccgcgtcttaagccgcgtaaagtgcccgtcaaccgcttcagggatgttcgtccggcactgcagctgcgactcagtcagttgaagcatccgttaatcaggaaactggagcaggacaccggcattgaccgtgagagggttcgtctccaactccaaacatttccttcccccatcataattcccccatcacccattttcagctcttttacatggctatggcatatttcgtgttcctgctcctgttcactcagtgtaagcttctgctctccactctcattggttggcatttcgacacaaatgccatcctttctctaattcctccccttttatttaaggctcagtctatcccgcctatcagagcattgtgactgtccatactcaggccaaaagtcagtgttattttgtggaattcccaaataaaaggatttgaatttcaggcgaagagattcagtggctcacttattggtgtttgttctctctgttttctctgtgtgacatttccttttccgtcgcccttccgttctatgcccttgtgaagacaatcattttgttgtatttggctcttccccaaacttatggtgcgcacaatttctacgtcatttacgttgacccgctggtggaccaatggatgctgatggtcaacgaaattgctggctga

SEQ ID NO: 63699 - DNA, 425 bp, Heterodera glycines
  Genomic contig location: Contig_ID=SeqID_7058; Location=3036..3460; Strand=-
  SCN-specific regions: Sequence locations=1-331,354-425
atggcaaagcaaaacactgatcagctcagcacatcggacggaattgtggcaaaacaaaaattgtgaataagataatgataattcctataatttggagggatttcccgagacggaagcacattggtactgatttggcctcaattggagcacaaaattggttgttcaaaagaaaagactcaattcgccaacggactaaaggattctttcggccagaagagaatgggaatttaatgaacaaattgcagggattggaggcatctttcgacgacatttcctatctgaacacaaaattgcgtttggttctcgaaagtcaggacaaattggagaagtcaaattttgggattggaaaattcaccaccaaagacgacaaatataaaaagcgatttaatcacccatcttttaatatgaaattatatgacaaataa

SEQ ID NO: 63700 - DNA, 541 bp, Heterodera glycines
  Genomic contig location: Contig_ID=SeqID_7058; Location=3835..4375; Strand=-
  SCN-specific regions: Sequence locations=1-113,135-541
atgaaggcccatttcaacggcatcagtcacaacggcgaagcatcgatgtacgccaaaattgagcagcaaagtgccgaagaattgatcaaactgcacagtaaactgatgctttttaaaataatttctgaagaaattttgaaaaggatattttaagaattttaaattgaatttttctcatgcttaagaaagtgccattaatcagttcgaatcgcgtggcattccgtcgctgaacccgtttaacgagtcgcactttgtgccccacgcgacgattttatatttgaggagtgaaagtgatcggaagcttatcaaatggtgggcggaggaagaagcgaaatgggaaggcagaaaattgggcacggaaaatgtgaaaagtgagagacaaatcaatggaaaagcgaaataaaatggaatgaattaaaattagtgaaaatgtttaaaattactcgcaattttattttatttagtgcttcagctttgcaacattgacttggacgatcagaccgaagattacgaagtgttgtacgaagttcgcattgattaa

SEQ ID NO: 63701 - DNA, 715 bp, Heterodera glycines
  Genomic contig location: Contig_ID=SeqID_7058; Location=4433..5147; Strand=-
  SCN-specific regions: Sequence locations=1-32,61-61,90-223,248 -496,518-715
atgctgaagtgggtttgtatcaatcggttaattaccatttgaaaatgaaaatggcaaacatttgccaacccaacccaaaaaggtcgtgtccaatgtcaaagccatccaaaacgaattgctccgatttgactccgatttttcgcacacttttcaaccactccaatcactgcacgtcacacttcttctcatccatttggacaaggcaaacttccaaaagcaagtcaatttatataaataaataaattatgtagtggcaaaaaaagaagaagaaactttcccgagaagaaaaaatctgatggaccgattaaggcgataattagaaacctaatcaattaaagtagaaaatgatcctaaatgatttagtaaaaaaagaagcaaaaggagaaatgttaaattagcattaccaaatttgtaaaataaacaacaaacctacacatttttatgcaatttgcgcttgcccaattaaagaaaattagcaaatgattaattatgaaggattgtcttttttaaaatatttgaacaaattgattatggtttgtagaaccaaaacatactttaaaatttgtttgcacattgaaaatgcttttaaaaagcataaaatccgtccatttttgtgattttcagcgcttgtgatgctctcgctgcgactgtgcagcattttgctcaaccattggtggtaatttatttggtttttgaggaatcaattcatttttaa

SEQ ID NO: 63702 - DNA, 288 bp, Heterodera glycines
  Genomic contig location: Contig_ID=SeqID_33725; Location=596..883; Strand=+
  SCN-specific regions: Sequence locations=1-288
atgcaattctctagtgttggccatttaaggcaaacattaaatgacataatcaaggatgcatataaacaacggtttgggctctcaccacagaaggccgccggaacaacggttaaagcgaaacgccaaattgacgttacggaccttttttttcacgatcaccctggtgattattgggaaaaaattgaagagttggaaaaaaagttggctgaattaaaagaggagattatgacgaaagagagggaacatggtgccaaaggtacagagcagaaaagaaaaaggaacttgaag

SEQ ID NO: 63703 - DNA, 463 bp, Heterodera glycines
  misc_feature (10)..(10): n is a, c, g, or t
  Genomic contig location: Contig_ID=SeqID_33728; Location=488..950; Strand=-
  SCN-specific regions: Sequence locations=1-463
  Gene Ontology: Cellular component=exocyst; Biological process =embryogenesis and morphogenesis
atgggccgtncattggacaaaattcatgtgaatgaatgggcagggaaaaataaatcaaaaaatgaaattcagacatttttcgagaggatagaaaaacacttggaaaatggcgcaaagccggaagagatgagctacgagcagcaattctcccggatggaactgaaacgggccatttcgtcatacccggccaaagaagtgaagaagggacttgacaatctgtacaagaaagtggagaaacatctctgcccgggctcgcctcttctggtcgttgtgtggcgacaaatgcaggcaaaaaaaaccacggatttctttcacatttgacaaagttcaggaagaattcttgaaccaggtgaaacattaccaagagctgatctcgcggtgttacggcgcctcaaaaatcgaattggatttctccattggggatgtgcttcaattcttctctgaaatcgctcaacagcactaa

SEQ ID NO: 63704 - DNA, 99 bp, Heterodera glycines
  Genomic contig location: Contig_ID=SeqID_33728; Location=1..99; Strand=+
  SCN-specific regions: Sequence locations=1-66
ccgacagggatttcaattagatcaccaaacaaatgaaaatcggattcgaattctccactttgtatcaaatataactttattataaatcacatttacaaa

SEQ ID NO: 63705 - DNA, 677 bp, Heterodera glycines; identical to SEQ ID NO: 63383
  Genomic contig location: Contig_ID=SeqID_33731; Location=155..831; Strand=-
  SCN-specific regions: Sequence locations=1-60,82-677

SEQ ID NO: 63706 - DNA, 252 bp, Heterodera glycines
  Genomic contig location: Contig_ID=SeqID_7059; Location=1380..1631; Strand=+
  SCN-specific regions: Sequence locations=48-252
atgaatgaatggatgaataaaaaagggaagagaaagaaacaaacggaacggaacgctccaccgccaccgcacgcattggcaccacccgcggcggccattgctgcggctgccatcaaaaagccgcccgcatccgccgacgtgccgccgcctacggttaccggagaagcaccagagatggcggcgttgacggtgccggcactgccaaacggaaaatgttgcgacgcagcggtgccaccaaacgcagacacaacg

SEQ ID NO: 63707 - DNA, 1472 bp, Heterodera glycines
  Genomic contig location: Contig_ID=SeqID_7060; Location=170..1641; Strand=-
  SCN-specific regions: Sequence locations=1-30,205-265,290-439,462 -501,524-588,610-668,690-700,726-756,783-893,915-958,980-1472
  Gene Ontology: Biological process=regulation of protein activity, epigenetic
atggctatgccaccgcaatcgcccgcgtccgcagcagccgctgcggctgccgcggcagcggtcgtcatgcagcaccagcaacaacagcaacaggtgcagtcgcagctgagcaagctggacagcctgttcgggcccgggtcgccggcagcggcgaccgctgcactgctccaactgcagcagcaacatcagcagcaccagcaacaggttgagtttcttgttgatcaacagttgtgtggaattcgaatttttttttaaattcacatttggaaaattttggaaagaattttttaattagtatgctcgagagtctcgggctcataattctcacaaatatcctgaattggattgtcatgttttacaaaaaaaatttaaaccgatactgcgatttcaagcgtcaattgttttggaaacttttatccaattaatagagacgattattttgaaaaagctggacctgaacctggattccatgttagacctggacctggattaccttcggtttttgataattttcaaaataaaacatcggtcacttgtaataataaattcaaaattttggtctaggaaatccaggtttttcgtatttagcctggaactggatttcctggaccaaacatccagaaaaatctaggcctggatccgggtaccaattaagcatgtcattttaccttatcatgacccaatttaggcggagcccctctcattaactaattaattaattatcattgttcagtcggccgctgctgcggcacaatgccatcagcagcaacaacaacaagcgaacagtgagctggccgctgcggcactgctggccagccaattccaacggcacaattcgtcggtggtcgccgcttcggtggcggcacaactgctggccgctgccagtccggcaagcccggcggcggcggcggccctctctttgatgtcgtctccgctgggcatgcacaaccacccgcaacagcaacaaaaccatcacaaccaacagaatcaacagcaatttgctaatgttgcagctgctgccgcgtcactcatccaccaacagcaacaggtggccccggggcttcacgcctattagctctgctaatgggtggttgatcaagtttttatgaggattgtcataggttactgatatttggagaccgaacgggatcggggagcccttcgggattttcccgggatccttgtcccgatttattctgaaaaatgttgatcaggatcccgacaaaatggatttaaatctagtaaccctatcctggcctgattcccaattccggtcccgacttctactaattttggcactgtcaaattaatctgcccggctggtcaatcagtgtgataataatgttccaattcaaacaatatgatcaaaatattatcttaaatcctatcagctaatcactgccacccattttgtcactaattaccctaattaaacactttcccttttttcaatcatcatcacccctaataaa

SEQ ID NO: 63708 - DNA, 533 bp, Heterodera glycines
  Genomic contig location: Contig_ID=SeqID_7060; Location=191..723; Strand=+
  SCN-specific regions: Sequence locations=1-472,494-533
tgaaaaaagggaaagtgtttaattagggtaattagtgacaaaatgggtggcagtgattagctgataggatttaagataatattttgatcatattgtttgaattggaacattattatcacactgattgaccagccgggcagattaatttgacagtgccaaaattagtagaagtcgggaccggaattgggaatcaggccaggatagggttactagatttaaatccattttgtcgggatcctgatcaacatttttcagaataaatcgggacaaggatcccgggaaaatcccgaagggctccccgatcccgttcggtctccaaatatcagtaacctatgacaatcctcataaaaacttgatcaaccacccattagcagagctaataggcgtgaagccccggggccacctgttgctgttggtggatgagtgacgcggcagcagctgcaacattagcaaattgctgttgattctgttggttgtgatggttttgttgctgttgcgggtggttgtgcatgcccagcggagacgacatcaaa

SEQ ID NO: 63709 - DNA, 631 bp, Heterodera glycines
  Genomic contig location: Contig_ID=SeqID_33734; Location=25..655; Strand=+
  SCN-specific regions: Sequence locations=1-82,104-242,266-631
atgagcacaaaagcaccaccaccgacagcagcaacgccaagttggagcagtacacgatggaaaagcggaggggaaacaaacgacgcaaaagagaacaaaaaagcacatgagacaagccgaactgcagcgacagaacggacggaaggcaatgttaacttccgactgctcgcaatcgccggaatcattgcgggttggtcctttcgaaccaaaaatgattattatttaccacttaattcctttaatttttgcttcagtgttgtttattatggttggaattggaagcatttgcacgggacggtacgtgcgaaagagtcgtcaactccacggcaaatacagggtcggcaataaattaaagatcgattagaaataaaccaatggaacgagtggaaaagtgggggaggggtaataaagaaagaatattcgaccatttcgctttgttttagcccgccgcgtacgaattgcagaccactcgccccccgcctttgaccagctcttccatgactttcgcgccttccaatcgcatggccaattccaatgaattgcagcagaatcggcatttcgagtttggccaaatccatcaaataccgccgccagttcattgtcctcatcagctcacaatgaatgggaatga

SEQ ID NO: 63710 - DNA, 783 bp, Heterodera glycines
  misc_feature (689)..(689): n is a, c, g, or t
  misc_feature (706)..(706): n is a, c, g, or t
  misc_feature (770)..(770): n is a, c, g, or t
  Genomic contig location: Contig_ID=SeqID_33736; Location=166..948; Strand=+
  SCN-specific regions: Sequence locations=1-783
  Gene Ontology: Cellular component=cell wall (sensu Fungi)
atggaaacaacgacaattccattaataattcgccccactacaactattattccaccagcaactcgcactactacaaccgctattccaccaattactcatactaccacaactgctatcccaccgacaactcgcactatttcaacggctattccaccgattattcgcaccaccacgacggctattccattaataattcgccccactacaactattattccaccgactattcgcattaccacaacggctattccaccaacaactcgcgctactacaaaggctattccattaataattcgccccactacaactattattccaccagcaactcgcactactacaaccgctattccaccaattactcatactaccacaactgctatcccaccgacaactcgcactatttcaacggctattccaccgattattcgcaccaccacgacggctattccattaataattcgccccactacaactattattccaccgacaactcgcactactacaaccgctattccaccaattaccacaactgctatcccaccgacaactcgcactatttcaacggctattccaccgattattcgcaccaccacgacggctattccattaataattcgccccactacaactattattccaccgacaactcgcactactacaaccgctattccacccacaacccaggctanaacaagggaaatgccanagggtacaattgaaaccattgagaagctcatcaaaaaactcgagaaaatgacagaaatacggangaaaacaaagtga

SEQ ID NO: 63711 - DNA, 431 bp, Heterodera glycines
  Genomic contig location: Contig_ID=SeqID_33737; Location=201..631; Strand=+
  SCN-specific regions: Sequence locations=1-168,197-431
atggcttactgtaaggacgtttgagcgaaccctgacagtacagtatacgaatctgttttgctctttttataagaagtgggcgttaattgactcaccgttttctaaagatattatgacgtaattaaagccactattgtgccattagcttctgcccagtaataattcaagaatttaaataataaaatgattattttaagttgcctgttgagcttctgataattttgccagcatttttttattatgggtcttatttttctctcacaaaatatgtgagaaattttgtcggagttaatcgtttgagacagccggaagtatttggtgacgaaatcgcattaatttgcaaaagaaatcgaggcggaaatggtcaaacaacgacaaagtgtcgtgtgggaaattaactcaccaattggtcgattttttggtatttcaaa

SEQ ID NO: 63712 - DNA, 634 bp, Heterodera glycines
  Genomic contig location: Contig_ID=SeqID_33740; Location=66..699; Strand=+
  SCN-specific regions: Sequence locations=1-71,100-108,130-144,256 -419,449-548,570-585,607-634
  Gene Ontology: Biological process=N-linked glycosylation
atgaagaaacaaaaggcaaagcccgaggaaaagcccgcggcacctgcagaagccaaagcactagtgccggaacagaagaaggcagaagagacaaaggaaaagctgaagcaggaagagaaagctgcggaagtgccgacctcacctgaagaaaagaagagaaaggaagcagaagcaaaagcgaagagagatgccgaagaaaaggccaaaaaagaggcagaagcaaagaaaaaggaggaagaaattaagaaacaaaaggcaaagcccgaggaaaagcccgcggcttttgatgcaaatgacttcgtggcgcttttttcttcctattcttcaataaatttctctgttaaatttccaagtcagactgctcaaattgaagttgttctctcagattgtcttcttgagaacggtttgttactcaaacaaatttaatttaatttaatttaattttattagttgactcaattaaaccttcgcgcgaaccggcgccgctgtacatgaaacccaaatttgttagagggttgtcaaatgtgattgacctgatggcgctgaatgaagccacgtttgagtgccaattccaaggatttccagaaccaaatgttttatggttcatcgatgatcaacctttgacacagaaagg

SEQ ID NO: 63713 - DNA, 409 bp, Heterodera glycines
  Genomic contig location: Contig_ID=SeqID_7062; Location=497..905; Strand=-
  SCN-specific regions: Sequence locations=1-101,125-132,191-319,341-409
atgaaagaagcaaaattttatcacttactctacgacacattatctgaacagtcgtcagagtaagtggttttcgcccttctgatgacttttttattttttacgaataaataaatcatttattttatttcgtagcaaaaataatccaaaacaacaatataaattattcaacaaaattattaatgaggtgaatccattagtgatttgggcatcttaattgataataaattaaggctttctatcattatactaaaattactaaagctgcttatttaaggattcttaatattgccaaaattctaaaatccagctctatacgtatttgaaccaaaatttataaaaatatattcatcctcttttagaatatgcgcctgaaatttggaatccgacatacaaaaaagatataaataaa

SEQ ID NO: 63714 - DNA, 670 bp, Heterodera glycines
  Genomic contig location: Contig_ID=SeqID_7063; Location=696..1365; Strand=-
  SCN-specific regions: Sequence locations=1-28,52-617,639-670
atggagcacgaaatcggaacttatccatcggtgacattgtccaattcatcaattatcgcggcccttcaaaaacgtggctgcgagggacaattgtgtcaggaaaaggtgtagtttggcgaatttagtcgccacaattgcatgccgttgtaacccgtcatgcaaaccaaatccagaaattcgatcccattccatacaaggaaaatttgggcattgacaatcaggcacaaggcgaacagcaaccggagacaccaaaccgatcacctcgcagagttcggttcgctgacgaacagaacgaaccgctcgaacagatacagccgattgagccgagacggtccacgcgccaaagaaaagccccacaacagttggacatggaagtgaccaaaaccaaatatgattatgtcaaacaggggaagacaaattaaagggggagatgttgggatgttgtcagccattattattttctctcgctctcttccctttagtcatttctctcttatttttccacactctctctctcttgcctgaggcgcataaatagcgacggttcccttccctttttgtccgtctcccagtcatttccaaattcagtccgtatttgccattcatctttctctgtctattttattattatatttattcgcttctgacttattttattgtgttcaataaa

SEQ ID NO: 63715 - DNA, 1011 bp, Heterodera glycines
  Genomic contig location: Contig_ID=SeqID_7063; Location=2762..3772; Strand=+
  SCN-specific regions: Sequence locations=1-208,230-253,281-507,556 -648,670-757,779-804,837-843,865-1011
atgaataataattggatgattagtgagtgagatgttttgttttccaaaattcatttggttttaaaatttttttaacaaatttcatcaaatcatccacaattttttcttaaacggcaaatttttcaatttttcctttcattccttttcattttttgacaacttttgaaataaaagtgcctatttttggattttaagacttttgaagtcaattttttgcactttccttccgtctgtccaaaacaattaattaattaaattgcatgtaattatttactaaatgagggagtaattcttgtgcttttaattatgtttacgatcattttcgagtttgtgatcacaatacagaaattattattcattattaaacaattaataatggcaaaggcaaaggcttctcccgcatttcttccgccaaagtcaaagtgattcccccgccgcccatcgtttggcaataaaaagggcaaattgaaaagaagcgggagggagggggagaagaagcactaaaacattgttattattattatattattattagaggtgttttaaagagacaaaacatagaaaaaagcagcgaaagcgcagacaaacgccgtcggcacaaaacgcacattttatccgatcaaaatcagtttactgacaataaagttgcatttgaaatataaattttaaccaatgaataagccaatcgatggcacgtcgtttaatggcaaaaaacacagaatttaatttatggcttatagactagggcccagcttcctctctttgaaacctttatttaatcattaaaaaagtagattacatactattttaatttcaaaactttaaatatattttttagtcaaaatttccaatttataattatcacaaatttaaaaatgtaaaaaatgctattaagattattgttaatcgattcttgcttttgtctgccaaatgttcagcaactttttttgcctcgtaatagtggcactcatcggaatggttcagtcaaaatttcaaaaaaaaaacaaacaa

SEQ ID NO: 63716 - DNA, 220 bp, Heterodera glycines
  Genomic contig location: Contig_ID=SeqID_7063; Location=4160..4379; Strand=+
  SCN-specific regions: Sequence locations=1-77,127-220
atgggccgaatttacaaatatgtgaaggaattcggtgccgacgcaatcatcgcaacgccgtgcatggacggtgaaacaaaaaaaacatataaaaataataaacaaatattttaaataattaaaaaacattgttatttgtcacagtgccaccaatgcttgggcatttggcctccaatttcaacttgccaatgatggtttggggacagagcatggcgtcggt

SEQ ID NO: 63717 - DNA, 783 bp, Heterodera glycines
  Genomic contig location: Contig_ID=SeqID_33745; Location=43..825; Strand=+
  SCN-specific regions: Sequence locations=1-316,338-783
atggcaccggaggaccaaatcccaaagccccaggcggagaaggaaaatgttgagccacaggcggacccagagaaacaacgcaaacggcgatcaccaccggcaccaatcatcagcgagctggcccgaatgatggatcagctgaaggcctcaatggttgcggaaatccaggactgtttggagcatgtgcgaaatgcgatgatggatgaggtccagctggcgttggacaatttgtgggccaaaatccagccggtcatggtggatcatgggcgctcgattgcggctttggcggatgcatttgatgaaatgaccatgaaagaggccaaggacaaaatggagaaccccacggagggaggtcctggggtaaatgacccaccggctaacagcccaccagagagtggaggccaaaataaccaggctgacaataacaacccaccacagagtggaggccaaaataaccaggctgacaataacaacccacaacaaagtggaggccaaaatgttcagttggctaatcagtttgagcgacccgcccaatggcagggccgagggtcgcgtggaacttggcgtggtcgtcgcgggttcgagaacggagggcctggtcgagtgagctacttgcgacgccagcttgagcgggagtccggcggtcgagtgcgcatccagcacccctacttggaattccgccgtggccgtggttatggaccgagtggcagaattgatcgcgcatttggacaatatggaggacaaaactctggggggccaagccgaggacgccgtgggaactga

SEQ ID NO: 63718 - DNA, 552 bp, Heterodera glycines
  Genomic contig location: Contig_ID=SeqID_33748; Location=164..715; Strand=-
  SCN-specific regions: Sequence locations=1-23,45-182,204-335,400 -461,487-552
atggcatttgtacaatttgctgttttaatttgggacacaattgtggcatatgtccatgggaaaagagcggacggcacaaatgccaacggcgaaattgatgaaaaatcggaaaagattggccacaacagaatccaagcatttattgctgccacaaaatgttttgaccttccggaatggcgaacaaatttaggtgaaaatttaaatgtaaatgcaattttaatttcttttttgttttatttgaatttcttttcccttataagaaaaacccaagaccaaaattgttaagtaattattcctacatcagatttaaaaacattttcaatcatttccaagcgatttttattttttcaaaaagataaaatctaaatgattttataatattataatttaattattattccagcatttttgactctttgatcaaaattgaagcgatctcttcaaaagaagaagaaaaaaaaggccaaaaagtgcctgcttttggcatatcgatctataaagaacatgaatacccagaaagcataagcaaaagcatttcaaaacgtaaataaa

SEQ ID NO: 63719 - DNA, 612 bp, Heterodera glycines
  Genomic contig location: Contig_ID=SeqID_7064; Location=3740..4351; Strand=-
  SCN-specific regions: Sequence locations=1-143,165-323,345-577,601-612
atgacaggttagggagaggacgaaaagttagatagaaagatatgaaacaaacgaagagttaagaaaatagtttcatataataacaaacaaaaattggaaaaagaaaaaggtgaaatgcagagtaaaatgttattccctgttacgaattaaaaaatttaacagatcgactagttaaagtcccattaataaaaaatgccgaaaaagtcttccgccgcatcgacaaggctaggctcaacgaaagtgaacagaatgccagatgcaatgccgagaacgaggaaaaagccggacatcatgccaacaacttgggacttggattcattgacttttctgcataaatttctttctgagaaaagtattaaaatgaattatgttacttcggcgcgtaaaccatcgccaaagaactgcaatagccgtgactgagtgccataagagtgatcagaacagtgaacacccattggttgtggatgaacacgaagcgacgcggagtcaaattgtcatattggtaatcgcaaaaccaaaacaacggaagaaagagcagacggaggcaaatcggcagggacaaataatcggggaaaggctgaaggagggaggggaggggaatagggaaataaa

SEQ ID NO: 63720 - DNA, 1849 bp, Heterodera glycines
  Genomic contig location: Contig_ID=SeqID_7064; Location=2133..3981; Strand=+
  SCN-specific regions: Sequence locations=1-559,581-1063,1090 -1619,1643-1849
aataatgaccacgggctcggaccgaacacaactccaactgcaattacattttaacgcaaataattcttccgaggcatcccaatcacaaaattcctccgaacaaatgcaaaattgttcaagtatgcatttcctaatctttcataataatctgttgaccattgtttagccaatgaaagagtctctggagaagattcggtgccattcatcgacagagagacttttggagacgcggagagtgacagaggaaggggaccgccgcccgatcggtttcgactggtctatctgatcgtgcttctacatggaatgggcatgttgctgccgtggaacactttcattacgatcgcaggggatgtaagacaaaaaaatttcgaaaaacaaacttcaattaaatgttttaatgggctttaaggcacttttataactgcttttttaagtattatttgcaattcaaattcgcaaatgtgagcaatgaagacaattacaaagtgtactttttcaattatctgacggtttgtgcccaaattcccgtgagtttattcatgtttatctgattgtgagcatttttctgcctttttcctattttagaatttgcttctaagttttctgaatttatttgtcgtcataagaggcggcttttaccgtcgcatttacttcactttggccgtcatttttggcatatgtctcgtcacaattgcgatggtttacgttccaaccgataactgtgccttgccattccttatcttttttatcctttcttttcttagggactttcggctttttcctcttcacaatgctatccgttgtgcttctgaatagcgccagtggtgtttatcaaaacagtatttggggattggtcgctgattttcccggggaattcgccggtgccattattcttggcaacaatttatgcgggattctgatggcggtgctatacatcctcatcattgtgttgggtttgcgattcatccgcttcgcttttgttcggttcgcttttagtcggtgccaatgccgcactcgccgccacagtttacttcggtctcgctctgtttaccgtcgtcctttgcattttttctttccattttcttcaaaaattggttctattctatttattttcaaactttaatctttttaaacataaagaatttctacaattactatgtccaaaaagcggcgaaagcgcgcgcgaacaatggaacgaatattctgcacgaggaggaaacgggcgaagcgaaggccaatagaaaagtgacgcatccgccgctaaaaacatacatcgcaattttctctgaggtaagcaccaattaaagcatgatatgctgtgaaaatatcattttggcaacttataggtccgtcgccagttgctcgatgtttggcttgtcttttttgtcactttggctctgtttccgaccgttttgttgaaagtgtctttaattagtccgttcaacgaccagaaaacttccggtggcattttacacattaattgttttttgacatttctcttaagaatcgctctacaagcagctgacagttttcctcaatttcaatgtttgggccgctgtcggctgttggctgtccggcttttccccgagggttttgtccatcggtgttttatttccctattcccctcccctccctccttcagcctttccccgattatttgtccctgccgatttgcctccgtctgctctttcttccgttgttttggttttgcgattaccaatatgacaatttgactccgcgtcgcttcgtgttcatccacaaccaatgggtgttcactgttctgatcactcttatggcactcagtcacggctattgcagttctttggcgatggtttacgcgccgaagtaa

SEQ ID NO: 63721 - DNA, 476 bp, Heterodera glycines
  Genomic contig location: Contig_ID=SeqID_33752; Location=328..803; Strand=-
  SCN-specific regions: Sequence locations=1-17,39-476
atgcttgcctacttcgaaagtgaggagcagcggctgcgagcgaacgaatcaacgacggggatatatagaatcggagattgtgatggtggccaaaacgacgggaaggtcagtagggggggggggggtttgatggttaattgatgtcttaattatgttaatttgtcaaaatccactccagtaggtcagtttccgctctgatcagtccttctctcccattcagcaaattgtgctcggcacttgggagcgattcgccttcgccaatgtccaaccaatggtcgccgggggacattcagcagggcaattccatggaaatgtcctccaatttatgcaatttgtgatcagttcgtttgcccttcagaagcgacgaaatcgtgtcgatgctcagccaaaatcatttagaggcgcccaacgtggagagtcttctcggcggcttacaaatcggacaacgaatggccgccgatcagcgaccgatgcag

SEQ ID NO: 63722 - DNA, 810 bp, Heterodera glycines
  Genomic contig location: Contig_ID=SeqID_33753; Location=160..969; Strand=-
  SCN-specific regions: Sequence locations=1-38,61-83,105-321,343-810
atgttctcaaaattcttttcaaagggaagaaattccatatttaaatatatacagaaatacgaggttaatccctttgaaatacctaatttagtttttgaaaccaaatgctatcatgatggtgctgaaaaatgtgaattatttgccaatttatttgtaaattcgtttaataattctgaagatgacccaggctgttatagcctgggtacaacttttgctaatcaatgctttatatcagatatagactttaacatcatcgagacacaaaaacttttgaaaaaactcccgaataaaaatggtacatccccggatgatataagctataaaacattgaaaaactgccattcttcattggcaactgttattactgacctgttcaggatttctttagattctggttctcttccagatatttggaaggaatcaatagttttacctcttttcaaaaaaggggataaatctaatcctgaaaattataggcctatttctctaacctgctcactttgcagggttatggaaagaattcttagccaaaatatttacaacttcctcctaaaaaacaataaaatttcggaataccaatttggttttgttagaaataggtctacgacaagtcaactaataacagttgtggaagattggtacgaggcaattataaatggaaaaaatgtgaccggtcatgttaaccaaataacaaggaatgcgtatttacgtatgagttccttgtttagaataattaaatccaaatcatctaagatttggattacgttatataaaacttatattaggcctttattggaatacgctccggag

SEQ ID NO: 63723 - DNA, 208 bp, Heterodera glycines
  misc_feature (200)..(200): n is a, c, g, or t
  Genomic contig location: Contig_ID=SeqID_33757; Location=693..900; Strand=+
  SCN-specific regions: Sequence locations=1-208
atgcttctccgttccttcgtgcaagatcgaacaaatttcgccgaattatgcaagaaattggaaaaattggatttgatgaaaatgatcacttttgtaaccaggcgccgtggcaaggctgtgtacgatagtggggaaacggtggaatatttgaggcagcaattcgaagcataccttggcgtaatgcatttgatgcgacaganatgggcct

SEQ ID NO: 63724 - DNA, 444 bp, Heterodera glycines
  Genomic contig location: Contig_ID=SeqID_33760; Location=162..605; Strand=+
  SCN-specific regions: Sequence locations=1-90,116-358,380-444
  Gene Ontology: Mol. function=creatine kinase activity; Cellular component=cytoplasm; Biological process=muscle contraction
atgcgccgcctccccctcactctcgcacgcacccctccctcccgcacgattcgactcgcattcgttacgcacgctctccaggtgtttgttcaaattaagtatatataaaaaatagccctattcagggatacccattcaacccttgcttgatgggaacgactgttcgcgcgagtgtgcatattcgacttccaaagatcagcgcaaatcacgacgacttcaagtccatctgtgaggagttgaaattgcagatccgcgggattcacggcgaacattccgagaggtaattatttattgttctgtttttgaaacaattgtcctttatttagcgctggcggcgtttatgacatcagcaacaaggcccgtcttggtctcacggagttcgaagcggtgaagcagatgtacgacggagtgaaacacctgatcgaattggagaagaaagcataa

SEQ ID NO: 63725 - DNA, 720 bp, Heterodera glycines
  Genomic contig location: Contig_ID=SeqID_33761; Location=219..938; Strand=-
  SCN-specific regions: Sequence locations=1-87,109-314,338-529,551 -642,664-720
atggcccacactgaggtaaaccgcattcatttcgtatataaattgaattcaggaagtcacttggccaacaatttcgcgcgcatatgcaaaaaataaaattggtacaacggctattgttgagagtgaagccgagtataaaaaagtagcgcagagggtaaaggaaaagcttgatataataggcccaaaaaagtaagtaataaatttcaaatttaaacatttacggtttattggatttgatatatccccaagttatttaaaaagactttttttaaataaaacaacccttggaaacatgttttcatgatttttgaaaacaaaaaatatttttccaaaaaatgggggggggcaccatccaaagtattactggttcatttttcaaaatgcctaatttcgtttttatctttgtaatttcttaaatttagatattttcacacagtcatcgttttcccaaattggagtaacgcatttcagttggcgatccttgctacacaaagtcactatttctttttggacggagaaaatgaaatcaaagaaaagaaaattaatgtgatcgttgttcggtgtgaaaacgaccgttttggaagggctatccaagcggggcagtggtttacccaaacagttgaaaaccaaatgaaatacatgataaagtaatttttatttaaatagctattagtagggtcgctacttttagtgacgaaaatctcaaaatagttaattaaa

SEQ ID NO: 63726 - DNA, 1301 bp, Heterodera glycines
  Genomic contig location: Contig_ID=SeqID_7065; Location=2269..3569; Strand=-
  SCN-specific regions: Sequence locations=1-650,683-1301
atgccaattgttatgttatccaacaagcattgcgaagtgattacgctaagtgacgacgatggaggacaacaacagccaatgatggcccagcaagtgcagcgccaccaaccgcgacagcatggtcttcaaaaaaggtgtgcgtgggtgttggtttgtacgcatacataccattgggtaattgagggtgcaagcaggggaccgggacagacatcctgcattgttacacactcgggactgaagtgtcgaaatagctgggactcggatgaatcattaaatttccaaaaagcaaaatattcaacggagtaacaaatttggtttctttcggttactaatttaataaatcaaataatttttgaacaaaatattacattgtgatccgggattaatttggtcgtgaaaccctttaagaaatagttttacataaatctcactcgatggttcggcctcgaattctggatttttttttgttaattatgctttttggacattgaatgattcaattcctaagttgggcacttttaatgtaaataattgtttggacaaaaggttaaaactcattttcatgatgaattagcgtacaatcacatcagaatctgtccccacggacggggattttttttttggcgaagtggagtcttggcgccaagggctataattttataatttttcataaaattaataagttctattttcaacttactaacaaaaaagaatgggttgggcatttgagggtcgaagtcaaagaataccgttgattatggttatgaatataatccttgccctgacaattaaaaatttggaaatttaagtgagtattatggcgactgccaatcgtccaacatcgccgccatcccaaatggacgtctgccgcctaacaatcagcttcacccacgccaacaacagcaggcgcaaatgcagcgacaaacattggcacagttgctgaaagcggagaatgtgtaattaattgatgggatggcatttagtggcgaacttttaaattttgaaagttgtttttaagaagcctaaaggaatcggtttttatcgatttactgaactttttatcgataacattccctttcagccaatcaacggtatcatctctcggcactggaatcatttccaaaaacgttaatcttccgcttcaaaatcagcgtcgcccatgccaacagcagccgacacaaacgcaacggcaaatgctggccgagttgctgaaaacggagaatgggtgattaattgatggggatggtattttgtggcaaaaaaacccaaagtaattaactaaaaaaatttcaaaaattaaa

SEQ ID NO: 63727 - DNA, 593 bp, Heterodera glycines
  Genomic contig location: Contig_ID=SeqID_33764; Location=117..709; Strand=+
  SCN-specific regions: Sequence locations=1-193,217-380,402-593
atggtcatgtccacgggtgggccccactccaaccttggcctgatgagcagcagcggtggaccgcactccaaccttggcccgatgaacccacattcggtccagaatccactttctgtgcagaatcctcattcggtgcaaaacccacaatctgtgacgggcattgccccgggctcagtgaaatcgtacaatgatgatatgcagcatcaaatgcaacagcaaaaagcaagtggaagtaaagaggaaggggcaaatgaagaactgacagttgtggagcagtacaacgaatccagggaccagtttatgaacgtatgcgacaacattgagcgcaacatggtatcattgacattggacttttaacaatagagtgtaccttagattatttttgggtttttgtgtcggaaaaggggtccgacgtaccgacacgcgaagttgcaagggtgggggataccgagagaatggaccggactattccatactcattagaaaattttcagcaactcatcctcgaagtaaaccgtcaacagagcaagctgtacaatcagcagcaaaattctgcagtcgcgtgggttgaagtgacatcaatgttagggtga

SEQ ID NO: 63728 - DNA, 87 bp, Heterodera glycines
  Genomic contig location: Contig_ID=SeqID_33768; Location=949..1035; Strand=+
  SCN-specific regions: Sequence locations=1-87
gccaattgattgacggcggtcattgaattcctgttatttgtgttgtttctatcgtttttttgtgacaaatgaaatacgcccagctag

SEQ ID NO: 63729 - DNA, 159 bp, Heterodera glycines
  Genomic contig location: Contig_ID=SeqID_33771; Location=11..169; Strand=+
  SCN-specific regions: Sequence locations=1-18,40-159
atgctttctaccggctttgccaagaacaaggatgctgacggcctgagcatggccgaacccggagccatggccgagcagctcaacgccgaagtacgcacccacacccgtatcagcggaatcgaccctggtcataagcgcctgtggattggtgaggagcag

SEQ ID NO: 63730 - DNA, 1056 bp, Heterodera glycines
  Genomic contig location: Contig_ID=SeqID_7068; Location=118..1173; Strand=-
  SCN-specific regions: Sequence locations=1-996,1021-1056
atgtcggaccctgccctcatttttcttcacattccactggaggaccttaaagtatgtttttgtgtttgtttgtttgttgttgctcaaaatttaaaatttattttcatgtgtagctgatcgaatgtgccatcaaagacgtgcagttatttgccgtttccttggagaataaacgtcatggattgccgccgctcaattccctcgtcaaacttctcttctatccgcgcccttcgacgcgacggtatcggccttctaattaccaccatcaatgtcttgttcagctttgtctttaagtcacaacaatcagcatgacgacgccctgacaccgcagtgacaactgaaattgatgacgctgatgttggatttcgctcgattccgccatcaccccttcagccgtttccgagcacttggacaagaccaaaaccattttgagtgagtgtttattcgaattttaaatcttttattcataaataattttggtttagcgcgtccattcccgccaattgttcctttttgaatagcttggaaccggtcaccccaactctcaagccggacaaaaacgatttgcccgaattgaaacgcgtcagtccatttgtttcgcgttgtaaaatgtaccattgaataaatttttcagtcacgattcattcgtattgcggaatacgaacaatcgctcaagaggtatgttaagcttcgagtgacactcgttgcattcaacaacgccctgacaccgcagtgtcaactcgaattgatggacgcttgacgttggatttgatgcgtctcggcgtcacgttttgattttggttttcattgtcaatgtatctgagctgttcgtttagaactttatcattcccaagcttgacgaggccaaaacacttgctgtaaatattttgacacgttcggtggaacttttggagctcgaagagtaatgcttttttctttttgtatcgtgaattccttttgatacatcccggctataactgatttaacatgattgtattattgttttttcttttcttatttcaccaattgttattatttgttaattgatttggaaataaa

SEQ ID NO: 63731 - DNA, 704 bp, Heterodera glycines
  Genomic contig location: Contig_ID=SeqID_33772; Location=129..832; Strand=+
  SCN-specific regions: Sequence locations=1-1,88-271,294-368,390 -532,556-704
atggtgctgctgctgcttctgctgtcattgttgttgtctgttctcgcgctgatgccattgttgttgttgttattgtcacaattgttggcacaatgccaagcggtgaacgaattaacattcatgttgctgttgatgcttctgtccacggtcagcaagtcgaccagctggttgcaggtcaaaattcgcgcattgtgtattgtctttagctgggcacctgcaatggtttattagagtgaatgaacatcgattttttttttttgaaaattcatgcaaaaatatattaattttatagacgaggaatgaattttctgagttcccgagactttaagctttcgtttggtaccatgaatgtgtgttttggccaattaagaaattgaaaatattggaacagagccgaatcgcatacccgtcgaaaatcggttcaaaaagaaattttgttaatttcaaattttgcaaaatgtttgataattgattgtattgattagcaaattccgaggtattccttcctgcttaagtgcctgatgatgtcaagaaaaaaaatttttttttttttttggaagtttgtacttccacagaccaatgcaaatggtgaagctctcagaggagactttggatgttgcaacgggctgacgatgaatactgccaatgtcagaatgttgtcggtgtacggccataattttcgaatcgcacgaatgtgacctaaa

SEQ ID NO: 63732 - DNA, 285 bp, Heterodera glycines
  Genomic contig location: Contig_ID=SeqID_33773; Location=1..285; Strand=-
  SCN-specific regions: Sequence locations=1-58,180-285
atcctgaaatcgccaagtaaatatctatgctacacctttatcattagtaccgctgcgctcgtactgttgattatgctgccgcacgaaagtatgccggtctatttagggatggcatgtacgctgggctttggcgcgatagtctttacacagcgagccgtattttttgcacctatcggcgaagcaaaaattgctgaaaataaaacaggtgcggcgatggcgttgggtagctttattggttacgctccggcgatgttctgcttcagtctgtatggctacattctggat

SEQ ID NO: 63733 - DNA, 1336 bp, Heterodera glycines
  misc_feature (553)..(553): n is a, c, g, or t
  Genomic contig location: Contig_ID=SeqID_33775; Location=68..1403; Strand=+
  SCN-specific regions: Sequence locations=1-29,113-138,162-215,237 -771,793-829,851-1231,1256-1270,1295-1336
atggcgaaacgtcatagaaccgaaaggaaagagggagaagaaacagaagaaagggaagagaaagagaacaaagaaagggggaaagagaaagagacagaaaatgaacaggaaatgagggaacttggccaaatggaggtcataaattaattaataaagaaaagtcaggaatttgaaaattcaggatcagatttcgggtgggagccagaccgggtcggattttactaataaaacattgtttttcaagatcctgatccaggtcccaaacttttgaccctgaccacgatccgtttctaaaaatgcctaaaaaatttaattcgagaaaacaaaattattgaggcgtcattattagtgctcgactttttgaaaaaagactgggcctggatttgttgggcctgagcctggcttgcgtggacaaaatttcggaaaaacaaggtccatgagaaacccaggttgccgaaaaaggcccggaccttgcttgacctggatctaggaaaatccagacttggacccaattccaggtcgagctctatcaactttattatagttaaactanatgtacttgtcaaaaatatcttgagactcccggtaaaattatcaaatagcctcagcactttagcttaattattttctttagcatccgttgccgaattatttgttgccagaagacaaaatcccggagtataagctgcacaaatgcacacagtgtttatgttcattttattgggccaaatcacttcaaaaacactcatgcaaaggccaacagacggagaaagggacagaagaagaaaaggaagcggtgatcagtgattgattgaaaatgaatttataataatttaaatggattaattaaatccgaaatttcagaaacaaactgttactgatgctaataacccgggagagcagaaggaggcaagtcaatccgatgcaaaagcattgggtgaaaaacagcagaactgttatgatgaggtaaatgggttttccagatctgggattttccttatctgctaaaagtctgtaagaatttgcataaaattagggtttgctgatttttttgcttttttgaaaaactttacctgacgctgtctttttttatgaccaactgaaacatgatcagcgtcagacacatgaacaagctataaaatatgtaaatagaaggggaaaaatcgaagcccgacccggacttctttcttcgacccaacccgatttttttctccacccgctacaatccgggaagacattatttttaataaaacgttaaattaattgttactttttatttcaaatttaacagaaaaccaaagccaatgctgagaagcaatatgaggtgggtatttaa

SEQ ID NO: 63734 - DNA, 657 bp, Heterodera glycines
  Genomic contig location: Contig_ID=SeqID_33776; Location=229..885; Strand=+
  SCN-specific regions: Sequence locations=1-657
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataatttgttgagtaccccaaacggacacttgaaaaaatcgatttttttg

SEQ ID NO: 63735 - DNA, 1316 bp, Heterodera glycines
  Genomic contig location: Contig_ID=SeqID_7069; Location=3430..4745; Strand=-
  SCN-specific regions: Sequence locations=1-384,406-500,522-784,807 -833,856-897,931-985,1007-1046,1068-1115,1137-1316
atgaccatcaaaatttgggactttgtgaacacttacgaatgtttgaaaacactcaaagggtaatctctcattttgcgccttttttgctaatttaccttttttcctttagccatgaacataatatttcttccgtcgtttttcttccctccggagattttattttgtccgcgtcgcgggacaagctgattaaactgtgggacattgcgaatggttattgcgtgcagaacttctccaaacacaccgattgggttcgaatggtggcggttaacgaggacggaaagtgttttgcttcgtgcagcaatgacagggtaacaaattgcattttttttattgaggcggagtatgggaattaaagaaataaagacaacgatggcactctcctattttatacaaatcatagaccaaaatgtgaggggaatgggcggtcgactcccccaaccgtaagaaatttcatatggttttttgcaatttcttcgctccaaaagcagatcttactcgcaatttgtaaactttttaaatgaggattaaaaccacttagaaaaaactctaaaaatttaaccactttacttgtatatattcggaccattcattgcattttcagtccattattatttggtgtttggccaccaaagtgccgaaaatgactttgcttggccatgaacatgtcatcgagtcgatcatttgggtgtcggacaaaagcgctgctcaaattctcacattttccggcgagtcgtcgcgagaaggtggcaaatttcatttttaatgccgaacttatttaatggaatttgcattaccataggaaaaactaacggagacattgagcaacaacagcagaaaacggccatgttggtctccgcatcgcgtgaccgatccattcgcttttgggaggtaaccattttttgagtttggcttttttggttcattatttccgccattttccatcccttctttaggtgttgtccggctgttgtctgtttaccttggctggccatgacaattgggtgcgcgacattcgactgcatcctaacggcaaatttttggtgcgagaaaaccccgggggttggaaatggtaccaaaaaaggaggcgaaataacccatttatagttttttacggcttttttgttattcattttattcaatttgagtgttaaactgtctattttgtgcaggtgtctgtcagtgacgacaaaacgttgcgcgtgtggagcattgagcaccggcggtgcattaaaacgctgcaggcacatccccaatttgtcaccgcgttgggtaaacaaattatttgtttttaatgacggttaactacttgtaataaa

SEQ ID NO: 63736 - DNA, 570 bp, Heterodera glycines
  Genomic contig location: Contig_ID=SeqID_33782; Location=88..657; Strand=-
  SCN-specific regions: Sequence locations=1-76,98-570
atgcttacggcaactccggcatcgtttctttactgtaagtaccgtaattttccattgaggctgcgattggcccaccattttttaattacccaaatttttgacaattaaatttaaactcccaaaaaaatgaacccaaatgtttgacatttagattttaaaacccccaaaaaaaatgattttctttttcagccggtgccaccaaggacgagctggaggagatcaaaagccaggtgaacgaggtgaagcagaagtggcggaccggcgacttggagggcgcggacattcaagaggacagcgcaatgcgcgacgaattggaggcgctcaaaggggtccgtgtgtttgcctgccccatgacttacaaaatttccaaaaaaatttcatcctttgaggaggttgtggcctatgattttcaaaaaaaaaagttttccctggcttgcatcgattgccctagctcacattttccgtttttttttgtaggtgaacgtgaaggagcgtttccagcctggtcagggcgagttccagaagtcctacgaccgttcggagttggacacttccggtgtgtgcgtttag

SEQ ID NO: 63737 - DNA, 665 bp, Heterodera glycines
  misc_feature (642)..(642): n is a, c, g, or t
  Genomic contig location: Contig_ID=SeqID_33785; Location=32..696; Strand=-
  SCN-specific regions: Sequence locations=1-298,320-665
atggcagatgacagccggattgcaggaatatgtgaaagtcctttggaattaggtgcaaacggaacaaattaattggaacataaatattaaaaaaaaggtccggcgaagcagcagcaattgtccgatgctggtggcctaccatcatcaagttctgctactgttgctgctgatcccaaggcgtctggatcgtttccgctctcattcactgatttgaccccgattcgttcaaagtcagtgaagattgaagcaaaaaggcgaaaagttgaaacggcactgttgacgacaaaaatttgtgaaactgctgctgctgctgctgctgaattgccaacactgaaggaaatgcaactcaaagtgcttgaaaaggaggacgcaaaattgacgttggaaattcgaaaactcgaactcgagttggaagttttggagttgaaaaaagaaaaacaaacccgaaaattattggcaaatttttaaaagatgcaaaaaaagcgaaaaatacatccctaaaaagagaattttttcgaaatttcggaaatttttttttaggtattttgtccattccaaaaatttttcgctgaaaacaatgaagttattacaaaaattttgatatgtatttgatttgcaactgtgaagcgtgaatttaattanaattggcatgttttaagattaaa

SEQ ID NO: 63738 - DNA, 854 bp, Heterodera glycines
  Genomic contig location: Contig_ID=SeqID_33788; Location=264..1117; Strand=-
  SCN-specific regions: Sequence locations=1-358,381-408,445-717,741 -760,818-854
atgagttggcaatgcccgtggacatgtaaccgatgcccaccggatggaaatgtgccgacaaggccaccccaaattttagatccgccgcttccaaacagaaattgcaaggattttttagagtgagacttcaatggcacatacataaatgacaaatctcagtcattgataatttgttttgattatatgtggattttaaaaatctcaaaatatcgtcccttttaaaagctaatctttttgcaaacattttttatttttactcaatttattttctataatatagcccccccccccctaaattagacccactctcttaaataaagccctcatttagaaaggggctgaaaaatcaagcacccagtggcttaattttaggaaatttacttaaaaataaaatgttttcgtcgacagattttaaaaatattttttaaaatttttagtttttttgcgttttatttaaaaattgtcataagatataagcctttagtgattttgttgttttaagaagaagcggaatcaaaaaaaaaataaaacaacatttaagttgtccagcatgggcgcggaatggcaattgttcactttattcaacgtcaacacgagccgcattttgtccaatcacttgtcaagttgggtgtgcaattggaggaggggaaggaggagtggtgctaacatcatttaatggataaaatttctatgattatgaaacgcctaattacactaattaaaattaattccaagaaaatatgtaatttcaaaatgttgacatcatcatcattatcatcatcataatttaattgataaaaatttaaaaaatatataagcgccaattacaccagtaaaatcaatttcgtaataaa

SEQ ID NO: 63739 - DNA, 751 bp, Heterodera glycines
  Genomic contig location: Contig_ID=SeqID_7071; Location=314..1064; Strand=-
  SCN-specific regions: Sequence locations=1-111,148-751
atgtccgatcaaatccgttgtttaattcaatcgggagttggatctgatcattatgcaattacgagtgacggttggtctaagccgacactgtcaccacaattacaaaggttgataattattttttaataatgtttaatcattttaattgtaatttcagtgtcactgttcattggattgataaaagtttctctcgccacgatgccgtactcgctgccttttccatggaaaattttgttcactctggtgaactgatctcggagaaaattgcactatgtttgaatcaaaatggattgacattgaacaaaatggcgtgttgtgtgcgtgatgatgcgaagaatatgcaatctgccatcagacagttggaaaaggagaggtatgccaaggaaatcagtgataaatgaatgaaatctttagttttcaatgttgtgcacattttctcaatttggttgtcagtgatgcaatgaagacagagtgcctttcagaaattattttcaagacgaaagaagtgaccaacgaaatgccggacttttgtgcttgtcaaagcggcctcgcctggcagagatggaaacaatacctgcttctcagcaaataagcaattatatccaataactaatgaatttcagctgtcgcgcgaggtgtcaacggcgtcagtgattttgccgactcttaaacgacttcatgtttttttgcaagagggaaaatttccagaaattattcaaccgtttatcgacagtttggtggactcattaaa

SEQ ID NO: 63740 - DNA, 539 bp, Heterodera glycines
  Genomic contig location: Contig_ID=SeqID_7071; Location=3255..3793; Strand=+
  SCN-specific regions: Sequence locations=1-22,47-49,71-501,523-539
atgttcattattaatttctctgttattttatttgttttaatttcccccgttttgtcatcatttgctacaatatgcgtacgaccgaacacttttaattatgtggggcgactgtggtgtacacgcaataacattatgcacatgatttatcaagataagcccaaattgcagatgaagaaagtggaagatattcatgcattgccttctgggtggatttaggcatttgtgatcagaatgacacgaacgcaatgatccaaatcatcaaagcagataccaatgaaacggttggtattgcaaatggatgtgatttatgtaattagtagggctctaatttttagttttttacccattttttcctgctgaactctccgtgtggcctgaaacgcacgaaaaacaattgtttttttggtgtgttgttaagctacttttcgagttattagttcctattttcggtttttatttcttagagcctaaaaagaaatttaaaaacttattttaacctattttggcgttttgcccaaatttattaacaaacaggcaaa

SEQ ID NO: 63741 - DNA, 1074 bp, Heterodera glycines
  Genomic contig location: Contig_ID=SeqID_7071; Location=5278..6351; Strand=+
  SCN-specific regions: Sequence locations=1-185,223-260,282-284,419 -550,582-818,860-1044
atgttcatcgttttaccaagtatttatatgctttttgcgacccgaattttcattaatttattttcggatgactctttccaattttttttttttggatgattcgttttgcgcaattcgtcgctgacgtcattgaatgcttttacacctagcaatttcctagaatattttttggagtacctaatttgtttttaataaaatttaatatatttttttaaataaaatgcattgatttccttaaatccgaaaattattattttttattgggtttttggaaattaaaatggaaaataaataaatgtttaattatgtttttaatttgattttctcactaataattgatataaataattatttttcttttctttaattttcattaatcagtttatttttttaaagaatttcatatttaacatatattcatgtaaataaagattgaaaacccgaaaaattttgaattttttgtaagaacttttgagaaaaaaatagttgatataagaaaaatgtcttttgttttagcataatgataaaaattttaaaaattctagattgcatatataaatttaaaaaatcaaaatttttttgaagttatctaaaaacgctggtgtttttatgtatttttataacaatttttgcatttttgagggttcaaagctatttttggcagtttttaacgcatattttagtgaatatttgggcgtttttcgtgtttttaggtcatatttgggggatttttagtgcatattttatgcgcatatttggcattttttagtgaatccaacctataactctagtgatgataatagatatttaagcaattcaatattttaaaaaaaattaattttaaaaaatttaaaattaagtttaacatttttacggtcgatcggttactgataattggaattgcaaaaactttgccccattttagcaaattggaattgaccgataaggtaattttcgaacttgtaaattaaagtaaattagaaggtatccaattataaaaaacatgatatgtcgatacattaacgaacgacccacggacaaaggaattaattaaaaaaaaaatattttttttaa

SEQ ID NO: 63742 - DNA, 790 bp, Heterodera glycines
  Genomic contig location: Contig_ID=SeqID_33793; Location=58..847; Strand=+
  SCN-specific regions: Sequence locations=1-536,558-736,759-790
atgcccgctgcgagggcaccccgccaaagggtcctctacatgctggtattttttatttttttaatagagccaccccctggcctgcagaaaatggcaactgaagcgtgctcaaaaagtacacttcagtaccaggcgaataccgcgtcggcgtttgatctgagagaaaagtgcccagcgaacttattgtagagctttgaaagctcgatttttcaaaatttaaaaatttcgaaaattttcaaaaattttcgagttaggcctaaaaaacggttttcgggtttttgaattttaggattttttaacgatttttcccagagaaacggagaccacttccaaaacatagtttttcgagctctatcgattggtatttttttcggaaaaatttcgattttttcccggaaatagaaaaaaattttggcctcagcgggacatttgagtcctgggcccataactcgtcaggggttggttttagcgaaaaattgtattagaacatttttgtagagaattttaaatgctatcgaatggtgtgcttaatgactggaaaatttcaaaaattttcgagctaggccccctagaaattttcggaaattttttttcggacgaaaatgggggtgaaaaatatttttctggggtaaaataaggtgctgagtacgaatataatgtctattttaagtttcataatttttggaattttttaaaaattctttattttttggcaattttttggccttggaaatttgggttaatattggaaaattcataactcggtgatggtttcatcgatttaactata

SEQ ID NO: 63743 - DNA, 600 bp, Heterodera glycines
  Genomic contig location: Contig_ID=SeqID_33794; Location=266..865; Strand=-
  SCN-specific regions: Sequence locations=1-234,264-600
gacgacctgcgctttttgtattcgcccgaacattcgctgtcccgtttcgaataccaaattcacaaggaattcagcggagactccgtcaacaggtcattctcccccccccctaattgcttttattttgatcattaattggctttttgttcagctcttacattgccatcgcattggaagcggcaccgcctttggcgggtgtcgatgactcatcagtggaagacgcggcaaatttggtaaattttctgttaatttttaaaatttttctattcattgtaaataccaattcttttgcattattaattaattgtttagcaaaatgttgcagcaaatggcgccgcttcgcccccgtggtggaaaaatatgctgcggagagaagtggcgaacgcaattcaggcggacaaattttaaattggaataaataatcaaaatctatgctttaatcaatttcagggcacaatgaatgccattctgcacaatatgacggtcgaattgccggacggaagttaccattttggcaacgacatttgcgcacggatggcactttgtccgattagcaattcgccggttcaacttttttacgacgcctatttcagcgaaaag

SEQ ID NO: 63744 - DNA, 715 bp, Heterodera glycines
  Genomic contig location: Contig_ID=SeqID_33795; Location=51..765; Strand=-
  SCN-specific regions: Sequence locations=1-232,258-670,692-715
atggtgctcaagggcaaaggaattaaacgcctggagcagccgggctatggtgaccaaatactcaacatcaaagtgaatgtgccgaagtgagttttttttttgcgtaaatttggagtggctcttgatgatgatttggacatatttgatttcctcactatttttcattgacccctggggctgaaaattcgggaccaccagcaaaaagatgccccttcctatcccctctccatcctataaaaatggaatgttttgatttgatcgtccgttgtcaactgatttttgcggcgcctcatgttccttaacaccacaggcatctaacggctcgtcaacgtacactgatgctggagtttgccaagttggaagcgggacggcgcggcaccgtggacgggttggacagtggtggcggcaaaggaggaggcgcagcagcaaatgaccaagcggaagagccggaagaaatgccagcagcaggcacaaaaaagaagggcactaatggtggcggcggcgaagacaaagggggcgctggtttcaaatggtccaaattcttttgataattatgcccgcgcgcaacaaattttcatccatttttgctccacacagatcacaatttccatccagtgtttgattgaaaattatcgtcgtcctcctgttttgtgtttttgttaaattgttctacaatatatacaacattttactattttacacatattacaataaa

SEQ ID NO: 63745 - DNA, 465 bp, Heterodera glycines
  Genomic contig location: Contig_ID=SeqID_33796; Location=433..897; Strand=-
  SCN-specific regions: Sequence locations=1-264,286-465
ggtccccctaaagcagaggaatttgatgcaacaggtgccgatacggaaacagaagaatcattaacatataatttcccaacgtttgtctcaattagacgagcctataatagacgaagacaacaaaaacatggaatttcaactgatccttatgagatacctgcacaattattattaacaagacaaggagcaattaaattagctttaaataaaccattgtcaaaggatgacaagttaattttctttgaattaatagctaattaagttattataaaaataaatgtttaagctgggtaatctatagaaatagagatgaaggaattataatttttgataccaaaacggcagaattgctttcggcactagcaataggagcagcgatcgcaacgctcttaactccaattgtggtcgggtctgttgcaattggttacgttattgcatacaacgtgcataaaaacaatgaaaaac

SEQ ID NO: 63746 - DNA, 576 bp, Heterodera glycines
  Genomic contig location: Contig_ID=SeqID_33797; Location=81..656; Strand=-
  SCN-specific regions: Sequence locations=1-88,110-124,160-260,282 -464,486-506,528-576
gtaattgtccatttcgatctgaaaggagctgcaccaaagccacattatattaaagaattattaccgttcattaagaaattgggatttactgaaattcttatggagtatgaagtacaggaaattgtaattttattatttttaaatatttttttaatttaaggacatgttcccatactcttttgggttgtcggttttaagacgaaagactgcttttgatgaaatgactaccaagcagcttaaagaggttgtgtatcttcattaaatattgctgttatttttggcactagttaaaagaaggacatttttgaaaattatcaaaaacaataggggggagggacccttttgttttgcaaaaaaattttgtgataaaaaaccgttaaaatttgttctccgggggtttagggtcgctatcacgaatttgacatctattttgaccaatttctaaacccgaacaaaaatcaaaatttgaatttttcgatttatgattttttgttcaaatttaggttaggaaatgggaattgatcaaaatagttgacagattcgtgatcgggaaccccgaaaaccccgttgaataaa

SEQ ID NO: 63747 - DNA, 74 bp, Heterodera glycines
  Genomic contig location: Contig_ID=SeqID_33801; Location=223..296; Strand=+
  SCN-specific regions: Sequence locations=1-74
tttctcggaattttttggggtcatttatttccataatatttttcggtaataaattccatgaattaataacccta

SEQ ID NO: 63748 - DNA, 434 bp, Heterodera glycines
  Genomic contig location: Contig_ID=SeqID_7072; Location=160..593; Strand=+
  SCN-specific regions: Sequence locations=1-83,105-342,364-379,401-434
atggaaccgggatttgccagcccttggatgtttaagtttttaggtttgaaataagggaataaaaaatcacataatattttcagaatttggaaacaatttacaaggaaaattacggaatttgttatggtttatgacataaaaattaatttacacgacagagataatgttgtcaaattacaatcactaattcacaatcagtttcaagctccatgttttaatgattggctagtttttgcttggaaaaaagctgggtactacggtgatgacacattgccaaatttttgtcaccccaacaaatatgcgttcgatgtgccaaaagaaagatatttgcgaaaaatttaattgtgaaaatattattttattgagatgtgcctattgcaaaatgtatttgtgttttaaatattttttgacgattatcacatatgtgaaaatga

SEQ ID NO: 63749 - DNA, 71 bp, Heterodera glycines
  Genomic contig location: Contig_ID=SeqID_7073; Location=2895..2965; Strand=-
  SCN-specific regions: Sequence locations=1-71
gttttgcgtgcgtttcaggccacggggagctcaggaaaaaaataggcttttgcctaaaaattggaacccta

SEQ ID NO: 63750 - DNA, 864 bp, Heterodera glycines
  Genomic contig location: Contig_ID=SeqID_33803; Location=13..876; Strand=+
  SCN-specific regions: Sequence locations=1-57,111-180,202-242,276 -322,344-387,441-644,666-670,693-864
atggataaagaaaaggtggtttactgtaaaaaatggtgttaattcgcgtgcaggatctataaataaattaatattattttaatcattaaaaatattttagttatataaatgataaatcgaaatttattaatgctatgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcaagtgattttgatagaaaatggaaatgaaaatgtggtttattgaaaaaaaatggtgttaattcgcgtgcagaatctataaataaattaatattattttaatcattaaaaatattttagttatataaatgataaatcgaaatttattaatgctctgataaaaaaagcatttgataatggattcaacagttcaaatgatgcgacgtttttcgcccgaaaaactgcaaccggcgataacagaagaaaagaggaatgaagtgaaaaatgttgggaatatggcaatggaagagggctacgaagaggaactgatggcactataacagtgaaagaagcgccaggaaaaccaccattatggtcccatttgttgttaatgttgttgtttatgtttattgttatatataaacaaataataatatgagaaaggcaacagagatggacagcaaagaacctaaatacgatatgacaaatgccatctggtccctcctgttcgcagcgtcacaagaaacgcaaggcccacatgccaagcacaccaacggtcaatccgaacctgaaca

SEQ ID NO: 63751 - DNA, 129 bp, Heterodera glycines
  Genomic contig location: Contig_ID=SeqID_33803; Location=741..869; Strand=-
  SCN-specific regions: Sequence locations=1-129
gttcggattgaccgttggtgtgcttggcatgtgggccttgcgtttcttgtgacgctgcgaacaggagggaccagatggcatttgtcatatcgtatttaggttctttgctgtccatctctgttgcctttc

SEQ ID NO: 63752 - DNA, 812 bp, Heterodera glycines
  Genomic contig location: Contig_ID=SeqID_33804; Location=30..841; Strand=-
  SCN-specific regions: Sequence locations=1-412,434-812
atgccttatggtgttgcgtcagcgccagccatttttcaacaagtgatggaagacgtccttcgtggaatcgacggagtcgccgtctacttggatgatattgtggtgacagcccccaacgacgcggaacatttgaaaaggctggaaatgactctccaacgcatccaaaaatttggattgcgtgtcaaaaaggaaaatgttcctttatgaaaaaccaaattgcttatttggggcacatcatcgacaaagaagggatcgaacgtcgccggacaaagttgaggccatacagaaaattccagcccccaaaaacttaaaggaattgaaatccttcttgggcatggttgggtattatcgcaagttcattccgtcaatggcaacaatttcggagccgttgaacgagctacgccgatcagagaccaaatggcattggggacaacaacagcaaaaatcattcgaacagatcaaaattatgctgtcgtcgaacgagctgttggcccattttgatcccaaaaagccactttatttggcaacggatgcatctgactacggagtcggagcgatccttttccacaaagatggaacaactggaaagtttggcgtgatcgcgtacgcttcaagaactttgagcccagccgaaagaaattatgcgcagatcgaaaaagaaggacgcgcagtaatcttcggagtggagaaattcaaccagtacttgtacggtagaaaattcattctacagacttatcacgagcctttaaaaaggatttttggaccaaaaggcgagctgcccgtggttgcggcacgaagacttcatcgttgga

SEQ ID NO: 63753 - DNA, 565 bp, Heterodera glycines
  misc_feature (286)..(286): n is a, c, g, or t
  Genomic contig location: Contig_ID=SeqID_33807; Location=1..565; Strand=+
  SCN-specific regions: Sequence locations=1-248,283-402,425-565
  Gene Ontology: Mol. function=proteasome endopeptidase activity; Cellular component=proteasome regulatory particle (sensu Eukarya); Biological process=embryogenesis and morphogenesis
actcccattttgcgcaacaggtgactccgaagtgcagcgcacaatgctcgaattgcttaaccaactcgacggttttgagcctaccaaaaacatcaaagtgataatggcaacgaatcggatcgacattttggacccggcactgctcaggccaggtcggtgccaaagctgccaatgtttgtataattttatgaaattgctaaggtcggattgatcgtaaaatcgaatttcctgcacccgacgagaaagccagactggacatcctgaagatccattccagaaaaatganatttgatgcgtggcataaacatgagcaaaattgccgaaactattcctggcgcctcgggggcagaagttaaggcgagtgtggccatgggggatggctaattgatacggctaatcactgtaccttcgtcccttcccttttaaggccgtttgcactgaggcgggaatgttcgcattgcgcgaacgtcggatacacgtgacgcaggaggacttcgaaatggcagtgggcaaagtgatggccaaggacggggagaaggacatgtcgctgaggaaattgttcaaa

SEQ ID NO: 63754 - DNA, 57 bp, Heterodera glycines
  Genomic contig location: Contig_ID=SeqID_33808; Location=782..838; Strand=+
  SCN-specific regions: Sequence locations=1-57
atgagcacgatttcctgtcaaaggcagccattgcggacgcaattcgagcagttcaca

SEQ ID NO: 63755 - DNA, 2571 bp, Heterodera glycines
  Genomic contig location: Contig_ID=SeqID_7075; Location=164..2734; Strand=-
  SCN-specific regions: Sequence locations=1-1004,1026-1187,1209 -1894,1917-2158,2180-2571
atggctctctttagagcccgcagtgacaagacgccgacccacgccgggataccagcccctgatgaggtccgagagggagggtgcggccaaaaccgaaccaatcccgcggccccccgtggtaaggcggtagcgattcaaaggcaaaacggtataactattcctataaatgcctgcgctcaatccggcctagtccggacccagagggttcagcagtggtcagccgtggaggagtccgctttaaaggatgtagtggtgcgaaacacagacgaccgggggctcattaattgggccaaaggtgtgctccctgaatggcaaagattgtgccagctcaacccgaccatgtacatggctcgatcgtctccatcgctgtccaataagtgggcatctctgcggcggacccatgttggtcctggatgcccttcgaaagaaggctccgggccctcacaagacctttcagatgtaaaaatccaaccagccaggttggcccatgatacggtggccgagctacctcaacgtactgtcccttgtggcacagacggtcatggtgtaatcgattccgatgagaccgagactgccttagctgaggtatcccggtcgagtccctttggagaacgcgagccgctcgacttaggggcgacagagaggatcacgcgtaagcggctgcgcaacgccgttcgcgatgtggttccacctcggaaacgcagggttccatccacctcttcacgtaaggaacaagatttggttccagaggtggacaggcctgcacctacggatgtgttgacacacccacccacagaatccgaaccagaaccgatgcttgacccactctcacttgtccaactggtaaagccgcaattaggccgggcaatgggatgggcagccgaggagatggaactcgggaatgtcgtgatggacgtagagctgaagagggagttcaaccgggaggtgaggcgtgtcggaagaacgcctcccgaccaaatgtataagcgtggcgcaggtccaccactcccacagaaacgagagcccgaacgagtagccctactcgagcaactcattgtggcgcgcgtggagcgtgacatcaacaggggacttgattggttccttgaactgaatgtcgcggtctttgcagccgctagggttctgagccgccgggagagagtggaaactcttgctgatcggctgcacatcaacgattctgccactctgtccgaagtatccagacggcgagctaaagccgaaaggaaactccggtgtgcccgggaacaaccatggatgagcaggcggatcaggatacttggtgtgagggtcgagagactcaaacaactagctgacctggtccggcaaagaatagctgggagaggtaatagatcgtcttatgaaggccctaggcggagattccgactaagaccttctttacgttctgttactgaagcacctgtcaatccaccccttaacgggaatgaagtttacacgttctggcatagcctttgggcgcagagcctccgtgctaacacggatgactgtcaactgagggaattcaaaaaccagctttctgctgcgcgacacacggatctgacgaacgtcggaaccagctcattggttcagatgttcagcgcggcccttcggaaaatgaagaagggcaaagctcccggtcctgatggtatccgtgccgcgtggtggggagtgttccggcgaattgcaccgtatgtggctacgtgggtggtccaagtaatacgaggggcagaaccagtagctaactggatctgcaatgggctcactgtcctgctgcctaagagtagtgacaatgccgaccctagtaactaccggccaatcacatgcctaaatacatgctacaaactcttcactgccgttatcgcacaaataaccgcaagttacgttgatgttcttggtggcctacctagacaacaagtagcactgcgaaaaggcgtttggggcacctctgtgtccctgatgatcgatgcgctaacggtggctgacgcgagaagagctaaacgcccacttggagtctgctggttcgacttcaagaaagcgtttgactcagtaccgcacaacttaattcgctggatcctgagagtcatcggactccccccggtcatcttgtctgtcattgtctctgtgatggatcaatgggtaacgaggttaaagataggtggaaaggtcatgcccaagaccatcccggtgcgaaccggcgtattccaaggggacaccctatcgcccctgcttttctgcctatctgtttggccaatctcgttcgccctagaccaatttcctcagtatcagtttcgttgtgcaaaccatcttcagcagggctttagtgtcggacacgtgttttacatggacgacctgaaatgctattgcccagacagggaagtgttgacagcagttattcagcaggtgcagaagagcgcttctgccctcggtctgacgatccactacaagaaatctgcgtggctcgaccaggacggcgggaaaagtggcaaagccgtcttgggtgtaccagaacttgtcggcacttacaagtacctgggaatgcacgagagattcatgatt

SEQ ID NO: 63756 - DNA, 477 bp, Heterodera glycines
  Genomic contig location: Contig_ID=SeqID_7075; Location=1635..2111; Strand=+
  SCN-specific regions: Sequence locations=1-75,97-477
aaccaatcaagtcccctgttgatgtcacgctccacgcgcgccacaatgagttgctcgagtagggctactcgttcgggctctcgtttctgtgggagtggtggacctgcgccacgcttatacatttggtcgggaggcgttcttccgacacgcctcacctcccggttgaactccctcttcagctctacgtccatcacgacattcccgagttccatctcctcggctgcccatcccattgcccggcctaattgcggctttaccagttggacaagtgagagtgggtcaagcatcggttctggttcggattctgtgggtgggtgtgtcaacacatccgtaggtgcaggcctgtccacctctggaaccaaatcttgttccttacgtgaagaggtggatggaaccctgcgtttccgaggtggaaccacatcgcgaacggcgttgcgcagccgcttacgcgtgatcctctctgtcgcccctaagtcg

SEQ ID NO: 63757 - DNA, 1837 bp, Heterodera glycines
  Genomic contig location: Contig_ID=SeqID_7075; Location=2609..4445; Strand=+
  SCN-specific regions: Sequence locations=1-1044,1068-1109,1173 -1186,1216-1252,1280-1496,1529-1537,1581-1837
cgccttaccacggggggccgcgggattggttcggttttggccgcaccctccctctcggacctcatcaggggctggtatcccggcgtgggtcggcgtcttgtcactgcgggctctaaagagagccatttgggttaaggtttctctttccaaatcacaggatatcatttcgctttgatcgcttttcaaatgtattggttagaccgtatacaagtgatcttgcgccaccccagctccaagggtggcgcgccaagctagtaaggccagccccagctcaaagggtcgtaccccaagctagcaaggccggccccagctcaaggtggtaccccaagctagcaaggtaaaaaagagtggtgatcctccactcctgcgatcagcgagggaggagttgcacaggctccatcctgcgcgcagtgcaagactctggcttcaagaatccgcacgtgggagacacacgtgtggtcgcaaggtccttcatagccggagcttttacggccctttctcgtgccctgcttactagcatattactctatgctacctgttagcaagcaggttggtacactcggccatccgaaccccactagctcacagttctgaaaccagcaacgcagccttcgcctacgagggctagggctttcggtgcgtgtgggattacacgagactgtcatgttcctaaccagtgcgagccaacaccagaaaggggcctggacttaggttcaagttacagggtgaggctggagtctccatggccattccccttcgggctcgttatgacagcttcgacgtggtgcagcggggtaacacacggatgcccccgagctcactccgaagtgagtctgtccgtgccattcggcccgaccatttttaggtttcacgaaataccgccctgtaatctttcgccatatccgggaagaactgtcaagctcaacagaaatactggacccgcagctaagaaggcccagacgtttttggccgatgggaaggtaacccagcgccctcggattagcgcaacccgtgcagcacctagggactttcgcgacctgtaggccaactcctaccaggctccccggaggttccgagtatcgccacactcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacaaaacgtctgcgagttcatttgcgttaccgcgcaaaacatagggagagaaccgtcatttccctagcctggcgtgggaatgttaa

SEQ ID NO: 63758 - DNA, 749 bp, Heterodera glycines
  Genomic contig location: Contig_ID=SeqID_7075; Location=3697..4445; Strand=-
  SCN-specific regions: Sequence locations=1-257,301-309,342-558,586 -622,652-665,729-749
ttaacattcccacgccaggctagggaaatgacggttctctccctatgttttgcgcggtaacgcaaatgaactcgcagacgttttgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgtgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacga

SEQ ID NO: 63759 - DNA, 232 bp, Heterodera glycines
  Genomic contig location: Contig_ID=SeqID_33813; Location=3..234; Strand=-
  SCN-specific regions: Sequence locations=1-71,93-232
actttacgaggaaattgtgcaaaatgaattgagcacattcagcgaagacacaacacttaaattggaagagggaggaggagcagcacaaaacattgcatcatttggacaatcggacaaaagggaacagcacaaagacaaagaggacgaaaaacggacaaaaggcaacggaaaacgcaaagacaaattggtagggaaaagcaaggacaaatggaaaaaggcgttgattatttga

SEQ ID NO: 63760 - DNA, 622 bp, Heterodera glycines
  Genomic contig location: Contig_ID=SeqID_33819; Location=111..732; Strand=+
  SCN-specific regions: Sequence locations=1-387,432-622
atgaaagacgtgagagaagcgaccgatcggctgacagatcgaattgaacaagcacagaagaattacgcgtactttcaggtgggccaaggaaaagcgtttggtcaaatggtcaaataaacttttgccaatttgaaaatgccataggaatttcgtcgtcttatgttttggtctcgccaaatgtttgcgacaattaccggcgaattgctgccgcgcgaccccccggggtgcgaagcgctgttggcacggcacgcggagtacagacgcgagttggagacgaaggaggcggaaaaggcgaatttcgtgcggaaaggcattgaaatggtcgccgcgggaaattcgctgggggccgaaattcggacgcgactcgaaactttggaaaaaacattcacacatttggcacagacatggacaaaacggcaaaaggcaccacaaaatcaatgggaaaaccattgtgactaattggccatttgaggtgtacgaagagaattcggacgtacaaaaatggatggcaaatgccaacgaattggagcggtggctgtcagagagggagcaattccttcgcgacgattggcattcgggcgcgaccgcagaaaatgtcgaaggcgtcgaacttcggattcgg

SEQ ID NO: 63761 - DNA, 1876 bp, Heterodera glycines
  Genomic contig location: Contig_ID=SeqID_81; Location=69..1944; Strand=+
  SCN-specific regions: Sequence locations=1-276,299-498,520-1397,1419 -1716,1739-1876
atggtgtttggcagaaaattcactctgctcaccgatcacaaaccgctgctggccatctttggttccaagaagggcataccgatttatgccgcgagccgactgcaaagatgggccttaattttgtcaaattacgagttcgacatcaaatatgtcaacacagcagcatttggacaagccgacgtcctttcccggctaattgcaaattacccaaggccagaagaagacattttgattgcaaacatttgcacagaaacggaatgcttcatcaacagtgtattccaagtccaaattgatcaattgccattgacagcggctgagattgcggatgcaacagccaaagacgaaattctctcagaaatttcgagactgtcaaagaatggttggccaaacaaatgcaacgacccaaacatcgctccattctttccgaaacgagacgaaatcgtggaagtggaaggttgtttgctgtaccaacagcgcgtcatcatcccaggaattttacgggatcgagcattgaaggctttacatttgtcacatccaggaattgtgcgaatgaaagcgctcggacgccgtcacatttattggccaggattggattcggaaattgagaaaaccgtcaaatcctgtgaagaatgccaaaacgcacagaaaaatccgacaaaaagcacacttgctccatggacgccaacaagcaaagtcttcgaaagagttcacattgattttgctggtccatgcgacgacggatttatgtattttattatggtggactcctactcaaaatggcccgaagtctgccaaatgaagagcataaattctcaggccacggttggtttcctccgatcgatcatttacagactgggagtcccggaagaaattgtgtcagacaatggaacacaatttcattccgccgattttgccaaattttgcacagaattcggcatcaaacacactttcaccccgccataccatccacaatcgaacggacaggcagaaagattcgtcgacacgttcaagcgtgcaatgaagaagtcttcgaaaaacgacaaagattgggccgagaaagcgctcctttcttatcggacgactcccaacgcgacatcgaacggctactcacctgatcagttattctttggacggaagctccgtaccaaaatgtcgcttgttcacctgaggggagagccaattgagcatattgatcatgaactgatcagacaggcgaaaaaggaatatgcttcaaaaatgtctaatcaatttgacaagaagcacggagcaaaacgcactgattttggtccgggtgaccccgttttactcctcaattacaggaacaacaaatcccactggctgcagggcacaattttggaaagggttaaaaattccccaacttttcgagtcgaagtaccgatcttgggaggaagaattgtccaccggcacacaaatcagctgcgccgacgtttcatcttcgaagatgaacaaaaagtgatcggaatcaaccgattcacattgatcgtggacaaaatgatgagcaacagcaacaacccgagcagccagctgatgatgttccccaattggcagtgcgcagatcagaacggatcgtcaagccgcggcaattttactcgcccagcccgatcaagaagcgccgccgccactgatcaggagtgattagaatttaagaagggaggtgttagagatagtgaccattgacatttgtgatctctgaccctttgtttgtcccttcttccctcccccatttctgtctatttaatgttgactcccttccccacatttggacttccttcattcattctccaattttattgtggcataaagccaatcgatattcgcctctctccgtcaccaatttattattttattttcttca

SEQ ID NO: 63762 - DNA, 1428 bp, Heterodera glycines
  Genomic contig location: Contig_ID=SeqID_82; Location=39..1466; Strand=+
  SCN-specific regions: Sequence locations=1-377,411-435,457-793,816 -1428
atgtggggcgtggcaaatcgatggatggataatgaagcaggttagtgccatgccgtggatgaatgaatggccatgcaatgccaaaattgggcggggaaaggcgaatttgtggccaaattaaaatgtggggctgtggcaaaatcgatggatgataatgtgatcgctacagtgaggcagactagtgccattgtgttaaatgggaaataatctggctcttttatactccactcactcaaatttttgcgtcaaaggtactcactcggccgcttcgcggcctcgcactcttcttttggcattttcttatggcataacagttcttccttgtttcttgactttttcttacgcacaacatttttcttctatacaaatttttcaaacaaattctcattcattcatttaaaatttcattactatatacgttatattgacaaggagtttcgtttcaaaaactaatttgagcttaacggctaatgggacgggtctgaaagtagtggaagggtcttacaactttttgaggagaatccgggaaaactatagaaaaaaattcagcgcggacgactgagtcccggggaccgatttctcactttttcttgcgtttgacggcccataactttttttctgaaaatcggatcaaaaaattcccgctgtgagggccctaagtgaaaatgttgcctaaaagttaaaaaaaattctaggcctctagctctaaccccctgggctgggtgcttctagaacttttcagtaccaactttgtccagttcagtccccgttgaataactcattaggctttgacctgagcgcagggtggccagcagacttattgtagagctttaaaagcccgatttttccaaattttaaaatttcgaaaattttcaaaatttttcgagctaggcctaaaaatcggttttcgggtttttgaattttaggattttttaacgatttttcccagagaaacgaagaccacttccaaaacatagtttttcgagctctatcgattggtaatttttttggaaaaatttcgattttttcccggaaatagaaaaaatttttggcctcagcgggacatttgagtcctgggcccataactcgtcaggggttgattttagcgaaaaattgtcttagaacatttttgtagagcattttaaatgctatcgaatggtgtactacatgatgtaaaattttcggaaattttcgagctaggccccctagaaattttcggaaattttttttcggacgaaaatgggggtgaaaaatatttttctggggtaaaataaggtgctgagtacgaatatgatgtctattttaagtttcataatttttggaattttttaaaaattctttattttttggcaattttttggcccttggaaatttgggctaatattggaaaattcatatctagcctaagggttgactaattttgagcaa

SEQ ID NO: 63763 - DNA, 1110 bp, Heterodera glycines
  Genomic contig location: Contig_ID=SeqID_82; Location=1511..2620; Strand=-
  SCN-specific regions: Sequence locations=1-130,152-387,635-902,964 -985,1007-1110
atggtagcagcaacgagtcagagaagagaaaatagtaaggaaattgaagagaaaattttattttttttattcaaaacaatcagaagaggtacaacagtgattagaagaggtacaacagtgattaaaagaggtaaaaaagtgattagaagaggtacaacagtgattaaaagaggtacaaaagtgatcagaagaggtacaacagtgattaaaagaggtacaaaagtgatcagaagaggtacaacagtgattaaaagaggtacaaaagtgattaaaataggtacaacagtgattaaaagaggtacaaaagtgataaattaaacgcactgaaaaataacacaaaaataaatagaaaaatttaaaagtggtacaacagtgattagtaaattcattaaattaaaatgaaaatattttttaacaaatttaatttaaaaaatacatgaaattctatcaattaaaaaaataattaattatacttataaaatttatttatcaaaaaaaaaattttattaattgaatatttatttaatttgaaattaaattaattttttttcaaattcaaaaataaataatgaaattctttaatttaaaaaaaataaatttaaataatttaaaagaaatcttcaaattaattaaaaacagtcaaaataacccaaaaatgcatagaaaataatgtacaccgcccggattcgaacttcccccccccctcaaaatgatgtctcagaatccccaatcacacagggattctgaggtcttgactatgttaaaagtaaaatcttatcacgtattcgtgatcagcggcccaaataacccctaaagacatattttttgaagatttttggtgaaaaaatttttcaactcaaaaatcctatgctcacccctttggacccgaatcacaaaatcacttttatttttatatctttttttaaaaatgtgataaaaatgtaaaataaaatttatattatagagaaaaaaattgcggatttttgtagtattttacttttctcaaatagcttttcagaaggcagttacgaatttttttctgaaaaatctaaaatttccagaatttctggaataacttttttcatgttgatgttagaaaacctaaataaa

SEQ ID NO: 63764 - DNA, 1899 bp, Heterodera glycines
  Genomic contig location: Contig_ID=SeqID_82; Location=2907..4805; Strand=+
  SCN-specific regions: Sequence locations=1-67,115-133,156-172,198 -279,327-451,473-644,770-1000,1023-1041,1074-1657,1680-1899
atgttgtgcgaaattttggaacgcgacgaattgcaaatccgtgaagaaatttcaatgtggaatgcagtaaatttttttaaatttaaaaatgttacaaatttatttttaaaataagtccgaatctttttcggactattttataaaattattatattcaccagcctttccatatttacagttttcaactcttcctcaaattggcactgtttcggcccgtttcgaagcgctggtggacaaacattttgatgacaggacgattttttttataattccggcaagtttttttttttttttgtttttttctgttcttttttgtttttgtttttgggttatggtcccaaaagccttaacagccccaaattttcaaaattcttaataaaataaaaattttggaaattcaagaaaatttatttgtaaaagtgaatagttttttatgtgtttttttgaaggattttatgcgtaaaatatttaatggcctccaagtaggcaagttttattgttttttttttgtgtgtaaaaatgagaatgtttcaattttgtaaattatttttttaggatttttttccaaaaaacgaacttcaattttcagaatatcaaagtggtggacattctaccctttttgaccgtccatatcttaagagaacattttttcttaaaattaaaaatcttttttttggaaattttacatttttaatttaattttttggccctttttattcattaaaaaatctttttttttggaaattttacatttttaatttaattttttggccctttttattcaattaagcctaaaaatgcattttctatgaacaaatttacatatttaactaacattttttcaaaatttcagctgggtttgcatggtgtttggatggacattctccccttttgaccgtcctcaactcggcctcaaattggcattgctttctccccgtttcaatgctccagtggacaaacatttcaacggctgaaggcgtaagtttcagtttcaaattggccatgaaaatttttctaatctctacttttgtttggattcggtatttaaaaaatttaatttgaaaattttttttgagaaattttttcgatttatgacctcagaatccctgtgtgatttgtacctcttctaatcactgttgtacctcttctgatcactgttgtagctttttttcccattttttaaataactagagcgcaaaaaaaacctttttttcagcgacgaatatcgattatattttattattcattttctcagtatacattttgttattgattcccccccccccctcccttttgttaaataattaaaaacaccaaacttccaatgcttattaagtttttcctttgtatacaattttaatctatatttcaaacattttaaataattctctctttatttttttgttttttttcagctggttttttgcaacactttggatgggcatttctgaccatcttcaactcggcccaaattggcattgctttcgccccgtttcaatgctctggtggacaaacatttcaatggcaaagcggattgctggcaagtttcaatttttctcaaagtaaccggtcaaatgtttaataagctttaaaattgtgattgcattcggcagttcaaaaattgaaaaaaggaaaaaattttctttgttgaaaaaacttattttaaaaaatttatacttcaaccatatgaaatagccggtcaaatgttttctgagctcaaaatttttgattgcattcggcaattcataattgaaaacggaaaaaattttctttgttgaaaaaatcttaaaaattgtaattttcaagcctatgaaaatcaattattgtaactttttgaaaaaccaaattcgctcaacattgtgggcttatatcaattgcatcccgtaaataatttgtgaa

SEQ ID NO: 63765 - DNA, 857 bp, Heterodera glycines
  Genomic contig location: Contig_ID=SeqID_83; Location=29..885; Strand=+
  SCN-specific regions: Sequence locations=1-253,276-857
ctgggtttgccttgagtttggatggacattctccccttttgaccgtcctccactcggcctcaaattggcattgctttcgccccgtttcaatgctccagtggacaaacatttcaacggctgaaggcgtaagtttcagtttcaaattggccatgaaaatttttttgagaaattttttcgatttatgacctcagaatccctgtgtgatttgtacctcttctaatcactggtgtacctcttctgatcactgttgtagctttttccccattttttaaataactagagcgcaaaaaaaaacctttttcttcagcgacgaatatcgattatattttattattcatttctcagtataaattttgttattgattccccccctcccttttgttaaataattaaaaacaccaaactaccaatgcttattaagtttttcctttgtatacaattttaatctatatttcaaacattttagataattctctctttatttttttgttttatttcagctggttttttgcaacactttgtatgggcatttctgaccatcttcaactcggcccaaattggcattgctttcgccccgtttcaatgctctggtggacaaacatttcaatggcaaaccggattgctggcaagtttcaatttttctcaaagtaaccggtcaaatgtttaataagctctaaaattgtgattgcattcggcagttcaaaaattgaaaaaaggaaaaaattttctttgttgaaaaaatcttaaaaattgtaattttcaagcatatgaaaatcaattattgtaactttttgaaaaaccaaaatcgctcaacattgtgggcttataccaattccatcccgtaaataatttgtgaa

SEQ ID NO: 63766 - DNA, 810 bp, Heterodera glycines
  Genomic contig location: Contig_ID=SeqID_84; Location=678..1487; Strand=+
  SCN-specific regions: Sequence locations=1-810
atgccttcaaaacaaaagaatttgagaaagaagatgcaagatgtgtatcggcgacaggcagagcgatctgtcagtcgggataactcacccgtctcagacgggagtgcagatgggaatggagaggcatcggcgtctctccggggcaccagcaccccaagcttaagtgctttgcaaataagcacaccggcttcttccattggaagtaaaaagaggggaagacccttgagagccggagcgaagccaatcttggctactcaagaaagggtgtctctcattgacacacctcgaactgcggtcactcaaagtgaccagggttcgccgtgcaaaaaaaggggaaaggtcgccgagtgtggtcaacccatgtttgccaatgaagctattgctttgacgcctgtttcgactcaaagtcgtggagggcgtcctgccaaaaaaattagaggcccaggccgaggcagactcactgattccatgagcaaaagctctgaaatggatatcaatcttgaaaatgccccaattccggcaaccttgcacattgtgtctgaaaaaattgacttcagcactgtgccaattaatttcgccacatcgcgaaattttgcctgtaaaatttggagatgggcagcaattggcctttacgagcgtgatggcgaaacagcatttggcccacgctctggcccaagattcattgagacctgttggaacaggccaaatgaatggctaaatgacagctttattgttgcctatttagcttacattgcaagcatttcacaacgaaaaacagtagttggtggattctttggcatcgagaactga

SEQ ID NO: 63767 - DNA, 4876 bp, Heterodera glycines
  Genomic contig location: Contig_ID=SeqID_85; Location=1056..5931; Strand=+
  SCN-specific regions: Sequence locations=1-3,42-1776,1798-2828,2851 -2972,2998-3908,3930-4876
atgccttctaaacaacgcaatttgaaaaagaagaagcaagatgtgtatcggcgacaggcagagcgatctgtcagtcgggataactcacccgtctcagacgggagtgcagatgggaatggagaggcatcggcgtctctccggggcaccagcaccccaagcttaagtgctttgcaaataagcacaccggcttcttccattggaagtaaaaagaggggaagacccttgagagccggagcgaagccaatcttggctactcaagaaagggtgtctctcattgacacacctcgaactgcggtcactcaaagtgaccagggttcgccgtgcaaaaaaaggggaaaggtcgccgagtgtggccaacccatgtttgccaatgaagctattgctttgacgcctgtttcgactcaaagtcgtggagggcgtcctgccaaaaaaattagaggcccaggccgaggcagactcactgattccatgagcaaaagctctgaaatggatatcaatcttgaaaatgccccaattccggcaccctcgcacattgtgtctgaaaaaattgacttcagcactgtgccaattaatttcgccacatcgcgaaattttgcctgtaaaatttggagatgggcagcaattggcctttatgagcgtgatggcgaaacagcacttggcccacgctctggcccaagattcattgagacctgttggaacaggccaaatgaatggctaaatgacagctttattgttgcctatttagcttacattgcaagcatttcacaacgaaaaacagtagttgtggattctttggcatcgagaactgatgtttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggactgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggacatagtgccaattgaagtggatgattcagcagtacttccttcctcggaagatactgctgttcttgcgcaagcaccagtgatcggcgaaaatcaagctgacacccacggtgttgttgcggacacaattgtccagcaagaaccaatcgcgcaggctgatgatgtaatctttgtcagacctaagacgccaccaaggcgatcactgcgcgtgcaaaaaaggctttcagcttctgttagccgttcgccttcaccggcgccaaaacgacccccgccagcaaattcgctgggaatggcaatgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaaaatcaggaagagcttcgtttcttccgcatgactttgttggatagccgcagggctccagctggtcttaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcttaatatacgacaactcacatgtcgtgccgtataatccttatattctgctacgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggatattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggacacccagaccatcttaagatggttaatgggttactttgtacctcattcactgaggctgcaataatgcatggtcttcttgaagacgacaaaatttgggacaaaactctggcggaggcagctctgtcgcgctggccagatcagatgagatggctctttgtgagcatcctggtctatggccagccgagtaatgccatagaattgtggaacaagtacaaagaccaaatgtacaatccacagggcattatcagtgcggctatacgccaagcacgggagcaggaagcgctagccgacattgattggcgattgcacttctttaactcaagctgcatgcactgtggcctcccagatccaccaaattcaaaagccaaaaatatcaatttggcagttgaagaagctttctttggtgatgatgatcttaatatgccgcctggccagccaaatcctaggcagcagcaaaacgctccacctccactcaacagcgaccagcaaaaggtctttgatgctgttgtgagggctattcaatcggatccgaaggatccgactgtgccacgccgtttctttattttcggcgatggag

SEQ ID NO: 63768 - DNA, 1343 bp, Heterodera glycines
  Genomic contig location: Contig_ID=SeqID_909; Location=66..1408; Strand=+
  SCN-specific regions: Sequence locations=1-18,48-58,80-127,149 -578,635-681,768-794,823-871,894-968,990-1052,1077-1294,1316-1343
gcccagcagcatcacattgacacgcgacggcaccaacagacgcaagacggtggcaacgacaacgacgaggaggggaaggaggacggagtggtgaccaacaaacggtcaaaagtggtgagtatttgtaccatttataatagatttttctccgaaaaatcgctaatttgtggatttttggagaaaagttagcgaatttttgtttggaaaactgtaccaggggaagatttcatcccaccacccatcgagaaaaattgttgaaaaaaattcatttttattcaaatctccgaattacaaccccccccccccccccctcgttcgtcgtaaggggggcggctgtaaaggagggtggggtcgtaacgcaaaaaaaaaggtcgtcgccgggcaaaattgggggccttcgtacgaaaaattggtcctggcgcacaatcgtccgcgtatgggcctcgccctggcgcaccccttgttcatgtatgcccccgaaacaaaaaaaaaatttgagttcccattttattggatttttttttaatttttggttttggcttgggagtggattgtggcgacatgaaatgaatttgtccacaaaaattgggggcattttttccattttcaacaatttggcaattatttccctcccttccccagtcggtgacacttgacgagacggaagaaatttcggtgctcgacgaagaggagggcaaggaggaggaggcagaggagggcgaactaactgatgaggaggaagaggagaaggatgaaaacgatgcggacgtgctgtttgtggacgcacgaagtcggacaacgaagaagaaaaagaagggcaaaagcggcggcgccaatgtgtcgctggaggagggcgaaattgtggacgaatcggaggaggaacagcagcagcaaatggtcgttaccaaaaaattttaaatcaaaaaagaggaaaacctgaaaaaatttggctattatctaacaataagcaaaggcattaagaatttttaaattttgcccgtcggcgccttatgcaccaacggccccaaaaattctcctaaaattttgaagacgaaaaggggcggggaggggaaggggccttcgtaatcgagggcaggcaggatttaatttaaaaaaagctcgtcggttacatggcttggacccaccctccgctttttgggatccggttcccgaccctcggagttgtaaagccgcggaacccgactaaaaaaaaatcggttatccggggcacaaatggaccggggggcatcagtcatcggagggttgacaaatgcgtttaattgctgcatccaaaaaacaaaatttggtttcatcaaactctgaaaattcaaagttgttgccga

SEQ ID NO: 63769 - DNA, 914 bp, Heterodera glycines
  Genomic contig location: Contig_ID=SeqID_910; Location=59..972; Strand=-
  SCN-specific regions: Sequence locations=1-264,286-346,375-654,690 -793,815-914
atggcaaattcggtcaaaatgcgggattcggatgagaaaaaaccgggatttaggagggcaggggacgaggaggagttgggattttggagtaaggaagcgcagggaaggcacacgccgtaaaataaagggaatttttgaggtcgcgaaaataatctgaaggttttccccttttcaaggcaagaaaatcaccgtcagagcccaaattgcgccggacgatcaagttgaggacatggttgtgcgtggaaatatcgacgatgtcatgagggtaaatttcaaatttatttctgaaaaaaatttgcaacacaaaaaaattgtttaaagtcgcctattttttagggtccccctgaaaaaaaaatttttttttttgaatttaacaaatgagatgcagaaaattttatggtttttctctaaagtgacaaattcttcggcatcagtgtaaaatgctgcaaaacattttttcagagtattttgaagttaaatttccttgctcatttccgatggctcaccaccgtgaaaaatcgttatcggtcaacttttttttttagtttttgcccacaactttttagaaacctaataaatttaagaaatttttcaatctaacaaagccaattctgacaaatatgaatggagtttagccttgaaactggggaatggaaaatttcttttaaaaatttttcaaaaaaaaaattggcgtaattttgtcccggcgaaatttttcggagcacccggggcgagaatggggtgggactcattgaaaaatatcgaaaaagtttagaaaaaaatagttagacttttatttactattacagatgcacatccgattcgcgtttcagtctgtcaaacgtgcatatgagggaaacggattgggacaattttttgttcacaacaaagtaattgtctcaattccgccactg

SEQ ID NO: 63770 - DNA, 1015 bp, Heterodera glycines
  Genomic contig location: Contig_ID=SeqID_910; Location=4625..5639; Strand=-
  SCN-specific regions: Sequence locations=1-1015
  Gene Ontology: Mol. function=glycoprotein 3-alpha-L -fucosyltransferase activity; Cellular component=Golgi trans cisterna; Biological process=protein amino acid glycosylation
atgacgctgaagaagcggtcggccgtccaatttgtgtccaattgcaatgtgccgtcgggaagagatgcgctgacggcacaactccaaagactgctccaagttgatgtgtttgggaaatgcaataacaacacaaactgtaaagaagaatgctaccaaagagaacaaggtaggaatctgggaatatttggcattcatttgtcaatgtcagcgactttggcactatttttgtcgaaaatttggtattagatggtctcaataatggtgggcattgatcagttacagattcgagagctcaagagagtctcggacacgactcaagaaaagtctcggctatttttcggtctcgcatttttgatcacgatcgattttccattttcgagaccgaaaccgctatttttttacaaccctagtgcgacatttgcagaccgactttttctcatagcctaccgttgacacttccatttcctgtgccgactggaatttatttttacccggaagtcattgcgcaatcttatcaattgccacccccccccccctcattttcagagtcccactttttctactttgctttcgagaatgccgtctgcccaaattatgtgacggagaaattttggaaggcattgcgcaatttgatagtgccaattgtgttgagtagaaaagtgatggaagaagttggcattccgaatggcactttcattgcggcggacgactttaacagtgtgaaagcattggcggaatatttgaaggaattgcaaagggacaaagacaaatacatgaggtaattaattagtatgagattagggaaattgattgtccaataagggaaataattaatgattgtaagtgagggtaatttaatgagagtaattaatgccaaaagggggtaattagagggaaataattatcgtgcaggtaattaatgccaaaagggtaattgagagaaacaattattgtaaatgagggtaattaatgtcaaaagggtaattagagggaatataattgtatttttaataaa

SEQ ID NO: 63771 - DNA, 309 bp, Heterodera glycines
  Genomic contig location: Contig_ID=SeqID_910; Location=7435..7743; Strand=-
  SCN-specific regions: Sequence locations=1-309
gttgcgatccgattcgcgtttgatgctgtcaaacggacatatgagagaagaaatttgggaaatttctttgttcaacacaaagtaattgtctccattccgccaacccagacccgcagaacgggcccttcggcatctgccgccgctgcccttgcgattctctcctgcgccgccgccagggcaaatatgacgaagatggcttttccgttagaaaagctgaatcagtttaagaagctcgatcgctggattcgaaaccagttaagccgaaagactttggccgatgtcgatgatttgttctcgttgttgatttag

SEQ ID NO: 63772 - DNA, 2140 bp, Heterodera glycines
  Genomic contig location: Contig_ID=SeqID_7076; Location=1..2140; Strand=-
  SCN-specific regions: Sequence locations=1-337,367-851,874-972,994 -1526,1550-1642,1665-2140
  Gene Ontology: Mol. function=DNA supercoiling activity; Cellular component=nucleus; Biological process=dorsal appendage formation
cagccctgatatttaatatgcctaatatttttgggtgttaaaaactaaaaactgccaaaatatttaggttttcggttctaaaaacctcaaaataggtgttaaagtttcaatttaggggtataaaataacaaaatttttgaggaaatttttcattctcaggggtgtatttttgaaaattagacgaaatttatgtaaattaatctttatattcgggttcggggtccaaaatgggtgccggattcgctgcaaaagtgctggacacattaaggctgctaaatttcccgacacgaggaccaagactgagaatcccgagcagaattactggacatttgcaatgttaaatttatttcaaaaaatttttattttcgaatatacttttaattaaccacaacttttaaaaaaccaggtatatttaggctgcggtaggctgcgtagtaaaagaatttttacttttttttctaaattagttattgattttaaaaaatttgagtccaaaaatatttgagacggaaccggccctttgagtactaagacggaactggcgagacggaactggccagacggaactgacccctactgttaggctaggcctaggctttagtatatgagcacacgacaataaatcaataattaaaaattgatcgatcattcaaacaattcactgcttctgatcacttgggccgatctttgcattacgaaactggaatgtcgattctgttccattgatcataaaattgccagtcaatcgcttccttctcacattttgtccatttgctttcgtcgcgcacaattggacaacggatcagaaggaaatggccaatattgttcatccgcttcaacgtcaattcacagtttcatcgaccaaaatgtcatcgcttttctccaccgttttcatcgtcttttcgatgtctgtccaattaattttgccatcggtacgggcagtgaccgccttttggagttcattttgcgcaacatttggccaatgcttggaaaaaatatttgtgccatggattgtcctccagaattttccgccgtttgtgacaatttgtcccgtcacttctcagcgattgtccatcacttcgcgttgtcttttaccactctaacaattgcatcatcgaatgtcatttatatgataatcagtatttccttttacttcctgagcaaagtcagcataccggacctctaaaatccttaataaacattcttaaagccaaaaaaaaaaaatttgctaacttaaaaatttttcaagaaaaaaatcttaaagttttctcataagaaaattctaagaaaaaaaatattttttcagaaattttatggtgaattaccaagttttttcaaaaaattttccaaaaaattgctgaaaatttctgaaaaaatttttttcttagaattttcttatgaaaaaactttctaagatttttttcttgaaaaatttctaagttagcaattttttttttaaaattttctcgggggggaaacgatgcgggggggaaacgagctgctccccaccgccggacccctgttccacaaaaagttttttggaaaaaccgccgcaaaaaaaaactggtgtgaaaaccaacaacaaaaaaaagaggaaaaaggtcgtcgcccggggggaggtaccccaccccccaagccgaaatcctgggaccgtccctgccccctttgcgcatgtatggcgaaggccttttcaaatatttgaattgttaaaatgcgtttggatttaatttggtcccctttttctgcagcgtcaaagtccccaagctgccccggccattaaccgttgtatcatcgtgtgtccgagcagtttggtgaagaattgggacaaggaaattgccaaatggctccacggccgagtcaattctttgccaattgactcgggcaaacgcgaggacattatacgcaatttaagtacgactttttgggcggcagaagcaattgcgaattcaattgacagaacaatttgtcagtcagacgggccaaagagtgccgacgccggtgattatcatttcgtatgagacattccgactttacacggacattttgcacgagaaggaaattggcttggtgatttgtgatgaggtgggagtgatttgggaggcggagattggcacactttgccaacacttttcccctgaat

SEQ ID NO: 63773 - DNA, 310 bp, Heterodera glycines
  Genomic contig location: Contig_ID=SeqID_7077; Location=167..476; Strand=+
  SCN-specific regions: Sequence locations=1-310
aaaggtctctgtcacaacccggcactctctgacttaatctgtggagtcaatgaaagcatcgacagacaggtggacgctgcccgatctgctcgccatttcattcacaagcgacacaaacgatacatcctccaggatgctgtcattatgagaattttggcggacgcgtcatacaacaacaagggtgaaattcgtgatctgatgacggcgctcggtctacaaattgaaggatatgcagcaaaattgaaagatttcgtgaattttgatgattcgattgttcgtattccgtgatgaattttttattgaatgttta

SEQ ID NO: 63774 - DNA, 834 bp, Heterodera glycines
  Genomic contig location: Contig_ID=SeqID_33822; Location=5..838; Strand=-
  SCN-specific regions: Sequence locations=1-834
tctgttcggagtgccaatgtttgtcggcggttgtgccattctttggatttattgggaccgtttcaaaaagccaaaaaagaaaatgtaaaaataaaaataaccctttcaaaaatttgattaatttaatttttcagtttcatctccgccgactgttggctttgtgtcttcgatttgcttgagccgtcacaacttggccttggcatttcaatgatcagccaccgttttgacttttacgtcgacgaacacttcaaaacgcgcaaatggacattgggacttattcgaatttggagcaaaattggagagaatggcacgaagaaaatgaaaattgtcaataaatattggacaccattgccaattccgcaaattgaaatgccacgcaaagtcaccggattcgaacgcatcgatatcaagtaaaattggtcaattatgaagaaacaatttaggctcaattcatgttatttttagttacatcgaccaaaatgccatcgcttttctccgccgttttcgtccacttttcgccgcctgtcaaatcaatttgtccatcagtatgagaagtgatcgcatctcggaactcattttgcgcaacatttggccaatgctcgggaaaaacatccatgacattgaaatgtccgcctcatttttccatcttttgcgacaaatggcgccatcaattcttagcgattgtccatcacttcgttttgtcattttttatgccggtgatctcttcgccgaattcccatgcgatgacggtgccgcggcatcggatggacaatcggtggccaaatggcttttcactccacttcaaaacaacgtgccaaaagtgctcaactgctg

SEQ ID NO: 63775 - DNA, 323 bp, Heterodera glycines
  Genomic contig location: Contig_ID=SeqID_33824; Location=357..679; Strand=+
  SCN-specific regions: Sequence locations=1-323
ctgtctgtgctgcgaaaagttgcaggaaaatgtcatctgagtcaaatatggagaatttccccgtcaaattggacatggattatatcaaacggttggcacgcatcgaacggaccggccctaacacttttaggtttctttgatgaaaagggtttcgaaagaattcatttttagtgccaattttcttgtggcaggctatcgtaaggcggtgaatagggacgttttcgggggacaaatgttcgcgcaggcaattgccgcggcagaagcaacggtggacggcgacgaatttgcaccgaacgcggcccattcgatgttcattagaaaag

SEQ ID NO: 63776 - DNA, 870 bp, Heterodera glycines
  Genomic contig location: Contig_ID=SeqID_33825; Location=60..929; Strand=-
  SCN-specific regions: Sequence locations=1-57,79-394,416-732,774-870
atgacattctatgcttctcttgttggatacacgggaagaaataatagttagtccttttgttgaatttttagaaattttatccgtcaaatcggcttctggaattttaatgagtaaatcaggaaccgtaaatgaaattctctgcttctcttgttggatacacgggaagaaataattgttagtccttttgttgaatttttagaaattctatccgtcaaatcggcttttggaattttaatgagtaaatcagtaaccgtaaatgacattctatgcttctcttgttggatacacgggaagaaataatagttagtccttttgttgaatttttagaaattctatccgtcaaatcggcttttggaattttaatgagtaaatcagtaaccgtatagatgaaattgtatcattgtgattcatggatccaccgtaagatatgaacaattaatcctctgattgaattctaagcaaatgtatcggtcatgtgatgtatcgaaacagcaatgattaaatcgcggcacgcggcacggtctctcgaaggaatggatttaattaaattctctccttcggggatttttttccattaggtcgtccgttagcgttcgattgctatagtcaatttttcaaaatttttgttgaaatatttgtcgtgctctgaagggcgggggggaaggcccgccacgaggccgcgaagcggccgagtgagtaccttcggtgcaggaaaattattaaggaagagagttcattatttatttgttttttgcataattaattcataaatatttttttcagaacagggttctgaaacgcaccaaattttatttacatgttagtttaggcactctgatgctttttctatcaaaaagggagatgaataaa

SEQ ID NO: 63777 - DNA, 70 bp, Heterodera glycines
  Genomic contig location: Contig_ID=SeqID_33825; Location=331..400; Strand=+
  SCN-specific regions: Sequence locations=1-70
aatcgaacgctaacggacgacctaatggaaaaaaatccccgaaggagagaatttaattaaatccattcct

SEQ ID NO: 63778 - DNA, 428 bp, Heterodera glycines
  Genomic contig location: Contig_ID=SeqID_33825; Location=1014..1441; Strand=-
  SCN-specific regions: Sequence locations=1-185,207-428
atgacattctatgcttctcttgttggatacacgggaagaaataatagttagtccttttgttgaatttttagaaattctatccgtcaaatcggcttttggaattttaatgagtaaatcagtaaccgtaaatgacattctatgcttctcttgttggatacacgggaagaaataatagttagtccttttgttgaatttttagaaattttatccgtcaaatcggcttttggaattttaatgagtaaatcagtaaccgtaaatgacattctatgcttctcttgttggatacacgggaagaaataatagttagtccttttgttgaatttttagaaattctatccgtcgaatcggcttttggaattttaatgagtaaatcaggaaccgtaaataacattctatgcttctcttgttggatacacgggaagaaataa

SEQ ID NO: 63779 - DNA, 291 bp, Heterodera glycines
  Genomic contig location: Contig_ID=SeqID_33828; Location=444..734; Strand=-
  SCN-specific regions: Sequence locations=1-77,124-241,266-291
atgttgagcttcatttacattgaagatttgagcgaattgaatggagacaacgcaatggcagtgctttacgcgggtggatttattttttaattaattaattaattattttgttatttagccaataagtacaacattcctggccttgacggcccatctttacaaatttccttctccaaattgcgcaatgttttcttggcttacgcccaggccaatattttcgatttgaaggtggaatttaaaaatgatttatctccatactggtttggcgtaattttgttgattttgatataa

SEQ ID NO: 63780 - DNA, 491 bp, Heterodera glycines
  Genomic contig location: Contig_ID=SeqID_33831; Location=432..922; Strand=+
  SCN-specific regions: Sequence locations=1-100,141-376,398-416,438-491
cttatgaggaatggcttccactagtgttgggccgggaacgatggcttcgaagcggactcagccaagagaaaggccaacaaaagggtgggcggggagagggtaattaaaaaattaattaattaattttaaaatttaattttgaattcactgtttctgctggcgccaataagagactctcgaaaattggacataaagaaatttaaaattaattataccaaagagcagagagtaattaaaaagtaccaagtgccataattagtaattttgctatttaattgaatgaatattaattatttcatttggcaccggcaaatggctgagtattaaataaatccttgttaatccactcaatctctccaaacatttccatttggtatccaaaatcctccccaaaaaaggatgggcttatgagagaataaatttaagaaaatttaaatctttcagcagatgccgacaatgactacgacttgaatttggacggcacacactga

SEQ ID NO: 63781 - DNA, 114 bp, Heterodera glycines
  Genomic contig location: Contig_ID=SeqID_7078; Location=25..138; Strand=-
  SCN-specific regions: Sequence locations=1-114
atgcgacggttcagggagtgtgaaagtttggaggtgctgatcgtctacgccgcaacgcttggctacgaagcggatcggtatcgcatttggacatcggatatgccccggaaagag

SEQ ID NO: 63782 - DNA, 508 bp, Heterodera glycines
  Genomic contig location: Contig_ID=SeqID_7080; Location=1215..1722; Strand=+
  SCN-specific regions: Sequence locations=1-326,348-479,501-508
atggaatatcttgaggaaactttgtatcagtactcgttagaacccacagtaaacgactggtggggtaagttagatatagtttgcaggatttgctatttaattatttagaaatgttttttgaaaatgttgtagctgccagaaggcgtgcaaccattaaaaagtttccggctgaaagtgcggcagaagacgataaatggatgaacgaagccgacatgtttatcgcggcaaaaatgtttaaaattaatgtcatattttataagctcagcgacaacccagatcatatttggcaaatttttacgccaggcatgcaaaaaagcgtaagaatttttagaattttgttaattaaacaatttttggacggttttaagcttttaaatccggagcaagaccgtgaagtaccatctatctttatttataatgaaagtggtcgttttgaaatcattcttgaacccgagcgtttgtctcagaaatctatgacgaattaacatttaaaaattagcggaattta

SEQ ID NO: 63783 - DNA, 146 bp, Heterodera glycines
  Genomic contig location: Contig_ID=SeqID_7080; Location=129..274; Strand=-
  SCN-specific regions: Sequence locations=1-114,136-146
taaaattgccgaatacggtatcggctcaaaatcgcacaaaaacacttttataggttttcttaggtgctgagaacgatataaaagcttaaaattgggcgcggaaaagcatttaaaccggtttttgaaccggtttaaaactcgaaaat

SEQ ID NO: 63784 - DNA, 636 bp, Heterodera glycines
  Genomic contig location: Contig_ID=SeqID_7080; Location=1841..2476; Strand=-
  SCN-specific regions: Sequence locations=1-163,189-341,370-636
atgcaaatatggtatcattggaaagcccataaaaaatgctatccaatggtatgctacttatctgttgaaattggaaaatgacaattttatacgcaattatttttttcaaagcatgatgggacaacacttatgaccatgactgtattagggaaaaaaggattggacagagcagcagcaggagagaggagcgaattcagatgccataattcatgatgcttctcgaaaagggatgtcgtgagttacgaaacggagcagcttttttccgaccccaaatccgaaacggcattccgactaatgcctgtgtgccaacatgtcaaattccttcataaactaacacaccttatatttgttttttatttcttgtaatgaattgttagaaaataattttaagatttaaattagggggcaattaaatttttttgtaaaaattctaatggccaattttagaacaacgaacaaatgattgaaaggaaattgaaagggagcgaaagagatattatgtgtctcttttcaaaatgctctttgaaggttagagacatgagaatagcgtggtgagccgaagtgacaaaaatatcagtgagagactttcagaagagggatggggtcatttcagtacagaaaattatattaaataaa

SEQ ID NO: 63785 - DNA, 738 bp, Heterodera glycines
  Genomic contig location: Contig_ID=SeqID_33837; Location=277..1014; Strand=-
  SCN-specific regions: Sequence locations=1-640,662-717
atgttctctaccggcaaagggaggtaaaactttgcggtaatataccgtatttactgaattagaaccacccgggggctctatttttcaataatataccgtatttactgaattagaaccacccgggggctctatttttctaccccccccccctccctcgacctccagggaggatgagaggagctggctatattttagggacgagggtctaattcagggtgaaaggtctatttctgtaagtacggtatgtttaaaaatggccaataacccgcgccggtgcgttaccgtgccgagctaggcggcaccggatttcgtctggaaactgtatatatctaaaagtattgtttaaggtgcggtatgtggtccggcggtcactcgatggtattacgactctacacaacggtagagagttgcagaaaaaacatgaataaaatgattttacttatggatttgcaaaatgcatcttatactatcactgtttcgagatttcgaataagtgtgtaaacttggggacccgtgcccggtttttttgaattgtcgggtttttattgggtttgcctgaattattattttcacttaatagacataagatttgatataaaaatccataaaattgacaattgttggtgactcatcagaaataggaacaaaatttacaatttggttccggcatcgcctatcggcaccgccgatcctctcgtgtttttttttgtttttttaaaacatacagtaaaaaataaa

SEQ ID NO: 63786 - DNA, 152 bp, Heterodera glycines
  Genomic contig location: Contig_ID=SeqID_33838; Location=371..522; Strand=+
  SCN-specific regions: Sequence locations=1-152
tcggcaattacattgtccaaaaatgtgtgccggaccagccaggggccagaaactattgcaaagacttcaacaacatttgccaaatgggctttttcggcatgccaattcattgctcatcttgtaagggtgatctgtgcaacgaagcgcgtaat

SEQ ID NO: 63787 - DNA, 668 bp, Heterodera glycines
  Genomic contig location: Contig_ID=SeqID_33841; Location=282..949; Strand=-
  SCN-specific regions: Sequence locations=1-2,152-400,422-668
atggaaagattaaaagaaggaattgaggaagaagagaaaatgaacggaaaaattcaaagaaaacagaatcaaagaaatggcgaaggaacagcgaaaggaggggaaacagaagaaatggtaaaggggggaagggaaaagagaagggacggaacttcagacggacgagcagtggcgagagttgcgcgaatggagtgcccgcagagtcagcgacgatggcggcgcgacaaagaaaaggggcgccgatgaatggccggaggaaggcgggagacacttcgaaggtgagaggggaagggggacaaacggaggggacggacggacgagggatggcattctcaaatttatttgattttgggcatttttcaatttatcctataaaatttatatgaaagaggggaggacctcttttattggaggaaagaatgaggaagggtttatggaacagtgatggccaggggacatcgtgctaagtgcggaccaagcggacgcccttctcgaggaaacatttgcacgacgacggagggccaaaaggaaattcattgggtcgaaggtgggcaatggaaagacgacaatcaattaaaaacatttaaaaaaacgaaaaaccctcaaaattacagctgaccaattgcagacgattggtttacttttgtcattttccatatgggcattaa

SEQ ID NO: 63788 - DNA, 388 bp, Heterodera glycines
  Genomic contig location: Contig_ID=SeqID_7081; Location=96..483; Strand=+
  SCN-specific regions: Sequence locations=1-9,31-33,57-249,315-388
gaattcagaatacacagaggaaaagctgctgttcatgaaaagggtggaggaaataattttggacaccgcgtcaccgcccaattcgacaaaacggcgacagtttgtggaggaggcggtggaccatctgaggacgcaattgggacacggtcccccacccgcggaccccgaatggacttttctgacatcgatgtaggcacatcgatagccatatggccggtgctaggtcgaaccgaaaatggtctcagtgtgaataaaaatatttaaatttaattatacgattcactaaattcatataattatataaaaaaataatagcgtgtgaatcaataattcctaatacgtataattgaatgaatttgatgcatttgcttgttcaaaattatttaaa

SEQ ID NO: 63789 - DNA, 1105 bp, Heterodera glycines
  Genomic contig location: Contig_ID=SeqID_7083; Location=23..1127; Strand=+
  SCN-specific regions: Sequence locations=1-115,147-283,305-324,347 -405,427-613,642-932,954-1061,1100-1105
atgatgctgcccggctggacgctgttgttggtggcatattgcgtgtgtttggcacttggcattgttggcacaatgggggcaagcgcggaactgataccaagcaaaatgttcaatcacaacaacaaccacaacttcaacaacaacaatgaccagaagcaattaggggctaatgattttgcggaaaaccctcagcgacaggcgggcaacaacggaggcgacaacaacaacttgttgctggcccaaccgtcggcattccaacttcaaaaacaaatgatgatgagggcggcaatggcagcagcagccaaagtggcacaacagaaacaacggcagcaccaccaccaccacatgccgcaccataatcatcatcaccaccagcagaacaatgtggatggaagcagcaaatttggggtggtggagcaggaggagaaaagtggtgaggaattttttatgtttaatacagggatgcgatctgttctgatttatcagaaatgttctgatttgaagggtccaaatctgataaaataaaaatgttctgattttggggtagcgaccaaaatttgttctgatttcttaaacaaactcataattttaaaattttatggcctaatgtcactattttacaaaaaaaatataaaatttatggcaaaatttggtcattttttggacaaaaatctgttaacaaatcgtactaaaatcacaaatttttcccggcggcacctatcggcgccgccggatcccctgtcctccaaaatttttgggagaagggccccgcaaaaaaagcgtttttaaaagcgaaaaaaaagtcgtcgcttggtttttaattgcaaaattggcattttttggtgaaaatctgttaacaaatcagaacgaaattacaaaaaattttccggcggcgcctatcggcaccgccggaccctccccctcgcccatttcccaaaagttttttgggaaaatgcgccgcaaaaaattcttaaaaatctgattttttgatcccgagtgcactgaaatttacgatttgttaatttcctcaccaaaatttttaaagatgataattggaggcgaaaaatataatatttaatgatttttgattaaattaattgtaaaa

SEQ ID NO: 63790 - DNA, 674 bp, Heterodera glycines
  Genomic contig location: Contig_ID=SeqID_33842; Location=1..674; Strand=+
  SCN-specific regions: Sequence locations=1-298,320-674
ttgccaacgaaagtgaggacagatcgtgcgatgcgcgaagtcccacggagcgcctttgcctggccaaccaaacggcggtgctcggcggctttcaccatttgacgcacgactgccattgcgtgcagccgtgcaccggtacggtacatgccacagtaggcgatgccttaggcaacccaagcgtcttactgtaggcaagaaaaaaagatatgcaaaccgtacccagaaaattaacaaacgaattacccatttgggatgtactgttgccccgttcagagcatgtcttcgagacggcgtattccgcggccgcgtggcccgcgtcgaattttaacattggcggcgacgattgtgccattgttttgggcgcgaattttacgagagaaaattgcaccaaagtcaaaaaaaggggagagaaagggaatcaattggcattccgttcagtatttcgccaaaaacacggcactcatcgagatttactatgaacaacttaactatgagaaactgaaggaaacgccgggctatacggtaactaagggaatcaaaagggtacggtaacgaggggcttttcctgtttaagttggtcaatttgttctccgacttgggcggcaacattggcctgtggatcggcttctctctgatcactgtgatggaagtggtcgagctgatcttcgagtgtt

SEQ ID NO: 63791 - DNA, 359 bp, Heterodera glycines
  Genomic contig location: Contig_ID=SeqID_33845; Location=1..359; Strand=+
  SCN-specific regions: Sequence locations=1-118,140-198,235-359
ttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacatttttcgatttttgggttggggcccaaacgaccccggggcccaaaaacgggggcccaaacgaccccggggcccaaaaacgggggcccaaacgcgggggcccaaaaacgggggcccaaacgctctggtccc

SEQ ID NO: 63792 - DNA, 446 bp, Heterodera glycines
  Genomic contig location: Contig_ID=SeqID_33846; Location=4..449; Strand=-
  SCN-specific regions: Sequence locations=1-145,195-248,270-328,351-446
  Gene Ontology: Mol. function=transcription factor activity; Biological process=regulation of transcription, DNA-dependent
atgagcctgctccagctgaagcacaaagagttggacctgaacgtcaagaacaaggccggcttcaccccgttgcatcagttcgtgatgcgtgaagatcttggtaagaacgcacggaatttatgaggtttctttaaaattggcattcaaaaaaaaagttttttttttctaaaaattttcaatttttaacaatttttgagctaaaaattaaaaagacaatcatttgccattatcctcatccacttccagggatggtgatgtgtctgctctcctacggtgccggcctcggcgagaaagcggacagtggcaaaatgacggcactgcattttgcggtgtccaagtgcaacctgcaggtcacacgcttgctgctctgcctgggcgccgacccgaacgtgaccaatgcgcacggggactcgccacggcatttggccgccaaattgaaagagtaa

SEQ ID NO: 63793 - DNA, 492 bp, Heterodera glycines
  Genomic contig location: Contig_ID=SeqID_33848; Location=440..931; Strand=+
  SCN-specific regions: Sequence locations=1-130,161-385,410-492
atgcggtgagtaattgcggaaatacctgaataattcggctaatttgcccaacatataatttttcttttcagttctgccttgaaatcaatcagagctcgtttaatgcctcgaatggataatgagtgagttgaatttttattttcaatttataaaaatataaggaagggattaagcgcattcggataagaataatctgatttgacataggattttccgaaatgcgatgttcaacttccgttcggggatgatgatggccatggaaagtatacaacagtacagcaataactcaaaacaaaaagatgctaattctgaagtcgacaattctgttcaaagcttaaccactacaaaacaatgattgataatttgacactgtcaccataaaatattgtattatattgcaataattaatcctgttaagactattttaatcaaattttctttctttttttaaatttttttttgcataatttccataacaaaagacaatgcaaa

SEQ ID NO: 63794 - DNA, 750 bp, Heterodera glycines
  Genomic contig location: Contig_ID=SeqID_33849; Location=204..953; Strand=+
  SCN-specific regions: Sequence locations=1-93,331-511,533-556,579 -695,723-750
atgacttggtacggcgtcatattttgtgtggttccgttgaatatcagttccatttcaattgcacctcttttgttttttactaggtaaaatcgcataaaaataaattttaatatttggaatttaattattcttataatgaaaaataatttttttttttttttgaattaaaagaaataattaattagttaaaaattgatgatagacagaaatgttgttaataatttttctttaaacaataattagttttaaattaaaataatcaactaaaaaaattaaaaggccttatcaatttatttaattactttattttattaattataatattaaaatgccaatttttagcactgaatatcacaatgcttttacaaaagaatgggcacgattacgtgctttgttcgtcgggcttcaaccgtcaaacacaatttttgcaacaactgtacaacctttgcagccgatgataatgaaaatgaacaatcaaaatcaatcgccaactcggattgacaattttttaccaaataattaaaaatcatttagcataaatagggctaaatgtatgataatatatataattatattttgtaatcattaatgaaatgaaacatataaatatacaatttcttctttaaatacttcagacttgatgagattttctaaatgtgttgatgagttattttaaaaagcgataagacgaaaatatcatatttatttatttataacaatttgtggtttttcaataattggtttaagcca

SEQ ID NO: 63795 - DNA, 464 bp, Heterodera glycines
  Genomic contig location: Contig_ID=SeqID_33850; Location=341..804; Strand=-
  SCN-specific regions: Sequence locations=1-44,67-314,353-464
atggatgacattggaacaggaaatttagcatatgatgaagtgagtttttcaaattattgatattttgaaaattcccgaattaacagattggtcgtgaaattaatgagggtttacaagtgtcgggaaaaccgttggatgaaaggcttatccacttggccaaagcggaggaattaattctgaaacaagatgggacttctattcttgacaatttccttgacgagatggtacaatttatccatgaacgagaacagaaagtccgttgctttgtgatttcttttattgaaaaggcttggtaagttttgcttaactgtaaaataattaattaattgattaaagtgaaatttagcaaaaaagacacggaagtgttcaaaagagcgatagcgactttaaattgggcaatggttgaccagtcgagcggagttatcgtgcagaaaaaagtgtcactattatttttcagcatttaa

SEQ ID NO: 63796 - DNA, 1168 bp, Heterodera glycines
  misc_feature (476)..(476): n is a, c, g, or t
  Genomic contig location: Contig_ID=SeqID_33851; Location=27..1194; Strand=+
  SCN-specific regions: Sequence locations=1-25,213-273,295-299,342 -1003,1025-1168
atgccgaccttccgaaaggcacctcaaaaggggggagacaaagatacgacgaagaggaagaaaatagtgggagagacgaaagacggagagagctcaaggacgagtgataaggctgaagggagagagacagagggagataaacacaagcaggaaaaagagggaggaaacgaattgaaagagagaggtacagaaaacagagagaaacgagacagtgttgaaaagagtgacggtgatcagaatcagcagactgagagggaaaatgctgatcagcagaacacagagacgacgaagcagcagcaaaagggaaaagagagtgtggcaaaaggggagaacaaagaaggcagagacagcgagacagaaaaagtagacgaaaaacaaaagcaaacgccgaataaaccatcgacggtgagggatttgatgggcttaaacaattgaaaaacgaagtcatttaaactccgatttttaatcatttcaanatttggtttcagttctccgatcagaacaacggacaaaatttgttactaaatgaaattgcgacaacaacaaccgaagggcaacagaatgaagaacaaatgccaacaatgccatcgatgggaaagaagcagcagaagacgaccaaatcaaaagcaaaaacggaaacggaaacaatggcagaaaaaacgaacggaaaaagcggacattcgaagtcgaaaccgcaacagaaaaagacgacaccgacggcatattattcatccacggcatcggcacaggcacagtaccattatcagccgaacaacaataatcagcaacaacagcaattccaacaccggccagcatttgtcctccatcgttgtgcctccggcgatgggcggcggagtgtcgtcgccatttggcccatccaaattcccttcgcttcagcaatggttgctgcgtatgcgccatttttgcagaattttatgcagaacggtggtgcggcaacaacttccgcttatgcggacgcatccggtacaatttttgcactgctccaacaacagaggcaactgccgacgccgcagcaccagcagcacaaaattggccaaatgtttgtcggcaaaatgatgggaatggcatcggccgctgccgcaaatgccaggcaggcggagggaaagtgccgacgacgacgacagccgcaaaaagcaccagcaacggc

SEQ ID NO: 63797 - DNA, 302 bp, Heterodera glycines
  Genomic contig location: Contig_ID=SeqID_7084; Location=101..402; Strand=+
  SCN-specific regions: Sequence locations=1-100,138-302
atgcgccagacactgatgactttctttctgccgcttttcatcttcttcgcccatctgacagcgagtctcttcggtaagcaatttgagtccacaaatcatcattttaaaattatgtttattttttttatataaattttcaaggcctcaagtgcaaatttggagacgaaatgcggccagcattgatcaaaaaattcatggactccggacagtgccctcctacaacggatggacaggagacgaagcattgtgtggcaaaaatctgtacaacaggtccaccatcacccgctccaaatgggcgctga

SEQ ID NO: 63798 - DNA, 360 bp, Heterodera glycines
  Genomic contig location: Contig_ID=SeqID_7085; Location=193..552; Strand=+
  SCN-specific regions: Sequence locations=1-275,296-360
cacataaaaacccgggccctgcggatgaccaatgggatgttttggtgtggggatgtgctgaaacggacgctggcacttgtgccgttttggaaacaaaattatctcaagtcatgaacaacactgttgcgttctcttgcgaatgccattatggcgccagggatgttgatttggcaaatgagcaactgatgctccgtcatctgttctcgcccattgccgctcctaccgatgccgtttcaattgcagtaatggcattcattatatgaactaaattgaaaatatatatatatatatatattccaaattccgtatatattaaattaaacccccctccccccttaattagaagctccaccccctgaa

SEQ ID NO: 63799 - DNA, 792 bp, Heterodera glycines
  Genomic contig location: Contig_ID=SeqID_33855; Location=170..961; Strand=-
  SCN-specific regions: Sequence locations=1-200,223-282,326-470,492 -665,687-792
  Gene Ontology: Mol. function=channel/pore class transporter activity; Cellular component=nicotinic acetylcholine-gated receptor-channel complex; Biological process=synaptic transmission
aaaagagagaatcgaacgggtgcaaaattaaaattaaaatggcttggattggtcggtcattttcggttgcttttcctccccagtcgctcagcttcaccaacggttggaccattcgctgggcccaattcgcgtgcttcgtcattctccgctggaggccatgtgccgtccgccgttggacgagcggctgagaaggctttaccggtgaagagaacggggggaatggcactcacttccatttcgaatggagaataatcgtatttaaatccgacaaaaagcggacttcactttttctgtttttcttttggcttaacactgtccaatcgcaacagttttattctccctctcttttcattggtttaaatgccattcctttgcatttgaaaggtgcccaaaagtggagaaggcttttgaaaacgtttgttttgtggcggaattgctgcggcgaaaggaccgcgaccaaaaggtggcccaggactggaaatacgtggccaggtcagtcggtccgtcggtgcttttgcggcccattcatttgcccgattcgactgctgttttttccatatgttttgctgttccatcatttacattttttccctttttcttcctttttgtccctttttccttcccattttccctttcagtgttttggaccgtttgttcctcgttctgtttgctctttgctgcttttgcggcaccgcttggattttgttgcaggcgcccattttttatgaccgtcggcagcccattgacctccaatttcaaccgccgaatgctgtcgacgtgtgaataatggga

SEQ ID NO: 63800 - DNA, 1392 bp, Heterodera glycines
  Genomic contig location: Contig_ID=SeqID_33858; Location=19..1410; Strand=-
  SCN-specific regions: Sequence locations=1-618,640-735,757-1178,1200 -1392
atgtgttcatggcaacaattgatcaactctcttgtcaccaccaaagaagttgccgaacaaaagcaactcgacgaaactctcagggaagtttccgaattttgtcaaaatggttggccaaagaaattaccccaaaattggcagcttatttcacacatcggtacaaactctcggaagtcaatggatgtcttatgtttggagagcgcgtcatcatcccggcagaattgcgccaacgtatcctgtccgcgctccatttcactcatcctggcattgttcggatgaaggcacttgcacagcgacacgtgtactggccacgcatggacctcgacattgacaggtgcgtccgaaactgtgacgaatgtgcacttgcagcaaaagcaccgccaaaagcgccgcttcgtccatggccttccacaaacaaagtgtatgagcgtctacacatggattttgccggaccatgttccgatggacgtctctatctaattgtcgtggatgcttttagcaaatggccagaaatattctcagtcaagagcacaaccgccgacaacgtcattgtccaattggaatggctattttcgcgatacggttttccatgtgaaatcgtgaccgataatggcccaccttttcattcaaatgctttttcccatttttgcaggaccaagggaataaagcaaagtttttgtccgccttatcacccgaagagcaatggacaagccgaacgatttgtggacattttcaaaaaggagatgaaaaagggtgcaggcaaggacaaacaatgggtcaccaattccttgtttgcctatcgcaacacgccaaacatcgctttgaatggtcgcattcctgccgaactttttcttggccgtcctccacgcacagaactttccttgctgaaaccaactgtttcacacccaacaaacggcaccaaagactacgccaacaacatggcaaaacagttcaatcgccaaaatggagttcgccgtcgaactttcgcgattggagacgacgttctgataatcaattatcggaacaacaaaacaacgtggttacatggtaaagttgttgaaggatcaggtgtggtttggaaagttcatgttccaatcttaaacgccgttgtgcgtagacataccaatcaaatgcgtcacttttttcctaattccccaacagtctcaaggttcacatcatcagcagcaacatcttcaaattgttcaccaagaacccgcgacagaaccgaacactcctcagcgtcacgtgcgtttcgcggacgaacaacctgaagagcaaccggtcccggacgagcacaatcagaacgaagtcagacggtcgaatcgtaaccgccgtccaccaaaactgctcgacatggacacatcaaaagcacgatatgattacacaaattga

SEQ ID NO: 63801 - DNA, 267 bp, Heterodera glycines
  Genomic contig location: Contig_ID=SeqID_33859; Location=82..348; Strand=+
cgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgaccctctagtcaaggccttaagtgagtcgtatta

SEQ ID NO: 63802 - DNA, 645 bp, Heterodera glycines
  Genomic contig location: Contig_ID=SeqID_7087; Location=44..688; Strand=+
  SCN-specific regions: Sequence locations=1-645
atgggcaacaaacgaccaacttcaagtggatttccctggaccaatcactggactcttcaaagggaagcaaaccagctcagtaacaaattgttttgcgcaaccagcaacactgttcgtcaaatggcacagtctccaactactgtcgccaacccatcgcgcagaccactgcaattacgcttccgagtattgccagctgcaagacaacagttcactcatctggacttcagcatgtccaaacgacaattgtttcatgtgcgatttccaagaagccgaagaaatccacggagaattcacaagctcaacggtcaaataacagcattttggatctcggatgatcgacaaaaggcactgaccttcaccgagacgcatgccgtgcaagcatgcgacgggagacaaatcgtcttatcagagcagaacttcggcattccaaaagagcaattcgacatcatgatgagcaaccacacaagagcgaaacgcaacgtgcaacccgaacaactcgcttcacagcttaccgctgctcaacttgccacaacaatggcactctcacagctttacttaaaggaatgccagcgcaacgtgcgcgtcagcaacccaacgcttcaggcacgaaaactcctcaagcgcgaaaatctgcaagcccgatag

SEQ ID NO: 63803 - DNA, 771 bp, Heterodera glycines
  Genomic contig location: Contig_ID=SeqID_7087; Location=3448..4218; Strand=-
  SCN-specific regions: Sequence locations=1-771
cttttcgaaccgcttcgttgagtacgtctcggaactttgtcgtgttccagcgtgccgggtcttctccctttttggttaggattgtgcgcaggaatccgggagtgagcttcttttcaagcatgaggaaggtcggtgggccttcgatgtcttctcctgtattgttgagttcgcgtgtgagtcgttcgagttgcaggaggaattctttggtgtcgcgcaggtttttgcagggcttgaggtttgccaattcgaaatgaagtgccctgatgtgttcgtccggtgctccgtatgtgtccttcagcaattggagggccgtgtcgtaattattgtcctccagtcgaaagccagccacgagttctcgggcttctcctccgagtaggttgcgcaggagattgaacttctccgctttgctgagtgcgtgtgtgccgattgctgatttgaacgattcgtagaactccggccatttgcgtttgttgccgaagaacttgtccagctggattggctggaattggtagaacggaggagtgaaggacggcgtcttgtttggttgttgctgcgcggtgtgttgcattgcgtttgcatgagctgcttgagcgtcccgctcttctttgtccgccttgctgcggtagagtcgggattgaactgtgagtgtgcttatgaggtcacgcaagtcgcgcagcttcagtgctgcttcgtcgactttgtctgttgttcgctcctttttctcgaacttgttgaaatctgcttctgctggatcgcgttccgttgcaggca

SEQ ID NO: 63804 - DNA, 936 bp, Heterodera glycines
  Genomic contig location: Contig_ID=SeqID_7087; Location=836..1771; Strand=+
  SCN-specific regions: Sequence locations=1-912
atgcgcatcctcccactcatctcaaagatcgcaagttgctctcaatttcgctaccatcatctgcaagtgcaacaaaaacccaacttgtgggtgcgaatcgactcaaaaaatggaaacgtccaacgattgtcacaaactgcaatccatgagctctacgagacaatcctcaacaaaacggacaacgacttggatctccacccactgatcttccatcagtggcaactcgacaacgacaccgacttcgctacctttccacacatcgacgaatccgaggattcggaagagttcaaaaataagctggaacaacacacgacccaacgagccgaagcactcggagctttacccggcggaatcgaaggatggaccgtcagatggctccaagaacggctacaggaaataatccaatggtggatgcgtctcgcctcggcatattccacattcatactctgccgcgacgttatcctaccctgcttgatcgcctacttcctgaacccaatccgcatcacactcatgaccctgattggatttcgaccaaagaaacaaccaacgcttcaaatccaagcacaacacgaggacatgccattgagggaaatgccaaacacaccaatccggcggaaacgacgtcaattgcccgagcaatcgactccaccaatacgacaggacacgacgacagcaacggcctcattccgaacaagagcaagagcccacagcgcaacggaagacacgcccttcggacgcttgcgaccaatgaaactggcagacgactgaagggcccaaaagaaccaagaagagagaagaaggaaggaagaacggacgagcctttccttgccgcctcgggagtgtcgcgattgccattcgcgaaaatcaaataatttgattttgcaattgtgcacaaattgtgcaaaattgaattggccccaaaaaccaaaaaccaaa

SEQ ID NO: 63805 - DNA, 668 bp, Heterodera glycines
  Genomic contig location: Contig_ID=SeqID_7087; Location=6356..7023; Strand=-
  SCN-specific regions: Sequence locations=1-668
caactttggaattgtgccgtcgtgcgctgccactttgattggtttgacaaggctttttgcgtagatgaggttgcattcatcctttctgattattgttttggccttttggtacacggcaattcccatgccgtatttgctggcgtcgcagaagcagtggaattccactgagtcgatggcttggatgtgccgtggaaattcgattgtgattgcttcgcctctgttgagccactgtgccatcaatttgagccagtccttgttgatgtttgctggcaattcgtcgtcccattttgggttcaagttttgcacttcttgaagaatgagcttggctggcagtagtacgggtgacatgagtccgagcgggtcatagactttggcaatttgcgacagaattgtccgttttgtgatttttccttcgaagattggcaatttgaagatgagccgattatgttttggtttccatcgaatgccgagcactttgttgtcttctaggtcctttgccaagtcgtctggttgcagcttttttagctcttcgatgttgcttccgtagaattctcggagtttcatgcccgctgcttcgaagattgtcttgcttgcgtcaccaaatcttgaagcttttccgttggcttggcgtcgaacatgatgttgtcgacgtacagattcttttcgat

SEQ ID NO: 63806 - DNA, 2262 bp, Heterodera glycines
  Genomic contig location: Contig_ID=SeqID_7087; Location=3219..5480; Strand=+
  SCN-specific regions: Sequence locations=1-2262
atggccgcaccaattcaacagaaactcagcgctgctctcaaagttctctcccgaagccgaactgcggcggaactgaacatccaagccgaccaagcggcatcaaacctcgaaaacgcattcaatttcgaggctcaactggagaaggtccaaaaagaagcaaaaacaatggacatcttcctcgacgacgtacgagaatcgctcacagcatgggcggatttactgcgcaaactgcctgcaacggaacgcgatccagcagaagcagatttcaacaagttcgagaaaaaggagcgaacaacagacaaagtcgacgaagcagcactgaagctgcgcgacttgcgtgacctcataagcacactcacagttcaatcccgactctaccgcagcaaggcggacaaagaagagcgggacgctcaagcagctcatgcaaacgcaatgcaacacaccgcgcagcaacaaccaaacaagacgccgtccttcactcctccgttctaccaattccagccaatccagctggacaagttcttcggcaacaaacgcaaatggccggagttctacgaatcgttcaaatcagcaatcggcacacacgcactcagcaaagcggagaagttcaatctcctgcgcaacctactcggaggagaagcccgagaactcgtggctggctttcgactggaggacaataattacgacacggccctccaattgctgaaggacacatacggagcaccggacgaacacatcagggcacttcatttcgaattggcaaacctcaagccctgcaaaaacctgcgcgacaccaaagaattcctcctgcaactcgaacgactcacacgcgaactcaacaatacaggagaagacatcgaaggcccaccgaccttcctcatgcttgaaaagaagctcactcccggattcctgcgcacaatcctaaccaaaaagggagaagacccggcacgctggaacacgacaaagttccgagacgtactcaacgaagcggttcgaaaagaatcccaaatccaagaagtcatgggcgagtacggacactcgccacaacaacggccgcaaccacaaaggcccaatttctcggcatcaaaattccgagaccgcgcaccaatcccacagcaacgggaacgcacattcatcacctcagcggtggatgacaatcacaaaaggctgatcaatcgacagcctcaacacaggccacagcaacaaaggcctcgcgcaccacaaccgcaacaaagaaacttgcgcactttcaacaatcaaaggcaatttccaactcaacgtgccaatgcgaccaacaatcaacgacaatttccaactcaacgtaccaatgcgatcaacaatcgaaggcaatttccaactcaacatgccaatgcgacattcaatcaacgcaagccaccaagtccatgcatcttctgtgacaacgatcactggaatgaagaatgccggaaatacagtacaattcaacagcgaagagaagtactacgcacaaaggcattatgcttcaaatgcctcaaaagcaatcatcaagcaagcaactgcccgcaaccgaagaaatgcttcaaatgcaaacaacctcatccaacggcattatgttatgcagacgaaaaaccaccgaaccaaatcacagcagcaatgttggggcaaacacaacaaaatatgtcaatcacaactcaagacggaagcaacgaaccaacggcatcgacatcgcaaatgtgcaatgccgtaaacggaagcgacactcgcgcactcctcatgaccgcaacttcaacggtcttcaatccagcacaaccgcatctcagcatgactgcggcaattttcatcgatccaggcagccacagatcattcatttcagcaaaggcagcacagctactggatcttccggtggtccacaccgaagaatgccacttgaccagtttcggagaacgcgaaccaaaaagatacatcagcgacctggtcaagctcggatttctctgcacgagcggggaaaaactcatcttcaacctcaacgccatgaaattcttggtcaacgacatgccaatgattcaactgtcagagctggacaagacagagttgaggcaacaaaagcacaatcctccgcatgaacaacgacaacctgacatcatgctcggaattgatgtctggcacgaactgcaggttcaaccaatcgaaagttgccaagcggtttcacactgtgccgatccaaaatcggcaaaatcctcagtggatcaggacgcatcgaaatgcatcaaacgccaaacgtga

SEQ ID NO: 63807 - DNA, 971 bp, Heterodera glycines
  misc_feature (19)..(19): n is a, c, g, or t
  misc_feature (35)..(35): n is a, c, g, or t
  misc_feature (38)..(38): n is a, c, g, or t
  misc_feature (44)..(44): n is a, c, g, or t
  misc_feature (49)..(49): n is a, c, g, or t
  misc_feature (52)..(52): n is a, c, g, or t
  misc_feature (58)..(58): n is a, c, g, or t
  Genomic contig location: Contig_ID=SeqID_33867; Location=9..979; Strand=+
  SCN-specific regions: Sequence locations=1-67,89-413,453-470,492 -532,555-587,618-971
atgatcaaaatgaataaanttcggagatcaaaatngcnaatgancagancancgaccnaattcaatgataaacaaaaatgtgaaattgttcataaatttgacgcaataaaagaaggaattaagaaaagaggaaaatattcggcaaaaggccgtggtaaaattgagcaaaagattggcgtaaaattgggaattaatcgactgaaaatttacaaatggaaaaaagaatttgggttaaatttaaaaaaagataaacattattatgaaaagaaaaagcaggaatttgttgaaagaattgaagaattcaaaagaatgtacaaaaatggaaaacagaaacaatttgcgaaagaattgggcattcacaaagaaacatttattaaatggaaaaagaaatttggcattgaaattggcaaaagtaattttaatttaatttttaattttaattttaaatatttcaggatattctaatgaagaaaaaatgaacaaaatgtatgaatatttgaaaatgaagaaagcaaatccgtctttgagtgataaagaaattgccgaatttttgaaaatcactcaacgcaccctaatacgatggaaacaaatatttgtataatttttttttattttttgatattagcatatggattattgttttgttttatttgtttttctccttttatgtgtcgtctttttcctttttaattgtcttcttaaagcattcgataatgttatttctgaattttataattttgtgccgaccggtaaccataaattcggttttggtttttgttaacgatcagacaaattttccattttttttttattttggaggagaactgaactaggattgctattttagcatattgtctttaacaaatttttggaaaattcagtccttaatattataaaaattcccaacagctctccgttaagaaatctgtgtcgcggatcgaggtaaaattcattttttatttatgctttca

SEQ ID NO: 63808 - DNA, 605 bp, Heterodera glycines
  Genomic contig location: Contig_ID=SeqID_33870; Location=1..605; Strand=-
  SCN-specific regions: Sequence locations=1-334,371-498,524-605
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaaatagcatgtaaataaaatttggtgcgtttcagagcattttct

SEQ ID NO: 63809 - DNA, 140 bp, Heterodera glycines
  misc_feature (130)..(130): n is a, c, g, or t
  Genomic contig location: Contig_ID=SeqID_33870; Location=757..896; Strand=+
  SCN-specific regions: Sequence locations=1-140
cttgtgtggtaagtgtgaagaactgtgttcctccaggcaaaaaattctaagaaaatttataagcatttgaagggttctcagcagtttccctgcaaaatttggtgagcttctgatcagtctagaacgttgngtgataaatg

SEQ ID NO: 63810 - DNA, 865 bp, Heterodera glycines
  Genomic contig location: Contig_ID=SeqID_33871; Location=148..1012; Strand=-
  SCN-specific regions: Sequence locations=1-865
  Gene Ontology: Cellular component=membrane; Biological process =nonselective vesicle transport
gagtcgaagctggaaagtgagtacatccaacgcctttttcgggccaactgacaccgctcgaggtacagtaacaatggtacattcattgacaattggtacagtaaccgggccattaaccaggagggcctatttcaatttccgccatatcatagctctgacgtcacatttttaaattttaaaagtgtataatttttgaaaaccttggatcattcgattcctctaaatattctccatttgcatgctaaaaccaattatggccataaatcggggagattttttttagttgcccaatctaatcactaaatttgttgccatttttctcatctcttttttccccaatgccattgtgtggttttttgtgtgcgcttttccaccagtgcctaaaactgaaaatacctttcccaggagagtcggctgtgcgaactgaagtacggtctgcaaagcatgcacaagggcaaaatgccgaacgacgcgcatttgctgcgttttctgcgcgcccgcgacttcgacgtgcaaaaggccacgcaactggtaaaaacgcttaatgttgaatagaccgtgccgtaaaatctcatacaaatgccaacttttggctttccactttttcgattttgtataatttcacttatgcctttttcaatgcttcaaatcattttagacgctgaactcgttgctgtggcggaagcagcacaaaatcggtggctaactttaacattatgtgcttggattgcccatgattaccactgggtaataaaaactcatttttagacagtcttttggacgactttgtgcctccggcgcttttcaaaaaatatttccccggcggatggcatcacaacgattctgaggtggggggacttagcat

SEQ ID NO: 63811 - DNA, 1646 bp, Heterodera glycines
  Genomic contig location: Contig_ID=SeqID_7088; Location=180..1825; Strand=+
  SCN-specific regions: Sequence locations=1-1569,1612-1625
  Gene Ontology: Mol. function=peptidase activity; Cellular component =integral to plasma membrane; Biological process=proteolysis and peptidolysis
atgatcaaacttttcattatgaagatgccattcccacattttccttgtaggcccattcaaaatgtgatcggatacatttggggcagtgaacggcccgacgagtgggtgatgctcggcaaccatttcgacgcgtgggttttcggcgccatcgacccgaacagcgggacggccgtgctggcggaggtggccaagggattggccgaaacggtgcgcaccaccgggtggaggccgaagcggacgattgttttctgcgcttgggacgcggaggagcccggactgatcgggtgggaagcactcactgattatgcataattaacttactgatcacacacattgacaaaactatatctagtatattcgtgtagctttactaagtattcgtttttttaatttgtttcatttttttgccacagatcgaccgaatttgtggaagaatttgcggaaattttgcagcaaaaggccatcgtttatttgaacgtcgatttgatctcctccaaccaatcattgtctgtccgtgttccttttgtgctcatttcctgtggccaatgttctgtttcaggtctgtctccactgtcccttcgcttttccattcggccgtcgcggcggcaaaagtcgtcaaaaacccattggacgaccaattgaccgtcttcgactcgtgggccaaacatttcccatcaaaaacggaatggcttccggacattcctgaaatgagcatccccgggggcggaagtgaccatatgtgagcaaaaactattggggaaattgaaaaaaagagcaaatttacaaaaataaggcaaataaaattaaatgaaaaaaaccaaatccatgcttaggtaattattacctacaatttcaagtacatcatcatcataattaatgtacggtattttagcacttttctgaactttttgggcgtcccggtgatcgactttctttacaaagatgccgaatcccccggatattcctaccccctctatcactcgcgctacgaattgccatttgtcaacgagcaccttttcgacaacaatcagttggcggtccgtttctcaaacattttttttgcatatttcgaactcaattctttaaaattcaggtgcataaagccgtgggcgaatattgggcggaattggcacgtctttttgctgattcgctgcttttgccgatcagtgcgaccactttggcacatcgattattggccgactatttggaggggatcaaaaaagttgctaaattaaattcaatttgaatttcgttattatttattttattcagccaatcttggatttgagcagccaatttccgagtacgtgtggaccggcgaagacccaactggacaatctgatccaaaatgggcaccaatttatggcgcaggcggaagagttcgaacggcacgcccaaggccaaagtgcgagtgccaatttggcccaattagcgtgggcaaatgaccgactgagaaaattggagcaatgttttgtgaacccggcgatgggactcgcgcgggaagaaccgctcaaaaggcacgtgctgttcgcaacatcgaaggacaatttctacgcatcgaacacaatggcaattgtttataaaaaggtgacaaaaacgaatttgtaattaaatttgaagagacaattaagaaagaaaaatgctaa

SEQ ID NO: 63812 - DNA, 659 bp, Heterodera glycines
  Genomic contig location: Contig_ID=SeqID_7088; Location=1844..2502; Strand=-
  SCN-specific regions: Sequence locations=1-49,71-498,520-659
atggccgaattgttcagaattgcaaatgaaagttcagatgaatttgagcaaagaaatgcaaaaaaggcaatagaaaatataaatgaaaattttaaactaattgaggaaaatgtgaaaaaaatgttggaaaaattgggaatttatcaattgggaatggaagaaaatgtactcaaaattgggaaaaatggaattgagaaaaatgacaaaattgtgaaaatggtgcaaagattaagcgaaaattcaaaatgggaagggacaattgaaaagaccaacgaaataattagcctaattaaatcagccgaagaaagtgcccgaaaggaggcgatcgaagcattggaaagtttggaaatgatcgacgaacaaaacgatcgggacaaaattgtgatcagaaaaagtgaccggaattaattattgtcgatcaaaaaattttcatgaatatttgtgaacaaattgttaattgatgatccattagttggcattaatattaatcgtgggcattatcaaatgcctttgctgagtgtgctggtggcacagtgaatcgcctgctgcacaacggccaattccaaggccaattcattgcaccattttgtgcgctcctcggcactttttgcgtcgcgaaattggccaatctaagcataaaaagcattaatttcattaaa

SEQ ID NO: 63813 - DNA, 754 bp, Heterodera glycines
  Genomic contig location: Contig_ID=SeqID_7089; Location=22..775; Strand=-
  SCN-specific regions: Sequence locations=1-70,123-128,177-393,433 -460,483-754
atgtgcagaacaaatgccgaaaatggacagactttcgttttgcatttgccaaatgttgacgaagagaccgcaaattttaacattttctttttcttttatgtaaaatcaacgaaaaacgaatacaaaggtaattataataattattaatttagcaaattaataaaagataattatttctgggatttatatgttctaaaaaacaaaaaaaaatgccaaaaaatctgctgaaataaacatagtaaaaaaatgtgcaaaaagcccaaaaaatgattctatgtgctggaaagtcgctctaattcgtgaattgttgaatgaaaatgcgctttttgggctttaatgcgataagattatacgcagaaaagtatatgcaaacatataaatctcagcgctcggttatatttaatttacattaaatatcatttaaataattatccgtttgttattgcaaaaggatatagagagttagatagtacaaatttacaaaatttgtgctataattgcgtcccattaagctgacatcgatgacgaaaatccgtcagacgaaggccctttctttgatccaaaattcaacttagaattggaagacattcggacgatgttccgcatggcttatgtcacgctatacaggcccaacttttccaagctgtacacggtcaatttgggccaaattgacccgaccgaactatttttgaaatcgcgcgtgtttctcgaaacgaagattccgatgagacgggtactttttggttactggtga

SEQ ID NO: 63814 - DNA, 876 bp, Heterodera glycines
  Genomic contig location: Contig_ID=SeqID_33873; Location=79..954; Strand=-
  SCN-specific regions: Sequence locations=1-219,241-681,705-793,817-876
ttttaagcccgtcatacagaccgtcgtggacaaattcaatcgttcggtgattgttctccaatgtggcgctgattcgttgggctccgatcggcttgtctgttttaacctcagctttgacggcctcgggtatgtgtagaatggcacaaaagggggagagagagagagaaaggagagagtggttgagaaaaagtctatggccaaaccatctgcacaatttgccttggaatactcttccacattcattccatcagggaatgtgtccgtatcgtcaagtcactcggcgttcctctgctcatcatcgtcggaggcggttgcactcaacgcaacatgatgacgtaaaaagacacaaaggaaaaaagcggtgcacaatattaaaattggggtaatcagcagtgaaaacgctgggactcagagcaccaccatttcaatcacagaaactcagaccacagcattgcaatcactggcaatcaattatcctgcatttcaatcactgggaatcaaaccaccaaaattcaatcactgggactcatagcaccaacatttcaatcagtgggactcaacccaacagcatttcaatcactgggactcaacccaccagcatttcaatcactgggactcaacccgccagcatttcaatcactgggactcaacccaacagcatttcaatcactggtattcaacccaccagcattccaatcactggcactcaattctcatgcatttcaatcactgggactcaacccaccagcatttcaatcactgggactcaacccaacagcatttcaatcactgggactcagcccaccagcatttcaatcaccaggactcaacccaccagcatttcaatcactggcactcaacccaacagcatgctaa

SEQ ID NO: 63815 - DNA, 1617 bp, Heterodera glycines
  misc_feature (80)..(80): n is a, c, g, or t
  misc_feature (294)..(294): n is a, c, g, or t
  Genomic contig location: Contig_ID=SeqID_33874; Location=9..1625; Strand=+
  SCN-specific regions: Sequence locations=1-17,39-245,268-368,390 -727,780-833,912-1045,1111-1617
atgtcccaattcattcgatgggagctgaacctgaccgaacttgtccgacgaatgaatctgattggatacggacgggacgnaatcatgctgatcactttgcactcggctgatcagctgaacgcgccgggcggcttacgcagacatgcttcaggcagaagaatggcagagacacccgtttccttgaccaggtaaaattgtaattctcgtggcttttaccataatcttgacctataatctattggccaaaccctaaaaagtatggcaaatactcaaataatgttggaccgactccanaaatggcacagacagaaaaaatatggcattctccccatataaatgtgtattagtgccatactctgctgagcgggttctacaaatattttacattttccacctcttttggcacagggaggctttatgggctccgcacgcgttttgcccctcgcacaaatggcggcacgccgtttgcatttttggcgtcgaagacttggcccgactcgtcaaattcccgcaccttttcttcaataaattttggcccgccttcgattttggcgctttgttgtgtgtgtacgaacggttgttcaacatgacccatttgcacacctgcggggaacagttggccaaaatggcaccggtggtgaacaaatcgtttgtccaacaactgcccaatgtccgttggtttggtgttggaaaaaagagtgaaatacgaaaaaagggaaaaaatttctttaaaattttccaatatattttttccttaaaacacttttaaaaaattgaggacccccaaaaaaagataaattttagaaataagaataatacgaacgatgaaaaagaaaaattatttatttaaaaaataaaatggggaaaaattctaaacatttttttttaattttaaaaatttttcttatttaggtgcgatttcaacaattcaagaaggaaatattgtgtgaacgaagtaaagtgcagataatttctgatgaccaattgacatttaatgagacaatgagctttaattgtgatggtgaatgaggagccgaaaaagaagaatattttttaaagtttattataattttatttatttgtaaaaatatatttattttcattttattagtaacatcgagattagtttaacagcctgtctaattattaagaagatcgctcaaacagttatttttaagaattcctatcaaaatattccaaaaaaaaaaactatttttatgaataggaaatacatattgcaaattgtaaatttaaattatgaccaaattcttggaaatcatgggcacgaaaaatggagattgtatgccatggattttgcaatatttcataagttgcgtgatcataagtttatttggtagtgtttttaacaattatgtgccgattttttgcactctgctcgtgatggtaaaactcaccttttaaatcaaacagatcgccattcaaattcgacatccgccttctccgtccgtcatacagttgtaccatcacaattctttacgtatttctcctcacaacaataatagcagctgcacttcgttttcattacgcaatgcttgccgaaatacaaattggcacgccgcaaagttttgattgccggggccgcatttggcatttgca

SEQ ID NO: 63816 - DNA, 779 bp, Heterodera glycines
  Genomic contig location: Contig_ID=SeqID_33877; Location=33..811; Strand=+
  SCN-specific regions: Sequence locations=1-21,78-779
  Gene Ontology: Mol. function=ubiquitin conjugating enzyme activity; Biological process=anti-apoptosis
atggtcatccttgtgtgttcactgcttcaggtgctcatttccatccaggtaatttgtcaattaaataattgggtaattaagctcaattcatttgcccattccctataatttcaatttgaaattattttcaattccccagggcctcattttcgtccgccatccctacttcaatgagcccggctttgagaagctccaagggacgagtcggggcgacgaattgtcgcgcaaatacaatttgtgcatcgaaaacgccacacttaattatgccatttatgagcagtggaagaacggatcgccgtattttacggtgagtcaattaaaaaaagtgactttttatatccccaatccaaggggaaaggcaactgacgcaaattaaacgacggaatatgccaaaaaaagaagcaaaatccattttgccaaaaaaagaagcaaaatccattttacaggatgtcattcgacggcacttttggctgaaacggcacgcggtcattcggcaggcggaacggtggctgaaggaagtgacggagaacgtgcggaacagcggaaagatgcaattgccggacaccgacggaatggcggacggcgttttgtccagccaaagccttcaggtgggaaagaatatcggaaaaaggaaaatctgatcaaaaagatgcaaaaactgatcaaacaaattatagcgtcaaaccgtgcgcaaattgttggaagaatttcggaaaatggaaaaccctttgaaggaagcggaagcggaggaggcgaaaaagggaggaggacaagcgtaa

SEQ ID NO: 63817 - DNA, 405 bp, Heterodera glycines
  Genomic contig location: Contig_ID=SeqID_33881; Location=111..515; Strand=-
  SCN-specific regions: Sequence locations=1-95,117-405
ccgatgtgtcggcaatttacgacagtttgccccccgaaattgaattcttccgatttgtcgaatcacttcggccatgctcaccgaatgaaacggctgaagagaaagaggaggaacaacgggaggcaaaaaggatttttaatgaaaggcttgaacagttgcgagaaagacaagtaggaaatttgcaatgaaaaacaattctaaagtgagtttttccaggaagctttgaaatatgcggagatgacaaagtctgtcgatgtttcacgaaatcgttcactaatgcaagactttggaaaggtaagccaagtgttggaatatatgtatttttctaattccttcgtatctcccaggaaatgagagaagcaaatcgtcatttggtcgccgttattaacacactgataactgtcg

SEQ ID NO: 63818 - DNA, 612 bp, Heterodera glycines
  Genomic contig location: Contig_ID=SeqID_33889; Location=94..705; Strand=-
  SCN-specific regions: Sequence locations=1-193,215-259,283-457,479 -499,523-612
atggcgtcactgttccgttccgagtcggtagacaatccaacacgattgaaggacgaggaatgggaccgagtggtcgcagtgtttgtgcaggtgggcgtatggtcatttcaggggatttgcaaaactgctttagggtccggcctggcaatttaaaaattggaaatggaatggcaatccggttgagatatttgccaacattgctgcgtttcacttgccatccgaagaacggacgagggagactgagtcgattcggggcgggaaaattattaaattttataaattggggaagagtttgatgcagataacaacaaaggtaggcttatctttgatagtgaaaactcgatcttctcatattttatgttaattgagcataaggttgccaaactcatcagggatgctcggcggtaaaggaatttcgggcaatgcaatgaaggcccatctagatgactcacaaaaatgttagaaaatatgaatctgtggtgtttattcatttcttcagaaaataattattaaatattttttcaggagagggttctgaagcatcatcatattttattttcaagctattttaggcactctgatgctttgtatatcaaaaagggagaggaataa

SEQ ID NO: 63819 - DNA, 3562 bp, Heterodera glycines
  Genomic contig location: Contig_ID=SeqID_7093; Location=710..4271; Strand=-
  SCN-specific regions: Sequence locations=1-131,165-190,238-440,462 -575,597-659,689-908,938-1034,1067-1255,1292-1327,1356-1587,1609 -1645,1667-2303,2325-2365,2399-2676,2698-2733,2760-3181,3218-3562
atgcttttgctcgtgctttgcctttttgttgtcccaactgcgcattgggtccagcagcaaatgccgccggcgcagcccctgggggctgcccaattttttcagccgattatatcttttaaagcgtccacggcacagcaacaacaacaacaacagcagcagcagcagataatgtacaacggaggaggagcggaacaacaacaacaaacggaacaccaacaacaagaacagcagcaacaagctggccaagcagttcggatatcgcgctttgatccgacattaaaggttaaaaaaaaattgtgaaactttgggctcaattacggattacgtgttaaggattaccaggaattatttcggcgtttttggacttcgtaattacggatcatgagccattttttagttgaccaattcaaattaacttggcatcattcaatgctttttacttgtaatattttaacaaattgcaaaaaaagagaaaagtcattaaatgattatcacaatctatctttacatggatggttctgtaacttttattgagttatttttaccttttagtaatgacttaaagatagaatcatatattctgtatttgctgactttacgatattttaatccattccatttgtacccatcacaaggagaattatgatgtaaactttatcaataaattattaatttttttttaatttttcataaacttccgttttttacgaggcagaaattccgattttcgaacaataatttttgaaaattgtgttctttgttcagacgaaatccaacgatggctatttgtctgcttcagctggccagggcacttttgtgcgcattgggccaactgccaatgcgccacccctacaaattttggtggaggacagagatttggtaagtaattttagttgaataaaatatccaatttaaaattattatttattttaaatatcccttaaaatacagtcaattaatttatttttttaactttgatttaacacattttcaaattcagttgccaggaatgccttcagcagtgtatcagtgagtttaattcttacattttttaaaataaaaatgccaattaaaataaattatatggcttatatttagtgcaaaaattcgatcgtttttagttatattttaaccggttacggtgctgaacgctttgcggttgaccatctgggcaatttgtatctgaacgtggatgaattggacactgatgcaactggcacaccgctctttgttctgcatgttatggcggtatttcaaatataaattaaattaaattaatttattattaaatggtgaaattcagtctggcaaaatttcgtttagccacaaaaaaataataatttttgaattttatagcagaattttgattcgattttaagttacaaagataaatttttgaagaagtcttagtcttgactcgagaaaagtctcggttttttgggcctggtctcggcctctattctcggaaaatgttggttttgagcatcactattaatatagagagaggtcgacacaacgccacagcgcagcagtgctccgatcagtctgactatacatttgctggacgacgacatggacaacgacgaggtggacggcgtggagacggagcaggagcaggaccaaccgcagcagcacgtgcaacaacaacaactacaacatttacaaggcaccgttggcggtggaccaacactgccacagacggtgtacgtggccaatgtgtcggccgccgctgggccgggcgagcggcgagtgatcgcgcaagtgaaggcacgcgagagcgagagcaacagtgccgtgttgtaagtactgggagattgggctttcgcttcagaattagttggaattttgcaaaaaaaagtgcttaaaaattatttttttgtataaagttttaggcactaactcaaactccccccagaacaagttttcatgagctattattgcaaaaaattgcaaaccaagggcccctctttgaatacagtatgtacattctcagataccgtatcgtggaagtgagtgacggcgctgtgaactcatttcgctacgaccacacaaagcatgaactcaggtgccaaccaatttaatttaaaggtcatataaattaaatttacgctctttaattagcgcgatcggtccattgtatccgggacatcgttataaggtaataccaagttaattcaaatcatttcattcaaaaaatgtaaatggcttttttgaatcttcccactttaaaaaatttttcttttttttcgtctattaccctaattttgttcatttttaggtggtgatcgaggcacgggacaccgatgggcttgttggccatgctgttgtgttggtccaagcattggccgcagaccatctgccatcaaaagctgctttttcctccccctcctcttccgctgctcgcgcttcgctgttcggcagtggccaagttccggtcattgctgatcatcagccatttccgctttcatcgtccgcatttgtgccaccattagcaaaagccgtcggcgtcggcatacccccggctttaccggcgtcaccaccgtcggcacaaatgtcctcctccctttctcaaaatgtgccaccagctgcgggttcgcagcagatgatgtcatcggcactgattgcgtcctcggccggtgggtattggcagccgattagcaacggcggcaacaacaaagcaaattccaaccaaaagccgaacccattttggcgagttgatccaacaacaacattagcaacaccagcagcagcagtgaagttgaatccgatgcttataccattcgcaactaccacaactgccgtaccaccgccgccaagtcagtccacggtgagtgttcagtgaaattcgggcttaacccggattggcaccgatcgaaaaagacagtctctcgataagaataaggttcaagaaaagtctgcaatttttgggcattgaattcgaaacttggccatgtttcggacagtatgtcaacagatgaagcgatgatgtaaatgctttggcccctcgtatcttcgttttttatagctttttaccggaatgtaatcacaagtgatggaatagattgcttaacgtaatctttaaatctatgctaaatgtgttggcattaatgcgcagcgtactgtaaaaaaatgcatcgtgtgccaatgcctttgaaggaccctttgttcttgttagatttaaatataaatatatatatatatatatatatatatatatttgtgtgtccctatatacataattgatatccgtttttgaatactataatatttcatacagtatcatttttattttccattatttattttttttcagttccaatttttgatctgcccttttcaggagcagactttgtttgttgagctgtccgagtcggcgccggtcggcacattggtcacttcattgggcaacgagttcagtgcaggaaaagtgcattttgtgctgctggatgaagaaggcaacattggcacaatgtttggcatggaggacgagcaggagggcacaattgtgacaaaaggcactctcgaccgggagcagactgcgcaatacaaattgcgcattgaa

SEQ ID NO: 63820 - DNA, 329 bp, Heterodera glycines
  Genomic contig location: Contig_ID=SeqID_33893; Location=126..454; Strand=-
  SCN-specific regions: Sequence locations=1-32,54-243,265-329
atgacaaccatgggacagctctaccaggttcatttccatttgacctttaaaaggttttaagagggaagccaaacgagattcgaagtggtacaaaatcggcagttgtgccgataatccccactggttctttaaaacaaaaaatgggcaaattacaaagggacctttgcttttctcttttgattcactttttttgttgcaagttttggtatgtcttttccaaatcgctttaattttttcttgggtttcaaaattaattcttttttcaggaccgccacgaggaggacttgttcatgtacatcgcttacagcgaggagaacgtttacggctga

SEQ ID NO: 63821 - DNA, 686 bp, Heterodera glycines
  Genomic contig location: Contig_ID=SeqID_33898; Location=117..802; Strand=-
  SCN-specific regions: Sequence locations=1-79,101-135,157-522,545-686
atgggacagtgccgaaacggaaaactgctctcatccgctccaggaactaagaaagcgatgacaattatgaataatgtggcaacgacaacgagcaaaatggcaaatggtggacaacggaacagcgaaggacaacaaaagagggggccaaaaggagggaggacggaggtgagagaaagaagagaatgaatgagtggaagaaaccaggttacctttttcagaacaaagggaaggcagtccattcttccaaaaaactgacggcaaacactccgtcgacagtcacaactctcaccgcgataaaaccaaaaatgttgggaaggaacattggcaacggacgggggagacctttgggaagtgcacataaagccgtgggaaaagccgtggatgggtcatcaagtggcgattcttccgatgacgactcatccatcgaccagcacgtccaattggccagcgaaagcagagacgtaaaactaaatggtggtggtgaatcgacaattatgaaagggacggggcggagaggacgtcgcaaaggccgaacgagggacgagtcttcaccagacttggccacgacaacagtggccgaagattggactggtggcaatggagacccggagttatgtgcacacaaaaaatgccaaagaccgctgcatatgtccatcaattgggtccaatgcgatgactgcgacaag

SEQ ID NO: 63822 - DNA, 372 bp, Heterodera glycines
  Genomic contig location: Contig_ID=SeqID_33901; Location=187..558; Strand=+
  SCN-specific regions: Sequence locations=1-46,68-126,168-240,264-350
atggagttgctgcgcattgccatgtatcatcgcttcatgccattcttatttctctgctttttgttgtgccgtggggccccggctaatgatgtaaaaaagaagaaaggtaggaccaaatttcaattcatttttattttatattaaataatacttttaaaatatttttaggggtatggaatattagtgttttatttttataaagccagtaaatttttggaaatttgataacagagttccgaaattttttaagaaaatgtttgggttcaacgtctaaaatatttgttgcacgtaattccgacttccaaaattttttattgcctcgcggcaacttcttcccttataaatactacattaatatttaaaattatataa

SEQ ID NO: 63823 - DNA, 527 bp, Heterodera glycines
  Genomic contig location: Contig_ID=SeqID_7094; Location=118..644; Strand=-
  SCN-specific regions: Sequence locations=1-45,67-78,100-137,179 -203,280-298,320-433,469-472,494-527
atgaagtactggagcggatacgtgagctgaattactttgctgatcaaaaatcaaaagaatattataaataacacccatacaaataataactaaataaaagacccagtacagacaaaataactctttaatttaggatcatttaaattaagatttaaataaaaaccttctaaaattgattaacattgcaatctactcaaaatgcaagaaataaaaaagatttaagagaaaaaattaatgatactaataatttaaaataatagtaaaaaaatatataaataacagataaaatcggtattgctaaaggttcaaagtgaaacaataggctgaacttgtaggatgattgcaaagaaacatcttagatataaatattagattgaattaatgtgtaaacaaaatattcttaggatgttttataatgaatttaaataggcctattttataccaaatattttaaaatataaagtattgaagaaaaacacatacattattaaaattttatcaagccaagaaaaatttattttaataaa

SEQ ID NO: 63824 - DNA, 1090 bp, Heterodera glycines
  Genomic contig location: Contig_ID=SeqID_7095; Location=114..1203; Strand=-
  SCN-specific regions: Sequence locations=1-21,44-717,739-1015,1037 -1090
atggctaaaagaaaagttctaattaaattgcaaagcaaaaaagcggcccaaaagcggtggcgaatgcgagaaggtcgtagggcgaaggcccaaatcgctgctcaagttcgatggacgaagaaaagttaattttcaattcatttttcataaaatctccaattttcccaaatttaagccgctccccagaccgacccagatgccgacacgccacaaccatccgaagatgagccgccggcatcagaggcaccggcgcgggacaacgacggacgaccaccatcaactccaacaccggtgacaccactggaattggacgtcccgtcggtggacatggtggaaaccgatgtaccaattacttcaacaccagccgacgacgaccaagaagccgagcccgtgccgtcaacatccacggcacgctgtgacctcatggcgacaccatcgacttcaaagtgcgccggtgcctttggtcttgacgatggtgagtgagaaattccatcaaaaattttgtttttttaattcatttcattttcattatttttaagtccatatgtttgacgaactgcgacggcgccacgtttggaccgaggaggaactgcaacggcagcgccgatcaaacgctttcctccggaaacagctcaaggcacagcgcgaccgttcgacgagcctcgagcgttcggcttcagcatgccgccagcgcaaggccctttccgacgtgaccaacacccagcagggggacaacaagctgagcgcggcgaacgacctgctcatcaccttggactctggcatctcgttcaaggcccgtgaagcactgaagcggttgttcaccgaccaaggacttgacgtttggtcaccgacgagagagatgaagcgtctgaaggcggagctgtgcgaggcggtcaatgaaggttgttgagaagttggtgaaacacgcgacactgctaaatgcccttcacgatcaaggtgtcggaaacaatcaagagaatggaagcaaatacccaaacttttgatcaaaatttcatttttccaaacattttcactatctgaatattatgttgaacacatttttccgatttctataacattattaaataaa

SEQ ID NO: 63825 - DNA, 1318 bp, Heterodera glycines
  Genomic contig location: Contig_ID=SeqID_7096; Location=413..1730; Strand=-
  SCN-specific regions: Sequence locations=1-21,44-873,897-986,1009 -1016,1038-1146,1181-1204,1226-1318
atggctaaaagaaaagttctaattaaattgcaaagcaaaaaagcggcccaaaagcggtggcgaatgcgagaaggtcgtagggcgaaggcccaaatcgctgctcaagttcgatggacgaagaaaagttaattttcaattcatttttcataaaatctccaattttcccaaatttaagccgctccccagaccgaccccgatgccgacacgccacaaccatccgaagatgagccgccggcatcagaggcaccggcgcgggacaacgacggacgaccaccatcaactccaacaccggtgacaccactggaattggacgtcccgtcggtggacatggtggaaaccgatgtaccaattacttcaacaccagccgacgacgaccaagaagccgagcccgtgccgtcaacatccacggcacgctgtgacctcatggcgacaccatcgacttcaaagtgcgccggtgcctttggtcttgacgatggtgagtgagaaattccatcaaaaattttgtttttttaattcattttacattttcattatttttaagtcattatgtttgatgaactgcgacggcgccacgtttggaccgaggaggaactgcaacggcagcgccgatcaaacgctttcctccgaaaacagctcaaggcacagtgtgatcgttcgacgagcctcgagcgatcggcttcagcatgccgccagcggaaggccctttccgacattaccaacaaccaacaggaggacaacaggctgagcgcgttgaacgatctgctcattacattggacgcaggaatctagttcaaagcccgtgaagcgttgaagcggtcgttcgctggccagggacatgacgtttgggcaccgatgtgggcagtgaagcgtctgaagagggagctggcggagggggcaaatttttagtgggtgggcgaaggacagactcgagcacttgcctgtaccgacgtccgtgcctttgttgaggggcgacttcaagtgttggcaaaaagtggtgagaggaaaatgaataattatttaacaaaggcagtctgcaactccaccagcaatttgtttcctaaattgtgttggtgctgacgggtgacaagggaggcaacggtgtggcagcaacgacaaaattgggactggtgatcgtcaacgttgatcacccaaattccccaaaaaatttgtccattttgggaatttattttggacatgatgaccgaaaaaatttggagaacaaatttggctcgatttttgcacaattgaaccagctggagaccgttgcattcgaaattgctgggaggaagcggatcatcccagtccaaatgtaaataaa

SEQ ID NO: 63826 - DNA, 384 bp, Heterodera glycines
  Genomic contig location: Contig_ID=SeqID_7096; Location=2224..2607; Strand=+
  SCN-specific regions: Sequence locations=1-384
atggcttcacaaattgaaacaaaaaaacaaaaactgaagcttccccacggtggacatctttacacattcgataaaatgagtaaagatgaaacgacaaaattttggaggtgcgaattcaaggatagcgtcaacaaatgtaaaggccgcatttggacggacctaaacaataacttcattcgtcttgcaacgccacacacttgtcccgcaaattcttcgaatgttgaagctcaacgagttaaaactacaatcaaactccgtgccatcgccaccttggaaccgccatctatcattcgttcagaagcattgcagaacgtgccatcaccagccgcacttttggtgacaaaaaggctcgcgaatgacgtacgagaattttttaacaaatga

SEQ ID NO: 63827 - DNA, 625 bp, Heterodera glycines
  Genomic contig location: Contig_ID=SeqID_7096; Location=3186..3810; Strand=+
  SCN-specific regions: Sequence locations=1-44,66-90,122-223,246 -272,299-625
atgccagatccggttttgcttttttcattttgtacggaacttacaaaagaaagtgaagcagcaaggcttatggcaggtaattttctcccctttatttaaaaatttttttttcaaaatttaagcgttattgttctgatccggtgtttgctttgaatgttcggatgctcacatcagtcgcattcgttccgctttgtgatgtcaggaatgcagtgacagcacttgacatggaatttggaaatttggcggcttttcgacctctaattgattggtcagaaaataaaattttcaattttagaataagtttttaggcttttggacaatatgttgggcgtcctcgtcccaatggcacatggtcacaaccattgttccgtccggagcagtggaacgtctaccaacggacattggatggagatgcgaggacgaacaacaccgcagaagcggaactaaaaagcgaggcaaatatttggcagctgatagacgaattctgaatatggttcgcaattacattccattgaatgcagtgaatgatcatgattatcttccacccattccccagcccaatcaatttcacactattttggaatttcttcgaggtatttcacaccattatcaaatgaacccttga

SEQ ID NO: 63828 - DNA, 60 bp, Heterodera glycines; identical to SEQ ID NO: 52045
  Genomic contig location: Contig_ID=SeqID_33903; Location=187..246; Strand=+
  SCN-specific regions: Sequence locations=1-60

SEQ ID NO: 63829 - DNA, 334 bp, Heterodera glycines
  Genomic contig location: Contig_ID=SeqID_33904; Location=21..354; Strand=+
  SCN-specific regions: Sequence locations=1-143,206-224,246-334
atgcacattatatggcctattgtcggaattctgatgtcctctattggtacgactttgacgattcgaatctcacccgatgtgaacagctttgaagtgctttcccaagaggcgtacattctgttatacaagcagaaagagactttggaagacgaggaagcgatggaggaggacgaaatgttggaggaggaggaggaatgggtggaggcaaattcatccgacgaaatggaaactgagggcggcaacggcacgtgaaagcactgcggccccccccccccccttattgtgattattcattatctttattacatgtagtaattatttgccgatttcgcca

SEQ ID NO: 63830 - DNA, 959 bp, Heterodera glycines
  Genomic contig location: Contig_ID=SeqID_33905; Location=1..959; Strand=-
  SCN-specific regions: Sequence locations=1-50,73-98,141-162,184 -230,254-959
  Gene Ontology: Mol. function=transferase activity, transferring groups other than amino-acyl groups; Cellular component=integral to membrane; Biological process=fatty acid elongation
tattcagcatcatattgcaatgtgttgaaatacactgagggcaacaatggctattgggtgtggtgttcatcaccagtaaaatggtaatacaaaaatcgttattttttttttaaatttataaaaatatctataaaaaatatcttttcgaataaatttaattgtatttttgattttacatttacttaaatgattttttcagtttgagcttgttgacaccgttttcctggtatggttgtttgtttatttttctttcttccaatttttactctactgcatattaattgtcgggaaagtgcttaatcattccaaaattctcgattaattttatgcgttcacatcaagaccaatctaatgttttctttttgttatacgataaaatatgtcttttactaattgaattttgatcattgattaggcaacgattattttcactgatggactataaatgatcaccacatttttccaaaaagggatcaaagtatcctcaaaatcttattttttcgtaattggaccaagatcccgagaaaatcgaaaactgccgatattttcattgccgtactctgtcatctggcaatctatttcttcttacaaattgcgaccataatccgggaaaatctaatattgccgacaaaaccatttctgtccggactctgtggatcgctggcattcattatgccgtaattgtcacaggtgctccggaaaaggccgttgatgttcctgcattggtaccaccacattttgaccatgatgtacgccttctactcctatccgatcacgcccgcattcaaccgatggggcgatttacctcaactattttgtgcattcctacgtgtactcggtgagattgaggcctttaaaacgatttttttttcttgtccttgttcgattttttggattttttttttcgagggtcgtgccacattttaattgatttttcgcaaaattccccatgaccgcca

SEQ ID NO: 63831 - DNA, 321 bp, Heterodera glycines
  Genomic contig location: Contig_ID=SeqID_33908; Location=659..979; Strand=+
  SCN-specific regions: Sequence locations=1-103,125-187,209-321
atgaccggaaatggaaatgaattaatgagaacagaggatgacgaaaattctgttaatttcatgcatttgtttgataatctggaattgacggattctgaaaatctggccagtctaagggaaattgagaaaatagttgcggacacctcaccaccgccagctggtccatcgccaattgaaagctcagttttggggtttgtgttcatctcacaccccatactgtgggcactggtacaaccggacattttgggcgaacgaaatgagctatcggaccggaaaaatttaagcttagaatcggatcagttggtcttccaagtacaccca

SEQ ID NO: 63832 - DNA, 509 bp, Heterodera glycines
  Genomic contig location: Contig_ID=SeqID_33909; Location=247..755; Strand=-
  SCN-specific regions: Sequence locations=1-151,175-180,220-509
atgggaaagagtttttatgaggagaaaaagcgcaaattcattgaacaatttgatgaatttaaagaattatatggtcaaggcaaacagaaagaatttgcgaaggaattgggcatttctgaaaagacattttggaattggaaaaaagaattggtgccaaattaccataaaagtcaaagtaagaatatatttttagttaaattaaatctaatttttatttaagagcaatatacaaatgaagctaaattaagaaaaatgagaaaatattacgaaataaaagaaaaaaatcagaaattgagcgatgtattaattgccaggaaattggaaattggatcgtcaactctgaaaaattggaaaaccaatttactacaacactaattgatcagttatgattgaacatgatggatgataatatgatcacatcgggcctctccccccgggcagtatctgttcacgagaccgatcgggtagagagagcctaagaattgtgtgattttctttcccggaataaa

SEQ ID NO: 63833 - DNA, 717 bp, Heterodera glycines
  Genomic contig location: Contig_ID=SeqID_33910; Location=151..867; Strand=+
  SCN-specific regions: Sequence locations=1-33,74-83,242-251,442 -534,703-717
  Gene Ontology: Mol. function=cytoskeletal protein binding; Cellular component=cell-cell adherens junction; Biological process=protein biosynthesis
atgccaagagagagagaaagaaatgccaatgccaagagagaaagaaagaaatgccaagagagaaagaaagaaatgccaatgccaagagagaaagaaagaaatgccaattccaagagagaaagtaagaaatgccaatgccaagagagaaagaaagaaatgccaatgccaagagagaaagaaagaaatgccaatgccaagagagaaagaaagaaatgccaatgccaagagagaaagaaagaaatgccaatgccaagagagaaagaaagaaatgccaagagagaaagaaagaaatgccaatgccaagagagaaagaaagaaatgccaagagagaaagaaagaaatgccaatgccaagagagaaagaaagaaatgccaatgccaagagagaaagaaagaaatgccaagagagaaagaaagaaatgccaagagagaaagaaagaaatgccaatgccaagagagaagaaagaaatgccaatgccaagagagaaagaaagaaatgccaatgccaagagagaaagaaagaaatgcccatgccaagagagaaagaaagaaatgccaagagagaaagaaagaaatgccaatgccaagagagaaagaaagaaatgccaagagagaaagaaagaaatgccaatgccaagagagaaagaaagagatgccaatgccaagagagaaagaaagaaatgccaagagagaaagaaagaaatgccaatgccaatag

SEQ ID NO: 63834 - DNA, 617 bp, Heterodera glycines
  Genomic contig location: Contig_ID=SeqID_33911; Location=28..644; Strand=+
  SCN-specific regions: Sequence locations=1-51,86-339,362-413,437 -481,503-617
atgggcctcggcatatatctcttggttagctcggtttccttcatcttcggagtggtgggtttttgggggtgggggaaatcatttattttgtgtctaatttgtccccacttccctttcagtacgcagggctcatgctgtcaatcaagattattcgtgagtgccgccactaatcatctcgcacaaatttaaattttgtttttacagttacgtttggcacgtgaacggggcgtcgccggcggtgtgggcggagatactggtacagcaactggcagcactcggacaagcagtggacgcaaatctgacgacgacgaatgccgacaacaaaacggcgcctgggaatgcggccgccagcagctctcaagcagcgacagtgactgactgaatgacgcgtggtcggatgagccatgcatggtacaacaacaacaacaataacaacggcatggcatgaagaaaaatggcgatcggaatggacgagaattttgcagaggatactaattaaaaagcatggataattttccgcattaaagaaatgttgtataatgaaattaagcccgtcaaatccaactgatttgtgtatgaatttccacactaatgcatgccatcatttgatattacca

SEQ ID NO: 63835 - DNA, 210 bp, Heterodera glycines
  Genomic contig location: Contig_ID=SeqID_33911; Location=852..1061; Strand=+
  SCN-specific regions: Sequence locations=1-17,44-63,87-210
aagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgg

SEQ ID NO: 63836 - DNA, 794 bp, Heterodera glycines
  Genomic contig location: Contig_ID=SeqID_7097; Location=303..1096; Strand=+
  SCN-specific regions: Sequence locations=1-383,405-478,500-794
atgccaactctgttttttaggctcaattcgtcctttgagccgtccaaggcattcccatccgactcgccgttggccagctcaatcagttcgctccgtgaagtgttcgaggagttctttcccatccacggtgagagtgatcaaattgtctgatcagtgatcagagtgagcgatcaatagtgatcattgcttatattcccctcaaattaagtgatcgtcaaccgtcccccaaacatctctgatcatgctcaggtagatgtacttgaaattgaaaatttccaaggataaaaaaaagtcttactacgtccggactgatcagtgatcactccaacaaactcagtcacattttctgatcagttcatatgcttgggatttggttgaatatttgttaaagaaaaagttcttgagtctccaaatttccatcaaaaattgaagaactctctctctctcttccagtcccatcatgagctatagaattctgaaaaaattttcaatattttttcaaaaaaaacttgacatatttattcaaaaaatttgaatccgcgattgccttctattaactaattatcggaccatccaatgaaaacaagcaaattttgggataaaaaagttgacaaatcgcgtcaaatgtttgacttttcatgcggcatctatcagagatgtatcggaatttagaatgccgatttccgattgcttgttgccgaaattttcagtgaaaatatggaaattttggcctaaattcccgacgaaaatggaaaattttggaaatttggttagcattggtatgcttccaagag

SEQ ID NO: 63837 - DNA, 576 bp, Heterodera glycines
  Genomic contig location: Contig_ID=SeqID_7098; Location=630..1205; Strand=+
  SCN-specific regions: Sequence locations=1-204,226-484,506-576
atgctgttgaccgtcaaaagtgatctgatcggctccatcgcggtcaccatcgtttgcatggcggtcgtctgttccctgttcatctacagtcgacttggcgtcggtgccattgcgctgtgcatcacctcaatttgcttcagtcagtagtcgtcaatgttttttattttacggcattttatgccattttgtgctttttttctgtcattcatttcaaaaatcactttttcagcgctcgtcggtgtactcagttggtgcggcgctgacttggacccggtgacaatggtaagaagctttaaacgctgatcaaaagttaacggatatgggtttgatcattgatcaatttattgcattgatcaaacaatgcgtcagtcatcgattggattacggctatttgatcaactgactgattatagttttcctgatccttaatgacggatcaatgattcatcatcaaaccatttaatctttttggctaaactgattgattgggctgcttcccctgcatcgttttcaccacgagagaatttttaaataacttttaacgaggacataaaaaaaaaattttgattgaaaata

SEQ ID NO: 63838 - DNA, 718 bp, Heterodera glycines
  Genomic contig location: Contig_ID=SeqID_33914; Location=258..975; Strand=-
  SCN-specific regions: Sequence locations=1-193,217-430,452-480,503 -537,572-718
atgagagaaaataaaataggaatatacaataatcacttaaacgcatatgtgaccactgtaagttaaggaacggtggctgattgtgagaaaaatcctacggtagtaaagtattatcgtccaactgtggcacaaaaagcggtggcaaatgcgatggattcgcttgctacgagtaatggagtgacacctcgaaaagtaattaataattaattaattaatcctaacaacaaaaaaaactaaaattttgatataaaaattctttaatttctcctatcaatttttatttgtaaaaattaaacaaattgtttttataggattttacaaaagtgtttgcttctaaaaagtcgaaaaaagaattgtataaaattgcttctggagaaatggcaccccattttttgttgaacgttggcgacaatttttacgacgaaggcgtaacaaaagaggatgttgcagagcgttttgaacaggtaattaattgttaattaaggataatttataaaacaaactataccacaaagtatttatttaatacgggaaaagaatttttaataaaaaaaatatttttatataaataccaatggttttctttttatagaattttactaaagtgtacaattatggcagtttgaatgtgccatggtatacaattgctggtaacaacgattgggaaagcaaagatggaattgagccacaaattgaacacccaagtggcaaatggtaa

SEQ ID NO: 63839 - DNA, 637 bp, Heterodera glycines
  Genomic contig location: Contig_ID=SeqID_33916; Location=149..785; Strand=+
  SCN-specific regions: Sequence locations=1-348,372-637
gcacataaacgccgtgttggtcggaggtttcgatgtgtttttcactgatcgctacgacctcgccgaaagcgaatggacccaccgacgaatccacgggaatgacccccaattgtcgttggactcgctcagcccttcgaccacttattttgttcgaatcgatgttcgaaattcggacggaactgtcgtaaaaagccaatcagcttatcgcttcacgacattcggttggttcggcaaaatttgctttaatcgcctattaattcattaattgaccttaaaagagactttgccgcttcgaagagattttcggcacatcgacacattggcataccaacaaattgggcctggccgaatgcaaatccaatgggaattgccggaagcagtaaaaatgggatcaaatggtaattttgaaaagggaaacggaaataaaaggatcatttagggatcgtcatcttctacaagtacgcgttcgttttccttctttctttttgattttttgcactcattctcagttcggacactcgcgaacctttggaccgatggcaccgaattgacttggaaaattccgaaacggttcagatcattggacaacattggaaactatgaagagataaaccaattaagcgatcacttgaattaa

SEQ ID NO: 63840 - DNA, 567 bp, Heterodera glycines
  Genomic contig location: Contig_ID=SeqID_33920; Location=215..781; Strand=-
  SCN-specific regions: Sequence locations=1-305,327-567
atggcaacaatatgtgatgcatatagggaggacgaacacgttgatgaaaaggctgaaaatgcgcaattaattcagcacaaaattcaatcttcaagaaaaagcttatccaatttgacgaaaaatggcattcaaaacggatttaagcattatgttgagctggagcaccacttgggctcattgttatggtcttacaagtacaaaatccaagaaccaaggacggttgggcttcccgagaaggcgaaacagttgctgatgattaagcatgaaccgtgtgaagaagcgaaattgaaagtgaccagaatggagaagcatgatcagtcagatgtgggcgaaatcttcaatcaagtccaggacataagcatcggtgatcagtcaaaagtgatcgaaaatagaaaggacaacaaaaacaaggacaccagtgatcagtcaaatgtgggcgagattggcaaccatgtccagaacatgagcatcggtgatcaatccaataaggacggcagtgatcagttggaagtgatcggaagtggtaatgatgatcagaacatggctaacgacaatcaatcaaattaa

SEQ ID NO: 63841 - DNA, 341 bp, Heterodera glycines
  Genomic contig location: Contig_ID=SeqID_33920; Location=907..1247; Strand=-
  SCN-specific regions: Sequence locations=1-68,102-125,148-341
atgtacttggcgaataaggatgaatggcaggcagaacttttacaaaatgttggactgtgtaagttaacaattttttttcattttttaaaaaataatttaaagcgaattttgctggaatatacgaagaaataaaggaacaaatggagcgacaaagaattgtcgaacaatttcgtattgtgttgtttgattttctatggcaactgttcgacttgaagcaatctcaagtgccaaatttcacagggattcacaaaagcattcagaaaatatgggacaataccaacgaattgggattaggcaagttttaccatgatcagtagggctgggcattttatttaattaaa

SEQ ID NO: 63842 - DNA, 1080 bp, Heterodera glycines
  misc_feature (1043)..(1043): n is a, c, g, or t
  Genomic contig location: Contig_ID=SeqID_912; Location=148..1227; Strand=-
  SCN-specific regions: Sequence locations=1-2,24-573,596-1080
atggagctgctgagaagcacccaaaatctgaagaacagagaagcggagaattatttggtgcagcgaggcgtaagtttttttgctttagcgcctctgttgcactttaggcggcgtccaaagttgacttttaggcttccgtttgatgccacaaatgtaggcattgaccaaataaggaaaaacttatggtttaggcatcatccaatcagtttttaaatgtgtccaatcatctgtttttgttggccatataactttttttttacttgttcaacacttaacacattcttagtattaaacgaaagcttaaagtgcaaggaattcatagaaaagagacaaatattgacaccaagaaaaaaaaaaactgagaaaaagtaatttagcttttttcgggtatatttatgaataggtaactactttttgtctgttgcttagggcccagcatttagttctacagaaaattctacagactttatgctttcgtttgataccacaaatctatgcattgaccaaataaggaaaaattacggactaagaaactgaagattggacgcctaagtgcattggaggcttctaacttttaaaattttcaaaaattggatttgacatgacccatttttcagattgaaaagggcagcactgtaatggctgcaaaaaaggaaccaggaaaagggggatcaacagttgccacccaagtaacgaccaatgtaagtgaggcgttgtaacaaaatgactgacgatgggcatttaccaattttttccgatacttccgtgttttgctacccctcccccttcgaaaattgaaaaaaaaattcatattttggtagattctggtgtttgtttcgacctttgatgacaccatgttcgtgatcagtgactttgaaaaccccaaaatatgaattttccgaggggggggggggtagcaaaacacgggaataccttttttcccattttgtagctgttcggcatcgacatgaaacgcccagtgacccgtgtccgttacgaagtgaaaatcagcggacacattatgctccgaagcggagaagagntgattatcgacctaaccgagcaaaccaaatcgagttg

SEQ ID NO: 63843 - DNA, 1215 bp, Heterodera glycines
  Genomic contig location: Contig_ID=SeqID_912; Location=1459..2673; Strand=+
  SCN-specific regions: Sequence locations=1-213,235-254,276-447,487 -494,516-522,556-1026,1048-1215
atgtctgtcatccctggtgtggaccagaaatttagtcaaccaatcaacaaactcggtaagcacattgaaagcccggcacttttatagaatgggtcccgcgtggattttcggggtcgctaatcacgaatttgagacatttctgtaatccaattccaaatcctaacttaaatatgaaaaaatcgaaattcgatgggttttagactttttttaattcgagtttttggtgctttccttctataaaagtgccaagtgaaatgaagatgtaaaagctttgtaagttttgcagggccatttaacgagtgacgactttaaaaagcttctgtaatactatcgatggtagcttaaaaaaggaaaatcgaatttttttcgcaattaggtagtaagttgtttttgccgttttcagggtcggaaatcctattcgggaatccatttcggaccccaaaccccgaattcgaacaaaaaatcttagaatctgtataaaacgaacatattttttgctctttttcaatgtattatagtgaaggtgctgatgtccagcccagaatatgaggaagggaacgagtgagaacgaggattggatttggggggaaaacggaataagccaaaatccgggccctggataaatggcctccccaaattggtaatcccttgggcgcccactagatcgaatacgcgtgcggggatgggcgagaaggagtaaaatataagataaatattggccaatcacataaaataataattccgccgcgctttgctctcggctctcgctcgccgattaactgcccactcaactgactccttatcgagagaatgctcccgattaaatagttggacttatggaacggaaaatggaatggaagagagcggggatatgtgcttgggaaagagataaaacggatgtgattaattgcgctttacacgtccacccttccttaagtttgtcctcaaactttgatttacttttgagttggaatgaatcaaaaaataatcaagcatcaaaacgtgacagattgaccgaagtcataggaaattaaattattgatacataaataattcgatttcgactgaatacccgaaagttggtgtgaaaactgacgtggattaatttattctatcaacagggatgtctagaaacaaaactttgttttaatgttgtaaacatagttttattttgtcataaaaaaaggcacggattttcaggcgcttaatcgcaaa

SEQ ID NO: 63844 - DNA, 1170 bp, Heterodera glycines
  Genomic contig location: Contig_ID=SeqID_912; Location=3966..5135; Strand=-
  SCN-specific regions: Sequence locations=1-1170
atgccactggcacaaaattatgaagacctcacatcatcgcgcgaatccgccactgtcgacaaacattcgccattaactccaacaacgaatgtcgtcgttgaccgaattttttcgggtgatcctgaaatggcagatgaggatgggaagcgagtttctcgctctgaaaacgggcaacacattaaaaaaatgtctgtgaactcggccttggggtcatccgtcatgattgaaaataaaagtggtggcgataatgagccaaattatgaagagagtgaggtgagaattgaggtcttggacaaaacaactaagacggccttagggtcaccagtcatgcatagcagagctaatttagctataaacaatataacaatagagaatattgaggacattaatagctttttcacaacctttgaaaattattttgctcgaacatatcagattttgggaactttgacagaccctctgttatgggctatgttacagcccaaatctctgagtgaatcagagaatagaaaatctgaaactatttcaacggatgacaaatttattgttattcaaacagggataaattggaccttggcatcacgattaactgaagtgagttcttggcctcattttttgctgatgaaaaagaaatcacaatcagatgaatattttcgattgggtgaaatcatagatataaaagaatttgtggaaaatgagtcaaattctcttaatgcttctaacaaatttgcgacaaattttaccttgctcccagaggatggctgtgggtcaattgaaagaattctaaaatgcgaaaaaaccggcaaaataattgccgtcgatgtctgttttgatgtaggggagtcactacaacgtttctattcacaccagtttggatcagatgttgatgtttcagcaattgttgatgatgcttgggtagaagttattaccttaggttttcgaattcaaggctttgaagacagtctgtctactttaactggtctaaatacgttaagtgatgaaccaacccaaatagtacctcaccaatacattggaaccagcattgatttagttatcaagattgtcagacaaattgatccagtagaggaggattaccgtcaatggtgtgagtttctcgcaaaacaacggtctacttccaaccatgatcaagactaccatcaccgaaggtag

SEQ ID NO: 63845 - DNA, 524 bp, Heterodera glycines
  Genomic contig location: Contig_ID=SeqID_912; Location=6264..6787; Strand=+
  SCN-specific regions: Sequence locations=1-93,122-125,149-341,363 -420,442-524
atgacgagttctgcgaacagaaagtagaagtagcacagtattccaactttattaagatttgtttacatttattaaattcgcgccaataagttgaaattaaattaaatatttaattttttaagtgatttaatattctttactgactttaaaggtctaatttgtattttcagtgtagatttggccttcgactcagcagggataacttcggataacgattgtttattcaacatgccactaataaaagaaagaaatttgtcgttacctgctgcttaaaatttttttttatctttgtttcgaacatcatgcgaaaacccgctaacgggtataatcattattctcttttttaatcatttcttcacaaaaattaatgacaaaaaaaggtaatttgaagattttttttgtcaaattctttgtaaattaaaagaaaattgatagtacttaaatagaaaagcagacttagaaagaagattatgacttgtcaataattcgtcagttaagctgaaacttcgctgaatgaagctgaa

SEQ ID NO: 63846 - DNA, 1406 bp, Heterodera glycines
  Genomic contig location: Contig_ID=SeqID_7100; Location=842..2247; Strand=+
  SCN-specific regions: Sequence locations=1-11,44-811,835-1348,1370 -1406
atggacaagtgagaaagcggaaatgtttttgaaacatttaaaatttgtttttttcggcactttaaacgaccaaatttggttggacacgttggcatggcttgggcgtggagaggtcggcacgcacatggcgctggtcaacgcccgcttcaccgttctggcgtacacgcagctgcagcaaaggcaatggtggttgaaggagttgcacatctgtcagagggaaccgagagggacaggcgccgaactgatcagcttgaacagcgacggctcccgcttcatgtcgccattgcccaccgcacaattgccggaaaatgtcgtcggcttctccagcacattcaacatctggtcgacttcaacaattcccaattttaatttaaattgttccccatttttgcaggtatttcgacggtgaagtgatcattttcctgcaccgaattcgccgcctcttctccacggacgtctctctgcagttcaacattcggcggacgcaaactcgtggttggaaagcgatggcacgtcacatttggcccctgctgaagaacggactcatcatgctggtcaacgtaaagcggctgcacctcatcaggatgcacaaatacgtgtcgccgaccgtcctcttcgactgcgcagaacttttccaaatcagcggcactgttttgcccgagagtccgacaacttacagcaattcgccggacttgtcgacacgtttactgtacaactggctgcacacgcctcgccccgatggtcgtccagtggtattcaaattgagcaaatggaaatcaggatgggaaaatttcgtcaacgaattgatcacggtgggtgtggggtgggtgtttgatcgacggacggattttacttttcctcgttgctttttaattgttctgatcacatttttccgttttttagtccttcactcgtgcggtcggcccggtcaagtacatggtgctcgcttcgttcgacgtcaactacacccggcgtgaacaaatggtgaacattcggacggaggaaaagctgacgctgtcgagcgatgtgcatcaaaggccggatggtggctttgtgtcatctgtgaagattctacgctgtccagcggtgttcacggaagcgaacgtgatgtcctggttgcgtctgccgcgtgtggccagcgaatggcacccaaatttggtgaccattggcttttcagatgactaaattgggtatggacgagttgaacaaatttaagattcagtgttcttatttccttcgttttcagaccaatgccttcgaacagagaaaccgatcgggctgagaactgagaaggataactgcggatcaacaacagatgagccctaagcacaatggccatcgaatgaaattatctctgatcattattattcatatatatatatattgtatttgtcttggcaaaggaa

SEQ ID NO: 63847 - DNA, 421 bp, Heterodera glycines
  Genomic contig location: Contig_ID=SeqID_7101; Location=254..674; Strand=-
  SCN-specific regions: Sequence locations=1-154,189-421
atgccaaaaaggcaaaaggaaaagacactttcgagcctatttggaagccagaaaaatgccgaaaataaaagtaaaattgttggcacttttgagcaaaaattggaattactgaaaaaagcatttgcacagcaaaaattgggtaagagaggaaattttcagggattttaaaatacaaacaaaatttttatcagaccaaatgatatttgaagaatacaaaaacaacgaaaatttgacactttttattgaaatgaaagacaaaataaattttaatgaaaaaaatgcgcaaatatttcctaccgaaaaatggcacgcattgaaatttacggaagagatggaaaactaactgattgaaaccgataaagtaatttaaaatcaaaaaaaacaaaaagtaataatattttaagttgaaaaacgcattaaa

SEQ ID NO: 63848 - DNA, 608 bp, Heterodera glycines
  Genomic contig location: Contig_ID=SeqID_7103; Location=363..970; Strand=+
  SCN-specific regions: Sequence locations=1-65,88-229,251-345,385 -481,503-575,597-608
gttttccaaactgcaaatttcgttcgaggtattttttgtctcccatacagccaaaatctaagtgtcattaattttttccctcccaaaggtatcgaggccaagaggacaatcggcacttttaccgtatcccgaaaagaccgcccattctgcgccaggcatggctttgtgccattggaagaagtgaggagacggtggtgagccaggcaagcaaaagcatcccccgtgggagaaggggcgggggacggagaggcaaaacaatttggcactaaattgctttttattgacgggaaatgccgcgggcgttggcgtttttcgcagactttttcgttttatgtgttttgttcgattttaaattttatttataaataaaaaaacattttaaatgtaaatgatgaatggcatttcttcagctccgaatttgttctgcccatttttacggaggtgaaaagcacgaaggcgacatcccggtggcggacccccaggcaaatttttcttaattggttattaattacaattaatggttcaaaaattgcagattgacccacccgaattcatcgaacttccgccaaaagaagtgcgctcttccgaaagaagggcccgcttaaagg

SEQ ID NO: 63849 - DNA, 54 bp, Heterodera glycines
  Genomic contig location: Contig_ID=SeqID_33923; Location=754..807; Strand=+
  SCN-specific regions: Sequence locations=1-54
atgtatttttctcgatttagcttacatgctgtgttttgcggaccccctcctgct

SEQ ID NO: 63850 - DNA, 746 bp, Heterodera glycines
  Genomic contig location: Contig_ID=SeqID_7104; Location=218..963; Strand=+
  SCN-specific regions: Sequence locations=1-131,153-387,432-673,697-746
atgaaaaatgccaattcggtggctttgcccttctgtccgtccacttcggctgcttctgatggggccaactccgaagcgaaccgtacggacaaaaagcgacgaattcacacgcgaaatgtccgatcagtgatcagcagcatttactgcagacggaaaaatgcgacgatcggcagaccgtcgatcggctgttggttggcactgctgttgccgctctcctcgttggcacttgtgttcaacgatcagttggaccaacagagtccggtgttttacagtgccaagaaaaagctaaaggaacaggtggaaaattcaaaaaaaaaaaaccaaaattactggaaattcacaacttttcaggaaatcattcagaaggtcctccgagattatggtgagattatttattttcatataaatttataaaaaaaagttattttaaagattggcgggttcgtccccgaggcaaaaatgactcttggcaaggtgaggagaagcctaattagtgacgaattgattagacaattaacgataatcattccctgctctgctcagatacgggtggccctgtgattgtttctgtaaatgtctgttaccactgttgttttttgaccccatttatttatgtcgacagatttatctccgctcaatctccaaaattgatgacgtcaacatggaatgtaagcttttgggaagtgattgagacaaaacatcaaattcgttcacagaaaatggacatttgggcatcaaaaaattaa

SEQ ID NO: 63851 - DNA, 1862 bp, Heterodera glycines
  Genomic contig location: Contig_ID=SeqID_7105; Location=555..2416; Strand=+
  SCN-specific regions: Sequence locations=1-741,763-767,789-833,925 -1025,1079-1124,1146-1269,1292-1862
atgcctcaacttggcgtcagtttcatctactccaccatttacgagaaattccgaaatgttcttcatgttaatgccaatattcaatccgcgcccgttgtctctgctttggccggtgagaacaatcaaatgccattccaaatttgttggtattcaggcggattttctagcattttcactcaaataatattcgtccctaccgacatcataagttatcttcctttttcattttgcaaatccgtcccattcactacggtttccctccgttttagtcagcatatgatgatctacaataatcccgcaaaatttttgggctctgctaaaaatgttgccgttttggacttcgtgcgaacggatggaaagtcgggccgtttgacctttgggcttcgaattgtccgagcggtttatcacatcgatggtttgtaaagggaacaattggaaagaaaaaaacatttggaattcttggggatttgtttttcattaatttatgggaattccttcagtttttaattgagaagggaatttcgccaattgtaactcggaaaatacatacggtttttatcagtggatagagcatgaccaatttgtaatgtgaatttttaatttttttgcctaagaaacttccctgggagttaaaaagcctcgaaattgggttttttagatctgaaggcacatttcatttctgaatgactgccaaccagggctggaatgggggtccgtccgccggtggtgccgacaggcgccgccgggaaaaattttgaaattttgagtgaatttgttaacagattttgtccaaaatatgtcaaatcattggttaatttattggtctatggacgttttaaaaataaagaaaaataattttcaatgttaggaaatttcttattaattaaatttcaattaaaattatcaaaacaaaatataaaaattctcctatcccagtggtgaattgaacccaagggatagacaacgaaagacagaaggcttaaccaccagaccaaatatatatgcgtccttctttaacagaattgaatttatttatttaattttttctaaaaaatttcttttcacacaccaatttcctattttcgtctcagtaaaaattccctatataaaatgcatcacggatcaaaatcacggaaaatttgaaaaaatccgtgacccgtgatccgagatcacggcaccccaaaaaccccgtgattcccgtgatccgtgatcacggccagccctgctcgggtatcacaatgggtttaagcaggttgaattaagctattcaaaaattttaaaaattagacagcgcccaattcacatttcgcgaggaatggtgggaccctcggctggcctatggccgttttgcggacgatgaaactgaagtgccggcttttgttgtgttggccaccagcgaacaggctgatctgactcaacagatttgggcaagtgttgaaacttaatcggcagagatcggcgattgtactgacaaatcaaaatagacaatcaatgctttgatattgattgatcagtcgatttatgattgacgaaaattatcatttcaatcacttttagatgccggacactttcttccaaaatgaaaagtaacaagcaaaaaatctgttcattttgattgtttaaatggccatttagagaggcgagaaggcatttgattgataagccaaatgtgctgatcagaatccatccggacggacaaatcctttacagtgttcggtccgattttgttttggctttctgtcgtgtttaactgtgctgttttcagtctctctctcgtcctttcatgtcccatgtctttggagtactatccgttggaccgacaaacatgcttaatcgacttggccagctgtaagccaaaagaa

SEQ ID NO: 63852 - DNA, 900 bp, Heterodera glycines
  Genomic contig location: Contig_ID=SeqID_7106; Location=86..985; Strand=+
  SCN-specific regions: Sequence locations=1-777,857-900
gctgtggacgtttggattggcgtttgtatggcatttgtaagatgttgatcattttgttgcactgaaagttcaattaattttaccaattttaatattttgcagatttttggcgcactgctcgaatttgcgctggtcaattacgcggctcgtaaagacattagcacaacgcaacagcgaatggttgtgcctaatgagataaataattgtcaaaaataaacatttaattatactttgtctattggcacacatttgccgtgtccctttttgaaaagccgcttaagatcaaactgcaccaccagtacagcacggtggtccaccaccaatccgtcgatgcttctgccgccgacgcgaaccaaagtcggccgccgcccggccacacgttccaatcgctgctccatcccaccccaaccaccggtgccaatttcggctctgtccgtcactcgtccacggcatcgcatcgcttcgtgccgcagagtccgtcctccttgccttcccggcgaccgctcggcatttgcttccgcctgtgctgtcggctgttcgttcgacgatacaaagagcgctccaaacgcattgacgtcgtctcgagactggtgagaaagcgcgggatggggccgggaaatgggaccaaattggacggagagaatggcacggagtcccgagagggggcagaagaaaggaagaattagatgcctatttaaaaacatttttttaggtatttcccatcggatatgcatgtttcaatggtatttgaaataaatatttgtaaaagataattgcaaaaattaatttaaattttaattttctaaattatatttttaaataatattatatagattatttgtcatttaattataaacattccctgcaaattcagtgctttattgggccgtctatttgatg

SEQ ID NO: 63853 - DNA, 304 bp, Heterodera glycines
  Genomic contig location: Contig_ID=SeqID_33932; Location=382..685; Strand=-
  SCN-specific regions: Sequence locations=1-304
aaaattccctcaaaaataaaatgtctattgcgcaccgccctccctatcatgctcgagagcatttgtatgtgtataaaatttatcaaaaaaagagatagccatttttctgggataacctctaaatataaaaatcctctgtgaaataaaatggcgattgtgcactgccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 63854 - DNA, 50 bp, Heterodera glycines
  Genomic contig location: Contig_ID=SeqID_33935; Location=181..230; Strand=+
  SCN-specific regions: Sequence locations=1-50
atgagctacaaatggattaaaggacgtcaacatcaaggatcctgtcactg

SEQ ID NO: 63855 - DNA, 234 bp, Heterodera glycines; identical to SEQ ID NO: 33936
  Genomic contig location: Contig_ID=SeqID_33936; Location=1..234; Strand=+
  SCN-specific regions: Sequence locations=1-234

SEQ ID NO: 63856 - DNA, 546 bp, Heterodera glycines
  misc_feature (5)..(5): n is a, c, g, or t
  misc_feature (7)..(7): n is a, c, g, or t
  misc_feature (16)..(17): n is a, c, g, or t
  Genomic contig location: Contig_ID=SeqID_33939; Location=848..1393; Strand=-
  SCN-specific regions: Sequence locations=1-257,279-471,523-546
ctcancnaactcagcnncaggagtcaaatttcgcttcttctatttcggcggcaacaacggggctcgactttgggcaaatgtcaactcaacaaccgacacatcagaaccgttccgaagcttctgatttcttttcgccaattgccgcagcgacaatggcaatggatgtggaacaaaagaaaaccaatccaaagccgagacagcagcaaaccgacgcctcgaatttctttggacctatttcagcggcaaccatgggaattggtgcagaaaaacccaagccaaagatgaaacaacagcaacaaggggtcgcctctcagtttgcttctgccatttccgccgcaacaatgggtaggagcaatgaacaacctaagcagcaacctccgatcgaaaaacagaaggaacagacagacgaagaaattctggatgaatttcttgagagtgtttcggctgcaactacctatttggatgtttcgcagaagaagaagccaaagaagaaaggaaagaaggaagcagaagatgaagaagcggcagcaattgcatcgatttccc

SEQ ID NO: 63857 - DNA, 559 bp, Heterodera glycines
  Genomic contig location: Contig_ID=SeqID_33940; Location=195..753; Strand=+
  SCN-specific regions: Sequence locations=1-21,44-191,214-250,287-559
atgatctcttctgggttaaacgaaactgagaaaatgaaagagcatttgaaacaaaaatatgaagcccatcttggcgttatgtatttgatggcagagaattggcaatgtgacaaaattgctcatcaattaactgcaaatgaaaatggaatgaatgtcaaaaatatcgtaaatatgtggacattttctatgaatattttttccgattgtatgcttatggtttgtttgatctgtacataattttgaatttgtctttttattaaaattaattatgataataatttattaagctaaaaatttgaacgtgtctgaacaattggtaccattgatgaagccattacttattacagaaatttctctggacagtttaattggagttatcaaaaatttgaattatatttcgaaatgtttttggcaaagagataaaaatgaaccatggaatttcaattattgggagatggatttgataaatgaggatgaattaaattatgaaataaaagaggagaaaagtggggaaaatccatcaaaaaatgaaattgaaaaaaattgcaaaacttcgtaa

SEQ ID NO: 63858 - DNA, 117 bp, Heterodera glycines; identical to SEQ ID NO: 53938
  Genomic contig location: Contig_ID=SeqID_33941; Location=72..188; Strand=+
  SCN-specific regions: Sequence locations=1-117

SEQ ID NO: 63859 - DNA, 412 bp, Heterodera glycines
  misc_feature (371)..(371): n is a, c, g, or t
  Genomic contig location: Contig_ID=SeqID_33941; Location=635..1046; Strand=+
  SCN-specific regions: Sequence locations=1-412
tttccaccttcaattccgagcagtccagcggccagcactcgcgggccgagagctgtctcgaattggaagcgctcgccgccgtccatcgattcgcaggaattgtgcaggaaattgctgtgtccgaaatggtgcccaacgccccctccccctctcacttccccttccgttcagctcccccgcactgccgatttgatttttgtgaatgtcaccactttggagggtccgtccgccgtttgtttggcatttcgtccatttccgtccctttcagcgcagccgttttgtctcgaattgacggcgaagggatggcgcgtcacttcgctgcgtaccgattgcatgcagggcgacttcacccgcatggaattgttcaccanttactatcaatcgctgcatcagttgatggacgcaatttcac

SEQ ID NO: 63860 - DNA, 887 bp, Heterodera glycines
  Genomic contig location: Contig_ID=SeqID_7107; Location=24..910; Strand=+
  SCN-specific regions: Sequence locations=1-89,126-202,236-265,360 -374,474-887
atggcgtccacaatctttttgctaaacattgctggacaattgcaaattcgccgtgcaaatcgcgcggtattccacaaaaaaaattgccgaaattaaatattattaaaattgttttagaataatttgctgacatcagttttaattatcaatgaattatttatctcatttttgccacattttcttccctttatttgtgaaagggtaaatttaattaattatttaaaaatatatttttcttatactaacttaatgaatttaatctcggttattttaactttttgtaatataacaaaaacatataaaataaaactatgctttttttattatcatttgatattaataattgatattaaataattgcaaaactatatttgttatttttgtttaaattatttctttttttaatataattaagtcatgatttacatttattttaaataatttattttatattacctaattttttaatttaaaaataaaaaaatcttttatttcattttaaacgatatttcgcaggtttttggtgccggttcatcgcttggcacaggacctttgtccgagttgatgaactcgttcgaagttttgtttttttcttccatatattcgtacaagttttcggcacggaacaacacatcaatgcatggcacgggaggaacatttaataacaatgccgtacaacaatatcaacaacagtcatactgtatggagatgaattacagtaggcagaatatggaacgaagacgggctgatcgtgtggtaccaatggcaccgggacaacctcagccggcacaaatcctcatccgccaagttacgccagttgagaatgtaaacggcaggcctagaacatcgatggcacgcttttgagaagagtcgagaaattttttgaa

SEQ ID NO: 63861 - DNA, 882 bp, Heterodera glycines
  Genomic contig location: Contig_ID=SeqID_7107; Location=997..1878; Strand=-
  SCN-specific regions: Sequence locations=1-670,692-731,823-882
atgaatcctcagcaaaagctcactcataccgcggtgattggacgggcagtgagtagcagtggtcggccgggcacttggcaagatttaggacgggtaagtcgtacaaagtggcaacatcctgtttagattagtatagatccagagaatgatcccttgaaaataacgtatcatggaattcaattcttgtctcccgaattagaattaagtttatttgcatgaaaattactggaaatcatgatctcaaactgattttaggcggttcagaataccaaaaaagtttcactctaatctagtgaataacattggaatctattttccgaatttaaccattttcattggatttttactgaatgcaaattctgatccaattataagccaaaaaatctagatttccagaccctgcctgactcagaaatccttcagatacttgaatctaacgaaaaagacaacttcaatgccatcgaccctaatttgtttgttgacccgagcacaaaaacgattttggctccaatactacggctccttttggatgggcattttccaagctattttttctttcccaaaaaaaatatccaatgcaaaaaaagagatattttatcaattgtaatctctcatctctaatggattaaaaattttgattatagcaaaaattagatttcaataatcaagaattttgtaaaactaaaaaatagatttcgtttaaaaaatctgctaacttttgagtttttgagtataatttataatgaatatttttgaaatattttaaaatttcattatttcacttaaaataatgatgtaatgagattttaaattaatttaatagacaaaacttggaatcaagggtttttgtcttcttcaaataattacaatcaatgaaataaa

SEQ ID NO: 63862 - DNA, 212 bp, Heterodera glycines
  Genomic contig location: Contig_ID=SeqID_7108; Location=938..1149; Strand=-
  SCN-specific regions: Sequence locations=1-15,37-212
catcccactttgtacaacattgttctgaaaagacctttcaacttcttgttaacgacatggagcagtacaatgccagagaaaattcagagattaaatctgaggccagatttggattctccggacttgatttggccacaaaaaccgcttttaataaatttccaactgatcaaagcaaagttttgacccgtacaataaaagtgatcgggttttga

SEQ ID NO: 63863 - DNA, 568 bp, Heterodera glycines
  Genomic contig location: Contig_ID=SeqID_7109; Location=495..1062; Strand=-
  SCN-specific regions: Sequence locations=1-100,136-155,215-296,318-568
atgttgctactgccttcatttttatgtccacattgtctggtgggagttgtggaggtgcaccaacaaattacctaatacatttatctgcaatataatcaagaaattttgtttattttttgaaatttaaaaaaaaatcaaaaagaatttccactgactatttaataaaaaaaagaattttttcaaattaaaatatattttaatttaatttaattttgatatttcggcttcgtcaaatttttagaaaatttggatattttttgagtttttaacatcaaataacctagataatgaagctgctgatgaaaatggtgatggtgccacaaatgttggatacatccgtaaattgtcaaatgccgtggttggtacacttggggcgatggcctcgataacgggcgcatttggcataaatcaaaatgggaacggcacacagaacttgcattggcacaaaacgggacaccatggcatttgcaaagtggcatcgaaatgtcggcacgcatgccgatttttggaaaggtcaattatccaaaaagcccaaaacggcactattgggaagttaaaaatggcatag

SEQ ID NO: 63864 - DNA, 194 bp, Heterodera glycines
  Genomic contig location: Contig_ID=SeqID_33942; Location=120..313; Strand=+
  SCN-specific regions: Sequence locations=1-194
ctcaagcatctgagttgccatattactctaaacatatttttgaatagctaaaaacccataaaagcctttaaatttaacgaagactccaaaaacaacaataaattgccaaaacttgcaaccatctcctccaagttacgaggagtctgacaaacgacagcgagagcttttgctgaactaccaagaattttccaaaa

SEQ ID NO: 63865 - DNA, 100 bp, Heterodera glycines
  Genomic contig location: Contig_ID=SeqID_33943; Location=389..488; Strand=-
  SCN-specific regions: Sequence locations=1-100
atgggaacaattgatgtgattcgacgggcccttttgtgcatattttggccaacaccggaggaaatactttgtcgaaattcgggtccaatacatttgaaat

SEQ ID NO: 63866 - DNA, 443 bp, Heterodera glycines
  Genomic contig location: Contig_ID=SeqID_33944; Location=38..480; Strand=+
  SCN-specific regions: Sequence locations=1-219,247-443
atggttatggaagtgaagcgacgcgagtacatcggagatggacagggtgacctcctcccacgggcttttgtcatacatgtgaataaaaaagaaaagccatcgtcaaacaaaaacatttttttgttttttaagagagaaaaaaatcccatcacttgttgcttcatattctgcggaccaattcaatggcgcatgaataatttcagctacattggatgatgagagaaataaaaacaaaaatgaataaattgagagaatttttgtttttagacacatcaaaactctgtccatcaaataacacagatgaattatgcaaatatgaaccaattcaattcttttcctacactaaacggtcaaaaatacacttataaattgttaattatagtgaacttttttgtttgattttaggcactttgtataatcaccagcaacaaaaacaacaacaa

SEQ ID NO: 63867 - DNA, 67 bp, Heterodera glycines
  misc_feature (67)..(67): n is a, c, g, or t
  Genomic contig location: Contig_ID=SeqID_33945; Location=724..790; Strand=+
  SCN-specific regions: Sequence locations=1-67
gacataaacatttatttgatttattttaccatattcacaatttgatcaaaatataggtggtcaaaan

SEQ ID NO: 63868 - DNA, 596 bp, Heterodera glycines
  misc_feature (62)..(62): n is a, c, g, or t
  misc_feature (133)..(133): n is a, c, g, or t
  Genomic contig location: Contig_ID=SeqID_33946; Location=4..599; Strand=+
  SCN-specific regions: Sequence locations=1-59,91-335,360-488,510 -515,549-596
atgtcggggttgggatcagggacgggcgaagctcggcttagtactcgaagccgaagcccttntaataaaataaatatattgaatataaaacttttggttaccggcgatgccggtggcgcctccggggaaattntaataggcactagtgctgctcaagagtctcggtctcgagcaaatttctcgggttttttgggctcggtctcggattttaagtctcggtctttgagactcgagaccgagacttttacacccctaatgtttgcttttggtaaatttttataaattttaggtctttgttcaatcttgtcgccatatacgtggtcaagtgggttgtattcttggatattttctttatttttgcgttggatctgtcggcaatttcatcgccgacgagagtgccagaggagaaagaagcggaattttggttttcaacgccgacggcacggcgagggaattatcggaggatgaggaaaacgaatgggcagggggattttccatcacccccagccgaaccgctggacccgaacaaaaaaggaagaagtgccgaggcgggcgacgctgatcggaaaatccggagggaggacattcccggataa

SEQ ID NO: 63869 - DNA, 320 bp, Heterodera glycines
  Genomic contig location: Contig_ID=SeqID_33948; Location=172..491; Strand=-
  SCN-specific regions: Sequence locations=1-119,167-196,218-252
atgtggaacttgctcggactcatgaagtgttggagaagcattgcatttacagcagaggacgcttcgggggatggaagtacgaagtgtcaaaccaggaccattgcttcatccaggttggctttaaaaaattaaaaataaaaataatttaaattaattaattaattttcagggcaaagaattgtgtgatcgattgttgttggacgagcccgaaaaactgtacaaaacattgattcccgagaagagaggttaatgagaagaagaaaaagaagcggaaaagaaagagaattgaaggcaaagaaaaaaaagagaaaatgaataaa

SEQ ID NO: 63870 - DNA, 577 bp, Heterodera glycines
  Genomic contig location: Contig_ID=SeqID_33950; Location=142..718; Strand=+
  SCN-specific regions: Sequence locations=1-577
gttctcgaatcctttttggattccgagttctcgtcagagaacctccgcttctggtgttgcatccaggacctcaaattctctcccaattgtcaagttaaaacaaaaggccaacacattttggacgagtttcttgctcccggtgcgccctgtcaggtcctttcctccgttttttgcttccttcggtcaatttttacattaggttaacgtcgactctagaacgcttgaagaaacattacgatgcttggaggagtcggaccaagcattgcgaaaccagaggttcgctttctcagtttcggaggaacacgtgttcacactgatgagcaaagactcgtacccacgttttctccgatccggcatttacaaggctgttttggacgctgccaaggcaaagggtggcagaaaacggatcattgacctgatcagagagctgtcagggagtgccgtaaacactaagaaagtgcctgccaaataccacaaaacatcgcgggggagtgccgatgtggacaatacacaacaactgtcgttgaacgccaacaacttccccaaacagtgctcctccgactcattgcctgtgaaa

SEQ ID NO: 63871 - DNA, 1265 bp, Heterodera glycines
  Genomic contig location: Contig_ID=SeqID_7110; Location=322..1586; Strand=+
  SCN-specific regions: Sequence locations=1-15,37-232,254-693,722-1265
ggactggaaaaaactgagaaacttcattttggtggcggaaatactgactgggaagagcgaaatttgggcagatttaaaactaggtaattctgtcaatcattattacatttaggtaattaatttagtgaaactcgtttcgttgaaatattggactacgtttgcaaaagggattcatctgctgagattggatttagtggaattaaggatttgcaatttaaggtaatggaacgaaatttgtggcaaaaattccattcaaaatattcttttaagtgtcattctctgctggaagcccatgaagaactgcttggacaatggttttttgagcatcaagagaacggaccaactctcgggaaatatctttgcattgagaatcttaaactttgttgtgacgaaggctattttggctcggattgttctccatgtcctggaatgaaactctcgggcaaaccttgtttcgggaatggacaatgccaagtgcttttttccataaaaataattataaaaaagactaaaaattaagggcaacggaacacggaatggcaatgggacgtgttcttgccatgcgggttatgtcggcaaaatgtgcagcaattgcgattcgtcttattttgcagtttcgcaaaattcgtcttacatcgaatgcgaaggtcgaaaattcgcttgacatttttattcgttttctttaattgaatgttaaattaatatatttatctaattttttcgtaccctttcagaatgtttcgacggatgttctagtggttgtggcggtccgagcccaaaagattgtcggtcttgccgaattgggtataaaatggatcccgaaatcggctgtaatggttggtaccgcacggaaacaatgccagttgatattagccttgaaaaatttttggtggttatttttccaattgtgtaattattactgcagtaataatttgcacggtttcattatttaaggggtgggtaatccactattttaacattagacaccaactcggaccctttttattatttctgtttatttaaatgtccatctcttacattatttatccgctaattttgaatttctttccctcagatatcgacgaatgtgcagaggaagggaaatgtgacaagtccaatgaaaaatgtgtcaacactcctgggtaacttttaaaaatcgcatttgtgactgacaatttactcgttccctttgagttccttcgagtgccaatgtgtcgatgggtttaaacgattggactccggcgaatgttccatcgatgtcgaag

SEQ ID NO: 63872 - DNA, 823 bp, Heterodera glycines
  Genomic contig location: Contig_ID=SeqID_7111; Location=34..856; Strand=+
  SCN-specific regions: Sequence locations=1-823
atgttttgccttttgccaggccgagaaaaagctgaagtcggtcaaacagtcggagatgaaccgcgtcttctccgaggaagtgattcgctttgcgcaccaaatcagcaaaaaccattcggtggccagttcagtctattggcagcagggcgacccgtcgcggccgtacccaacggaggcaaatttcgccgtgagcaatttgctgttgagcagaacacaaccggtaaaaagcgaacactgcgtccaagagtgatccctttgctcttattttcagaatgttcccctgtcatttgcagcccaagcgactcccggcggaatgctcaaatcggtcttcaatgttcccggaatgccgcaaaaagcgttttcgccaagtcctcgctcggcaatgtttgtctccaatttgggcgcttcttccgcttcaccgagggggcgcccttccggaagcggtaaaacgggcgaagtgtgtcagtttaaatttcacctaaataggcgcgcggatggcttccccagcgactcgtcctaagattctccagcggagttcgtctcagcaaagcccccgctttgctcagatgggctttcttcccggccaacaacagccgtcgttgatccaacagagtccgagcagttctccgatggttcaaccgcctcagtccgtctccaatttcgtgtctccttccggacagatgatggtcaacctgccggccaatctcaaagcattttcccaggcgccatcgctcgacgtacaaaaaatagagcaaatgtcatccgaatcaagctcaagttcgagcagtggggacgaagcgagtccaagcggacaatgaactga

SEQ ID NO: 63873 - DNA, 767 bp, Heterodera glycines
  Genomic contig location: Contig_ID=SeqID_7111; Location=1219..1985; Strand=-
  SCN-specific regions: Sequence locations=1-706,729-767
gaacaaacggcacgagtccatcgcagaagcacacgtgtcgggatgggacatcgagcagatggagattcaggtggcacgccaaacagcgaaagtgccgatgaacgaacgaatgaatccctccccaaaaaggacagcaaatacgtcgtccaactgctgggcgattggcggcagaaccctttcgacatccaatccaccaactgcgagctgtgcgtgcagctccaacggaacgcggtctattggctggccgaactgctcgcgcccgccctcgtcaccgcggcactgacactctgcgcggtgctctttcagttggcactgccccaggcgctgctgctcgctttcagtctgttctcccagctgctggccatgcagctaatgaacacgcggatgccatcctacacgggcacggcaccggccatccgtaagcgattgattaatagcaattagccgtgcccttctccactgacgtgcccatttggccagtgaaatttgccgctttcaatttgctgtccaccggcgcccttttcgtagccactcttttgctccgccgtttctcacaaacgaattcgaacattccgttgccccgctccgtctacgccttggcctccattctcgacaaactgatgccattgccgaagggttccaaagaattgacggaggaaaatttgccgcagggaaattacgcggacattgcgctgacactgaacaatttgttgttttgtcttttcactttcacttacggatggacaatcattttcacactgatcatc

SEQ ID NO: 63874 - DNA, 831 bp, Heterodera glycines
  Genomic contig location: Contig_ID=SeqID_7112; Location=1..831; Strand=-
  SCN-specific regions: Sequence locations=1-342,364-493,515-831
tgtgcccttttgcttaggcgaagcgccgccgccgaaaccgccgcaagaagccgcttcccccgcagtgcaaagcaattgcgtggattcggacccgaagtgcagcctttgggcgagtcagggcgaatgccaaaccaatgcgatttggtgtggcaaaattgacaaattcaatttttacccaatttactctaaaaacgactgaccatgaaaataatcgtacaattagcatttgttacttgccaaccaacaaatcaggatgatgtccaactgtcgccgttcttgccaatcgtgccaggggggcgaccgtgcctggcaactgcgcacgcaattggccaaaagttatgacaacacgacaaataccaatgcgactcgaactgtacgcattgagtccgtacgcatatcacacatggaaatcgtaaagactgataacttattttgatcagtcaacaaattccccaaatatttgaaaaaggatgaaacgcgcgaattggcgcgtctctttgggcggttggtgctgtcctggaacgactcgaaagtcagttgggaccgcgaacattggggcgtttcctggctgaacttctattgggtccaaatttggacgcctcaattgatgcaaatcaattcgtcagttttcggcacaaaaattacacgtgtttaaagtggcacaatttaagggcaagtacaacgcccggacaaataaacggcaaagttttggcagcaaattacacgggccaagtgtacatgtggacaggtgagcacagaagaaagcggacaaatgggcgaccgacgatgccatgccaaactctttcagactccaattcgttgttccctacc

SEQ ID NO: 63875 - DNA, 573 bp, Heterodera glycines
  Genomic contig location: Contig_ID=SeqID_7113; Location=197..769; Strand=-
  SCN-specific regions: Sequence locations=1-8,161-416,443-573
atgaaccaagatagagggaaaagaaagagggtaagagagagagagagagagagagagagaagaaaagggagggagagagtgatggatagagaggggagagagaaagaggaggaaacaaagagacaaaggaggagagatgatgcggagagagaaagaaagaagcgaggggagggtcacaaggacaattattaattaaccaccgtttctccttttcagaattccgcacaaacgccgttcgaacaaatttacgaagcagccgattatttgagggaacagtcgccaattccgacaatttattcgacaatgtcaaacggacaaaagtcaaagccaaaaatgcgaatttattcggaaggcggcggatacgataatttggagagattaagagaagaaatccgaaggcaaaaggcggaattggaggggaaaaggagaaaaggaaaagaaacggaggacagcgaacaattggccaaaggcaaaaagccatggcaatcaaaaaaggaaacaccgaattgggcacaaaatgccaatgggacgacagaacacaacgaagagtttgtcggatggacgaaatgttaa

SEQ ID NO: 63876 - DNA, 489 bp, Heterodera glycines
  Genomic contig location: Contig_ID=SeqID_33952; Location=160..648; Strand=-
  SCN-specific regions: Sequence locations=1-125,148-489
atgaatggctaccaaccatctagaaatgaacacacaggagatgaaagtagtaaaaaaaagaggcacaatacaaattattttagatatgtaagtgaccggccaaatttaggttgacaatcgagcaaataattttattttgaatttaaatatcgaacgaattaaatttaagaaacattaaaacgttttttcgtaaaaaatgattattatcactgacgaaatcacatattaccaaatacaaaatgacaaattaaggcatttgttaaagtttcactttttaaatgacagatttataacggaaactccgaacagtttggcttatgtgtcgcaattacggagtttaatacagaaaatatgccaaattacataacggaaaaactgaaaaacgaattcaaaatttacagaaaattgtcaaaagacagcaagcacatgcttaaagtgtttgaaaggtcattgaaaccaaaaagattcttttttaacttcataatttaa

SEQ ID NO: 63877 - DNA, 1335 bp, Heterodera glycines
  misc_feature (32)..(32): n is a, c, g, or t
  Genomic contig location: Contig_ID=SeqID_33953; Location=57..1391; Strand=-
  SCN-specific regions: Sequence locations=1-442,464-1335
atgagatggctcttcgtgagcatctcgtcttnggggcagcggagtaatgccctagaactgtggaacaagtacaaagaccaaatgtacaatccacagggcatcaccagtgcggctatacgccaagcacgggagcaggaagcgctagccgacattgattggcgattgcacttctttaactcaagctgcgtgcactgtggcctcccagatccaccaaattcaaaagccaaaaatatcaatttggcagttgaagaagctttctttggtgatgatgatctgaatatgtcgcctggccagcaaaatcctaggcagcagcaaaacgctccacctccactcaacagcgaccaacaaacggtctttgatgctgttgttaaggcaattcagtcggacccaagggatgcgactgtacctcgccgtttctttatattcggcgacggagggaccgggaaaacatttctgtttggccaaattataaggcgattgcggaaggtcccatacacctacaaagtgcttgctacggcatccactgggtgtgcggctatcttgctgccatatgggaaaacagcccattccacgttccgtctaggcagagaagtctcgctagacaagcttccaagcattccgcttgaaagcttctttgcccgacggatacgtgaggcccaactcatcatcattgatgagatcaccatgctgcacaacacggtgatagaggtcatcgaccgagtgtgcaaagaaatggcaattccccagcacaaggacctcctcttcggaggaaaaacggtcatattcagcggtgactttaaacagtcactgccggtcgtgcctcacgaaggcctaactgcacaagttacggcctgctttcaaaccaatccactgtttggtcagtttaccacaatgaaattgaccatcaaccagaggttgggccaagggcagcaagcgtacttgcaaatgtgccgccaaatcggcctcggagagaccggagaacacttctggattcctccgcagttcctcgtaaagagcagggaagagttgatagactttgtctatccaaacttccaacaactccttggcaatgacaaagagctgctcaatcgtttgattctcgctccgcacattgacacgtgtgatgagatcaacgaaatcatgatggcgaatgtgcctggtcaagtgcgcgaatatttgtcctcggataagccgcttgacgagcgtccactggacatcgatgaaatcgagtccgaagtggcagcgttgaaccggcgcacagactctgggatgcctccccaccgtctgcgactcaaagtcggaagccgtcgttgttctccttatcaacaaaagtga

SEQ ID NO: 63878 - DNA, 393 bp, Heterodera glycines
  Genomic contig location: Contig_ID=SeqID_33958; Location=325..717; Strand=-
  SCN-specific regions: Sequence locations=1-393
atgccttcaaaggatcgaagaagaaaagaagcagatcgtttacgctggcgagcggccattcagacacctgacgtggccaatgctcttgggggtccgaatacaagtggtcaacaaccttttggcatagatcagggtttttgttgcttttcatatgataattaaaatctatttgtagaaccttcaacgtcgactggaattcgtgcccaaatcagacaactacgaaatgatggacaagctattgtgggtacgccggcaatgcaactggacaccagtgttgtttcgactccgaccactgtcggattacgggctttgactattgttggaggtcttaatttaagcaaaatttaaactaaacctatatatattaaacaaatgacaggctctacaaataaa

SEQ ID NO: 63879 - DNA, 864 bp, Heterodera glycines
  Genomic contig location: Contig_ID=SeqID_33959; Location=251..1114; Strand=-
  SCN-specific regions: Sequence locations=1-91,113-318,340-864
  Gene Ontology: Mol. function=protein binding; Cellular component =cytosol; Biological process=insulin secretion
atgagttcatctggtttattttacaatgctttaattcgacgtccaaatgagcgcaccgaagaggtcagttcaataagctcgtcagatttttcttcaactgtttggagttgtttaaatataaactcagaatatgaactatttttcaggatgtatctgtgatattcaaccaattgcgtcgtttggatgtttttgaacggttacacgactcccctcttcggagtgtttgtcgaactgcacgactggagagacacccggccaattatgtgttgttcaggtgggaagaaagcactgtttaaacggacttacagcatgagaatcatttcaaactgaaagaaaatcaattctttaataagtaaacctgctcatggatatattttttattttagaaaaggtcagttggccacttgctggtacattcttctgtccggatcggtgttcatgtgggtattcgttctttatgttcttatcccaattgctattgactttaattttctaaaacccaaaaatatacactgtaaaacgggatttatttttttaacgaattgaaaattccataaaaattaagatttcacataaatttggtagtttttgaaaaattggacagttttagacaagttattaattaatcactatttttaaataagttttgattagcagaggcaacataaaataatccctgaaattttcaggaacaagcaaatctacttgcccattggatggtatgtctgttttggattaattgatattatcttcatttatttgtcaatgctcaaaattagtcttcattttttgcaaacttccgccccgtttgcaccaattatttttttgaaaagttcaaaatggctacaaattcttgctatttag

SEQ ID NO: 63880 - DNA, 111 bp, Heterodera glycines
  Genomic contig location: Contig_ID=SeqID_7114; Location=1359..1469; Strand=+
  SCN-specific regions: Sequence locations=1-111
atggacccgaaattgtacttcgattcggacgatccccaatggctgagttggatcggacaattctcaaaagagatgagtcggtgttcgttgaacacggacgagctgaattct

SEQ ID NO: 63881 - DNA, 683 bp, Heterodera glycines
  Genomic contig location: Contig_ID=SeqID_7115; Location=1..683; Strand=+
  SCN-specific regions: Sequence locations=1-241,263-564,589-683
agttggatcggacaattctcaaaagagatgagtcggtctttgttgaacacggacgagctgaattctgtgcgttttgtgccgtcattgtcggcttaaaaccattttgaaattgtgccgaaatgttcaggtccgagtttgtaccagggaacagttttacggcccggcgggggtcgaagcgatgaaacgcagcggcgaattgtacgcagagcacagaaacggtgcgaaacagtcaaattacaaattaaaattgaatttcacttttattactgtaattaattcatttaatatacacaaattccctaaaaatattttgctattcttaacaaaaaaccctaattaattgaccttttgtggctaaatttgcaagaattacaattagttaggttttgtccgtctttttgttacattttcggcctttgccccccccccccttaagacaatgtcctcgtgttggtcagcggtgcgtcgtctgtccctcggggttcaaccaaagtgtaattaacatgcaattggtacaattgcacctgctgaaggttccatgctcacctcgtgctaccaagagtgggaaagtgtgaggtcagtgagagaaggaatgccaacgacggatttaaaacattcgcaattgcccaacaactaaattcccatagttctaagcattttcactctctctttttacttaattt

SEQ ID NO: 63882 - DNA, 1014 bp, Heterodera glycines
  Genomic contig location: Contig_ID=SeqID_7115; Location=3194..4207; Strand=-
  SCN-specific regions: Sequence locations=1-369,392-435,458-540,562 -1014
atgccacgcaatgaggtttctggggcgaaaaaaaaaattaaattgcaacataaggtttaataatgttttctttcaaatcttctctagtggaaaagtggacccgttgggaaaaattaaaaacaaagtgagaataacgctattttgcgacacgcttttacttttcagtttcgatctgatatgagtggaaactcggcaattagtttattttcttaatctttgattgttttcatttctattataatgttttttcgctaattgctttttttgcactcagcagcaaaaaagcggggaagattcatgttcttttgaggaattggaagaagagttggagaaggaagagtacggaaaagaggccaaaacggaaagggaagtaggacaaagagaagagaaagtcgaacagaaaattgaggaggacaaaaaaatggaggaaaaacagacggtgagaaatggcaaaatgccaaatacgaataaataagaaggttccattttcagtcggacagtcctcaacaatgccaacaactctttgacatgtttgctgatggggaggaagacggagaggagaaaatgggcgaacccatggaattggacaggtgccaaaaagggggaaaagcagacgaaaaacaaagccaattgtcataggatttccgtcgaaacgaacgcacaaacggtgatttgcacagaagggaccgacttgtggccagactcttccgtctcttcgcatttgaatgaagtgaattcggcattcgctgcctcgcgcacggaagcactgcgaaaactgtttacggtgagaagttggaccatcacattttgttacggaaactatcacccacaaatattcgtcctccaatggaggatttggcatcattttttgaccctttaaaagccttttaggagccgcaacgcttcgcgcaaccgttccaaagagacgcttgttcttatcggtcctaccgggcggagaagagaaaggccaacgacttggaatacatcaccgaaagacacgtaatccactggtaa

SEQ ID NO: 63883 - DNA, 856 bp, Heterodera glycines
  Genomic contig location: Contig_ID=SeqID_7116; Location=120..975; Strand=+
  SCN-specific regions: Sequence locations=1-348,371-767,791-856
atggcctggacctggatccaggaaaaatccatgcctggatccaggtccgtatgcaaagggtgattggtttttatgggtatttttgtttaaaaaatcctattaatcgcaaaaaaaagacaaattaaaaaagacacagtcaacctgtatcgaacttgtgacctaattgtaaggtaatgtaaatgttgatgcactaaccacaacaccaaaacacagcatggacggtaaaaaagaaaaaaaagcgacaataaatctttttatggataattacagaaaaaaattggcgttctgtcacaattaatttttatctttacttatctcaattttatgtactatctcttcattcttaataatgtaaaaaacaacatttatttcgccacatataactttttttctactcatacaatttacaccaaattttgcatatcgatagagaaaaacattctgcatcaattaataggtcaacaagttaatattaaaataggtcgaattagaaagttatggagtgattaaaatttttgcatttcttttcctctcgtgttggcgtactattttcacatctctaacacacaaaaaacatcaaattcgtaaatgctaacaattttggttataaggatacaaaatcactttggaaatttagaattaatagagaaattaatagttttagcatttttggtgaaaacagcagtttaggacttgagttataacgtgataaaaatttgaaagtatcacaacttttttctgagatgtcaaattgcttagcattcacttagaaaaagattctccttttcaaaatctttttttagataccaaatttgttcatttttgttgggaatgaagcgtgttatggctgatcaaa

SEQ ID NO: 63884 - DNA, 297 bp, Heterodera glycines
  Genomic contig location: Contig_ID=SeqID_33963; Location=476..772; Strand=+
  SCN-specific regions: Sequence locations=1-61,98-187,209-297
atgcaattagaaaacaaatttaagtcaacgattattttttgtatgatggctaatttagaacaattaaaagtaaaaaattaaattttaatttaaatttcaggaaatgattctcattttgaagcaccagaaccagatgctctgtttagcagccctggtcaacatagtgcttacacaacggagagaagctgatttccatagatgaaaacaatatattgtttgaccaattctagcgataattaaattatttaactattagattagccatattctacaatttttatactgcaaattttaata

SEQ ID NO: 63885 - DNA, 287 bp, Heterodera glycines
  Genomic contig location: Contig_ID=SeqID_33966; Location=246..532; Strand=-
  SCN-specific regions: Sequence locations=1-167,189-287
atgattgaaacaatgtttaaaaaatcgatttttgaacctcatgtcaagagtttatgttcaaaatcattaaaatatggtcacgtaatttttagtgttgttcaaaccgaaaaattgaatgaaagcaaaaaataattgaattttaaatttcttctgttgacaaaatttgttaaatcatataaatttcatattttgtcaaaatttttaaaatttaggcttcttttgatgtactaaatgcggtcctacataagaaggcatttttggagccattcaacggaatcgtaaactga

SEQ ID NO: 63886 - DNA, 238 bp, Heterodera glycines
  Genomic contig location: Contig_ID=SeqID_33969; Location=322..559; Strand=-
  SCN-specific regions: Sequence locations=1-93,147-238
atggcaaaatccggtgctaacttttcacctgacgcaatgccagcaaacaattccgaaggaatcattgtcgattcactttacttggcatggtagaaaaaataatttcattaattttttttctttatttattaaaatgtattaattaaggcaaaagtttggcgacccaaatgcccttctgttaattgttgttggacaagcctatcaaacatttgagcagaagcaagtggaatatttttaa

SEQ ID NO: 63887 - DNA, 312 bp, Heterodera glycines
  Genomic contig location: Contig_ID=SeqID_33971; Location=132..443; Strand=+
  SCN-specific regions: Sequence locations=1-263,286-312
atgccaaatccaaaaaagaaaagctggtgccaaaaccaagacagccgtggaggttgtcgacaggtaaagtaaactaaaaatatgccaaattaatcgaaaaagcaatgattccaattgctaaatttaatattaaagcagtttgtgaactacaatttaaaaaaataaaaacgattttaggataatccataaagtgtaagcaaataatattatttcaagtctccttatccttaataatttacttgacaattgaacgtttgtccataatttttatttatcatagattttcattatttacctcagtgaatttaaaaa

SEQ ID NO: 63888 - DNA, 616 bp, Heterodera glycines
  Genomic contig location: Contig_ID=SeqID_7117; Location=1378..1993; Strand=+
  SCN-specific regions: Sequence locations=1-140,162-546,568-616
atggcacgatgtgtcacgtcgatcgcgtttctccccattggagatttgacccccggaatcattgctctggacatggctctccctgacgaacttactcccgtccttgactggtaaattgacaatctcacaaattgtttactatttattgttctttaattgtttaataggttcgtcatgaactacacgggtcgtattaagcatgatggaagccgaacacgcccgcgatttgacccaaacatttggagtgtttacactcgaacactgcaaggcgatgaccggacgaataaccattcagaagccgcgaacagacgcctacaatgcgcatttgcctgttcacatccatcgatttggcatttcattgaccttctgcgaaaggatcaaaagttatcagatgatgacttcgcgaagtgttcaactggacaagaaccaccgcaaaaggcaaagaaatatcgtgaagcagaccgccgaattctcacgatggttcaaaattatttgccacttaacaacgcagacaccaacattttcccaattcatcaccctttcaatcatcattttattattacatttttgatcggaatttctcgaaattatgaaatgagaccgtgatttgaaacaa

SEQ ID NO: 63889 - DNA, 60 bp, Heterodera glycines
  Genomic contig location: Contig_ID=SeqID_33975; Location=1070..1129; Strand=-
  SCN-specific regions: Sequence locations=1-60
ttgcggtcgttcccgcacaacggaatggcacatcagcagaatggccgcagcgaatgccga

SEQ ID NO: 63890 - DNA, 285 bp, Heterodera glycines
  Genomic contig location: Contig_ID=SeqID_33978; Location=106..390; Strand=+
  SCN-specific regions: Sequence locations=1-285
atgacacagaatattttgtcggagcattttgaaacgcccattggccaactgatggcacaatttgacatacaaattcaaattcgcgacacggactttggtgatgctcggtttgtcgacatggaaaagaattggtcagctgaacctgttgacaatcgcggtgcctacaaagtgatgctccatccaaaagtgggcgcccgcagaattgtacatggacaagaagaacgttccagcagccaaatgagcaatcggcaaaatgaaatgttcggaaatcaaacagccttttag

SEQ ID NO: 63891 - DNA, 705 bp, Heterodera glycines
  Genomic contig location: Contig_ID=SeqID_33979; Location=102..806; Strand=+
  SCN-specific regions: Sequence locations=1-86,108-705
aatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 63892 - DNA, 286 bp, Heterodera glycines
  Genomic contig location: Contig_ID=SeqID_33981; Location=1..286; Strand=-
  SCN-specific regions: Sequence locations=1-239
atgttttttctggacaaattcctccaggggcttaagccccaattcgacgatgacattgtggacagactcaactattactacacgccaatgttattcatcattttcgctctcacattatccgccaaacagtttcgtttccaatgtttccatttccatggctccgtccgtcccttcagatacgtcggccaaccgattcagtgttggatccccgcacaattcaccggcgcttgggttttcacattttataaattattttattattattcgcatttaattatttaataat

SEQ ID NO: 63893 - DNA, 48 bp, Heterodera glycines
  Genomic contig location: Contig_ID=SeqID_7118; Location=22..69; Strand=-
  SCN-specific regions: Sequence locations=1-48
atggacaaaaaatggtacagcagagcgggaatttacgaaatggaccaa

SEQ ID NO: 63894 - DNA, 1467 bp, Heterodera glycines
  misc_feature (265)..(265): n is a, c, g, or t
  Genomic contig location: Contig_ID=SeqID_7120; Location=643..2109; Strand=-
  SCN-specific regions: Sequence locations=1-117,139-330,381-430,454 -481,509-638,664-702,744-822,844-884,945-1182,1225-1398,1423-1467
  Gene Ontology: Mol. function=signal transducer activity; Cellular component=intracellular; Biological process=proteolysis and peptidolysis
atggccgcaaccggagaaaagtgtggccttcgtacaaaaaattaatcctggcgcagccccctgcgccaatcgtccgtcgtatgggcctcgccctggcgcactccttgttcacgtatgattgtactgttttcgttgcataattagttctcttttttctccttattatactgagtgaaaaattgataaattatgtcagcaaaatgtcacccataaatttatttcctaccgactgtcaataactggtgatggaattcctacgctctanaaaattgagaatttcctagcttcagccgaaagaaccccacccaaatatggttgatatgggaaatgtttaaaattttaataaaattaaataaaattaattttacaaatttattaaactcattcaaatttgttgacttgcgatttttggaaaacataaaaatcattgaaactttaaaaaatttcaatgaattttcgcggagtaaatttttgaaaatctaaattgaataaatggagaaattaattttcgttttcaacatagaaagcttttggattcagggcctctaatagctcatcaattcgatcaaatgagattcatttgatcgaaaagtgtctcagggcatgtaatttccttgtcatccgccattataaaactcaattaaaattaaaaatatttaaaatcacatgaattcgatatgaaaatggaaaaaacattttcgctggttaaaggatattgaaacaaagaacaaaacaaaaattatttaataaaacaacggtcactaattgtgaagtactgtagttagtgattgcctctgagttttacctttttaaggtaccaatatgaatccagtaaacaaaatattaacaattttaaaggcaaaaaataaattaatatgtctgggaaaataaaaaaatttaattaattgtttaagtgttttttaggattaaataataataaaaaagaaaacttgcttgaaattcaattagtttgaagtgaatttgtttagctacaaaatattaggagattttataataacattttgtcaaaaagagagttaatatcaaaatttctaccaaattacaggcattttccacttccatttttggcgttatggaaggtggacggaagtcatcatcgatgatcgacttccatgccgaaacgacaatggccaattgctttacagtcggcctccgactgagtaattaaaataaaataaaatattttaaattttattatttttagaaatgtattttgggccatcctattagagaaggcgtatgccaagatgtacggcggttatgctgtgcttagcggaggaaaagttagcgactccctctcggacttgacgggagggattacggaagaatgggacttgaagagtctcgatgtcgccaaacgaagggacatggaattggtaataaaaaaaatttaaaatataagccatttttcctaaattccgcaaaagggtactaatgaaaaataaa

SEQ ID NO: 63895 - DNA, 362 bp, Heterodera glycines
  misc_feature (268)..(268): n is a, c, g, or t
  Genomic contig location: Contig_ID=SeqID_33986; Location=21..382; Strand=-
  SCN-specific regions: Sequence locations=1-164,186-241,281-362
atgtgtgcacgttgcggacgctttggacgccctcattcggagcagttgtgcgcactggggacagtgcaaaaagaggcggtaccaacgcgtgatgatgatacactgaagcaagcaagcaaatacaataagtacattttggtaagggaaatttaatgtaaaaaaattcaagggacaattgaaaagggtcctcccgcccgaattcatatttagaataaggaatttttgtaaaaaaaatttagcgaaaatattcaatttttttttaattttnagaaatttttttgaatttcacataaaaaactgggaacaagcttttgaaaaaaattttcaaacagaaaaatttcaagaaaaaaattcttaataaa

SEQ ID NO: 63896 - DNA, 361 bp, Heterodera glycines
  Genomic contig location: Contig_ID=SeqID_33986; Location=578..938; Strand=-
  SCN-specific regions: Sequence locations=1-361
caaaacgtcgtcgaacgaatttttcgaccataacttttttctttctcaaccaaattaaacattcttggtattattcgaaagcattcgaaaaatgctattagcctgcaaattttcaaaattttttatttatgcacaaaaaaatcagagcaaaaaaagttcgaattactggggttttgagttccttctggccataacttttttgaaacttaacgaaaatttttgtagattttgcaaattaataataaacacatagagctattgaacaacaccaacaattcttaatttgattgacagtgaacaaagttatggttcaaaaagtcttccgacgacgtttcggccgaagacgttttggggtgcaccg

SEQ ID NO: 63897 - DNA, 169 bp, Heterodera glycines
  Genomic contig location: Contig_ID=SeqID_33989; Location=719..887; Strand=+
  SCN-specific regions: Sequence locations=1-55,77-113,135-169
gtgttgtatatcaaattcaactcaaacaaactcgaaaaaaatacttgtttaaactgcagtgaaatggatttagggggattttaacctttaattaggaatttgatcacagttaaagaattaagacactttgttttatatttgaatgcattggcgttttttacgccaacaa

SEQ ID NO: 63898 - DNA, 1975 bp, Heterodera glycines
  misc_feature (955)..(955): n is a, c, g, or t
  Genomic contig location: Contig_ID=SeqID_7122; Location=221..2195; Strand=+
  SCN-specific regions: Sequence locations=1-202,242-1054,1090 -1138,1162-1339,1363-1509,1554-1975
atgacccgcccattacgcactcggaggaagagaaaatggtcaaagtgagtttcataattcaaatgtttttttgacatttgattattggcatcattccccaaaggtcaaacaaatgatctgtcgtctgttgggtgaaattgatggtcgagttaaacgaattcaatcgatgcgacgcatttccacggaggatcaagtggtgggcatttattgaattgaattgaattattttgataataaattggataaccgtttttttgcccagggcttcatcgaggaatggtctttgcttacatggaatgtgttgtgcatcaccagtcgactgcaaaacgatttcaatgcgtctgtgaagtcgcaggaggaccgggtcatcttcaacaagttgaacttggctttggtcgacctcgtcaacaactcggggtacaaccaattcataaataaccaaaattatttgacccccccccccccctcatttcagagaagctctgagtccgcctttgcttcacccggacgccaatttcgacattttgacgaattcgctggctgagaccatgcacattttgcacggtctttaccggacactgaagtcgaacatgcacatgacgcaggaggaggtggaacagttcgccatgaggtgggtttggctttggatcgggtggttcccaaatgattcatgttaatggattcatttggtaagttaattttttggcaataaaatgccattttcttgtttgccattttcctgccattccgtttcttccttttttacaccatctgctccctttttagacttcagtccttctccgaccagaatttgattccgtttgtggagatgtttaaggtgggtgcactttttggccgttcgttcggccttttctccccgaaccctctcgcttcagtccttttgcgttggacaaactgtccgtttgtggcaggacttgcgagatgtccagattgngtggtaatacacttacgcagtcactatgatatacattaattgcaaaacacacagaccccggggcatttttggccatccgtgggccattaccagtaattggaattttgtttacaaaattggcacacatttttctggcaatggattttcccccacttggccaatgcttttggggtcagtgtgcgcgggtgtgcccaaatgttggcaaactgtgcgctttcctttcccattccaatgcgcagcatcgtcaacaagcaaacgctgccggagcagcccgtggtccgattggtcactttttactccttccaaatgcatcgtttggccattttggctgctcggcttcaagtgagtttttccatctgtgttattacttggaacagattccgatttttaaataaattcaaaataaactaaaattaccttcaattaaatttcagggctttcgctatgaactgacggtgaacaatcggcaaatgtttggcgactacgaccccgtccgcccgttgtcggacagtgttttctccgcgttggaactgttgatggccgattgtggtttgtttataaaaatttattaatttttccccaccccctttttaatgtatgattaaattgttaatccaattagtcatttcttcaagttttggccaccgagccgtcgctgaacccaattctggtgaccaacaaccttttctccatcaattgtggtgcgttggctcgtggcgtggtgttcaagcagttcgacgtgcaggtggtcagtgaagaaatggccgaacatattcaggtcattggagtggagaggagaacattgaatcagccatcaattgacacaaaaaaaattcaattgtctttcagtccgaaatgcgtcgccaacgtttgctccagcagccgtctccgattgcccaagtgccggccgccgcactgttggccatgaaacccaccagtgggacgaagcgctccaacagtcaggccatcaccggtcagagggatgggccatcaaaaattgccatcattttggacgagtaa

SEQ ID NO: 63899 - DNA, 1760 bp, Heterodera glycines
  Genomic contig location: Contig_ID=SeqID_7123; Location=221..1980; Strand=+
  SCN-specific regions: Sequence locations=1-198,221-315,346-923,945 -1151,1173-1625,1648-1760
gatttgtcccccaacggaatggacatgaaaagtgccggaggtggcagcagcggaaagcggccgatcttctacttttacattcgtgccacgatgttttctccgtccggacggtttgcggatgcgcacacactttcgctgccgttcaccatcgccacacggcgtaaccaggactatcaggtggggaagggggggcgagcagtactttaattgtacaataatattaatggcatctccaaccaacccatgttaaggtgcaacgtatgatgagttcgtacaccgccacctgcttttggctgtacggaaacaacattcaagtaattttaaaattcatttttaatttattttcaaattgaggacggtttgctgttgcaatgggtggagacggcgatgggctgggagaagttcaagtttctgttcatgcagcattttcggatcaacgccgaggtggagcggggtttacaggacaaggacttcgacctgctccaggttgatgaacccttcttttgatatgaacatttttcaaattgttttagtataaaatccaatgcaatgactgttcccctccttcgtccacatttagtggagatcgtgagctttgtttcgcttaaaaattggatattttttgaaatttgataatttaattaaggcaaaatcaccttcaaaaacattctgtgtccccatttgcgttacgaatgtggctcaacgaatgtccgcttcagtgtgtggcgtggactgctcgaactgctccaactctttcaggttcaattggccgccgcgtcacaaataaaatttcattcaatgatttgacaatttaacaaaggacacaaaaacgtgcgtacgcaaattgtgggagaagcagttgatcatgggtttcatggaatttgaccaggcaatgccataaaaacctctaaaacgcgcccctccataaaaagaaaaggttaaggtgtccgacactctctcctcctatccctccgctttgcttatgcgtctgtcctttgtcaccggcggtaccatttgcatcactctcaagtcaaccgtccactcggaggatcgggcgccaagtgtaccaatgcatttggagccgttggacctgaaaaagctccaagccaaaagtctcaccgattatttgcgggacattgccgttgcggagaaggtaaattcaaaaacattaatccaaccaaatttaattgtaaagtaatctttcagatcaaatatctgatcaactcgcagggagagccggtgctgatcagcgacctgttggagcagttcagtgagaggacgggcggtggtattgaggagttggaaaccagccgatgcatttcttccaacgtcacacacagcggcgacattgacgccatgcaacaaataacgtaagtgcaattcgggaatgtttcgatggcgcgtgattattggtcacttttcccgtttttgttcagtttcaccgccatgcgaattgctgtggtgacgtgcaaagtgaagccgcccagtgccgatctgatggaatatgaggaggcggcgttgcttcgcggcgatgtgcagccgaaggtgcactcgccggtcccgtcctccagcaacggttacccgtctccgtctttcaaccccgcttcggtgttccccggcagcgccggcggtggtggcggcggctatcggctgccttcggtcagcgcagcaaatgacgattttgtgcgggaagtgacccaattgtgcaacttctggggcaagtcgaagcaggtcaattcacagttggcaaatttacgcat

SEQ ID NO: 63900 - DNA, 2895 bp, Heterodera glycines
  Genomic contig location: Contig_ID=SeqID_7124; Location=169..3063; Strand=-
  SCN-specific regions: Sequence locations=1-8,30-64,86-627,717-861,929- 958,1005-1010,1032-1175,1197-1237,1366-1443,1467-1532,1554-2146,2168 -2533,2570-2587,2611-2653,2675-2714,2737-2895
atgaacaaggttatagacaaaaaattcaggccatgcgaaaactgccggattttttgcttttttgaaaaatactttatctattttcctttaactccttccattttttcaaggctcaataccctcacaaggtcgcataatcgggaagggcaccttagcgcagaggtaataattgtatttttaaactgtttactgacataagcattttataaggaccaaaaaacatatttttttttattcaacttaaaaactgtttttcagtcgcgcagcaaatctcgtggagcgaagcccatgtacaatgcccagccacgccgaacgcagcccgaacaaatgctaagccttgagacggtgagttgatcagaaaaacggaaattatgtatcaaatttttacataattttacaaattttagcaagttgttctttgcccaaaatgttcactgacattctcttcacacagaagtttgagcctacacaacagaatacataaaaaaggtgggtaaatgacaatgtgcttattgaagaaaaaaaatgaaagaatttttaataagaaattgtgaatttttgaaaaaaaaattgataaaattccaaaatttattgcggcgctgcaaattttttgtcaaaaagcgagggaaaattattttctaattttttattaaaataaatttcttttaatgtgataaaaaaaatttaaaaattgatcattattttttgaattttttcagagaacccgaaggaaccgcggacgacgcgcagtgccggcactgacgctgccccgttgacgccgcctcgtcagcgcatggtcaatgtaagttttgggcggtaaaatttgaggccataaaaatggcacttatacagtttaggcccaaaaaaacaaatttatttttacaattttgaaatttaattaattgtttaattattaaatgaatttttacaaatgtcgcgggctcaactaaaattttcgtaatttttttattaaaattaaattcagaaatttaatttaattatttcatttcatttcatttttaaacaatttacagctcgacgagtcatcgggcccggacgatgtgtttgctgaagctcatccgatgcaaccggtcgctgctgacggtaagagcaaaagctcaatgcgaaaaaaacaatcgatcactggccaatcgatcagtggaaagtccattggcaaaaattaaaattttaaaaaacaacaaggattttccaattttacatattgaatttaaaaaggttttttaatttttaaaaataattaatttatcattatacaaaatatattattttaagttttttatcaaattagataattataattttttaatataatttaaataaaatttgttttcaaaattaatttttgttgacggattgtccacttatcaattgatcagtgctgatcaattgatcagtgacggattgtccactgataattttgatatttttgggtttttattgaatataaagaaatttttgggcagcgctgggcacatcgggagggaaattttgataaaataaaacgaaatttgttaaaaattttattattatttctctaatctttcattcttttaaggtaccccaacattacccggaggcattccccgcaattcccaagcccaaattgacgttgtccggaaatcgacgtcggcatgtggcaaaaaaaattcggtgagtaaatcaggttttaaacaggggtctcgactgaaaattttcaagatcagcattttgattttggcttaaaaatcagcatttcaaaattttattacaaatggttaaaaatcaacaaaaatgtttttttgcggcgcgcttctaaaaaatatattttttttgtggaatttggagggggaggtgccgatagagactatacataccgtatttgctctaattatcccccatgggggattatttttcaacctcctcgtagactgggggataattggagactgggggattaagatagagggattattcttcaaacccctcctagactgggggataattggagattgggggattaatggagattgggggataattagagcaaatacggtatattcaattttattccctcctgttcaaatggcacacacaaatgggagggtacgggttattttggcacgcgctgccatctttttgcgtccaaagttgttttattttaatttttgtaagccaaggcctcacccgaattattaaccgtatttgtgtgcctaatggaatgtgttatgcgtgccgttttgagcagattcatgtaaaaaaaagagttgggagaaggtgtggaaagaatggaatgttttcagcgctttgctttgctgcgttagcgtcgcttgacagcagcccaattgtgtgaattgcgctgtcgccgcgcctcttcaccccgccatttttgactcaatggagggggaattcttcgtgttttgttctcacttttcgtttgctataaacagtttcggtcagcttcacaaaaacagcgaaactggcttaatgccccgcgaactttgctttttacatgtgcaatttttgttaaagaagcataataattaaaataatttaattctttattttttaaggtccataaaaggaaaacaaattaataaatatttaaatttagtgcctattttattgcattaaatttgggtggggtcgttttagcgtttagcaatataatttctttttgtatcatttggaaagctccaatgtactcaattatttagttaaaattttgataaatgtatatataatcaattaaacacgccgcactaaaacggcccatctcgtgaaacaataatagagttggtggtaacatgaggttctacagtacattaatgagtattattgtatatttaactgtgattatataacacaacaaaaagtttttttagaaaatataataaa

SEQ ID NO: 63901 - DNA, 646 bp, Heterodera glycines
  Genomic contig location: Contig_ID=SeqID_33992; Location=257..902; Strand=-
  SCN-specific regions: Sequence locations=1-46,74-480,502-646
  Gene Ontology: Mol. function=protein serine/threonine phosphatase activity; Biological process=nitrogen metabolism
gatggagggatacaaatggcatttcaatgagacggtaattaatgccaaaaatggggggaaaacaaaacaggaatcaaaggcattatgcttttgattcgttttaatggaacctaatgaaaaaaaaaattgaattttcggtggcatgaatgggtgtattgtgtcctcagaaatcttacccgtagatttgaaaaaaaaaatggatagcagggggcaagggcgcagccagacccttggttttgtgggggggggggggggcctgaaatttaaaaatcggtttttagaagtgtttttttagaaatcccgtatttcgacgaatttgtagccgtttcgacaaaaaaaaattactattttttgccatttggggtcaattttcaaaaatatggcaaaatgggaggagtggtatgtactcaaatgcctaccaggcatggttgggttgggatttgcctttgctcctccaaaatttgttgcccatttttcccaggtgctcactgtgtggtcggcgcccaattattgctaccgatgcggcaatgtggcggccattctcgagctggacgagcagttgaacaaggactttaccatatttgaagcggctccgcaggaagtcagtggtgtcaaaatcaaaactaataatgtccccaaccaacgg

SEQ ID NO: 63902 - DNA, 1461 bp, Heterodera glycines
  misc_feature (13)..(13): n is a, c, g, or t
  misc_feature (81)..(81): n is a, c, g, or t
  Genomic contig location: Contig_ID=SeqID_33993; Location=33..1493; Strand=+
  SCN-specific regions: Sequence locations=1-35,74-335,377-619,641 -1104,1126-1282,1304-1461
atgccaatgagancagcgaaggcggagctgacagcaagaaaaagaagaagaagaacaataaaaagaagaaaaacgccccgnttgtctgtgcacaatgaggaagtagcaaaaaaagaatcgaaaaaaggtgtggaagacgagcgggaggatgacagttttggagagaagaacaaggtccgccttgaagggaaggggcgatttgatctgtgccgcatttaattttagcgtcggacttcgctcaccgattcgccattaactgagctcagtccgtcgtcaacgactagcaacggcgactcagcggacgacactgaggtggccaaaagcagcagcaaacaaggttttttatgctttcatatttaattattcatttccattgcttggccactttttctgcaggttcgtcgtgtgggactgtgtccaattcgtcctcctccaacttttacgttgtcaatgcaccgccttcctcttcatattcttcagttggagaacgacaacagcaccagaacatgcactttttgagcgaaattacagaagaggaaaacatcaacgaagtggagcgcgagtacgccttcgaaattgtaatcaaccagaaaaaggtgcagtttctgaaagaatgtgaaagggtggggggagtgtttttatttatttgattaatttccctctgatatttggcggttctttccgaattcgtttggccaaaaatcgttttagcatttgattaagcagctgaagtacaacaaatggacggagcagttgtgccagtcgatcttcggtggggatttccgcactttttaccgtcgcttcaaaatggtgatgatttgcctacgcaaacggaaatctgcccattacgagcgacttaccgatgcacaattggcgtcacacgtggctgaggtgaaacgaaattattcagtttttctagttgaaaataaatattttttagatgatcattgaaaagtttcacaacaaggagaatcagaccaccattttgatggttttgctcagcaatagtgagcgggaagtgaagtgtgcggaccgcgaccacggctattgcaggttcaaatagttttccaaattttttatgaagtatagtggctctatgggaattgaatgttgtgggttatggaatttgatacgaaagaaattgccttttgttagcatgacgacggatgcagttttttcgcggggggggggtgagtagcaccctcatgagtgacgatttttgcaattccaaggcacggcctgtgaaattggatccgttttttaaaatcagaatccagacctcttattgttaacgcatcaaaatattctttaggattgcgcatatgttgttgaagctattgactcgcagtcaattggaaaaattgctcgaagtgaccgcggcgaagagcggaaaaaacgcattgcatttggccactgccactggacagtcatgtcaactgcaagtactgctcgctcttacag

SEQ ID NO: 63903 - DNA, 859 bp, Heterodera glycines
  Genomic contig location: Contig_ID=SeqID_33995; Location=459..1317; Strand=-
  SCN-specific regions: Sequence locations=1-128,150-298,320-859
ttgacaaacattcgtatcgtaacggacagcacggccgacatacctttggcactcagacaagaacttaacatcgagatggtgcctctcaagattcattttggagatgaagaatatttagatacggtgacgctgcagtctgaggaattttatccgaagctgacctcgtcaccgcactttccccgaacgtcgcagccgtctcctgcggagtttctggacttgtatcagggactgctgggagagcccgatacggaggtgatctcgattcacttggcatccgtgctgagcggaacataccagtcagcgctgctggcttccacgatgctggaggactcgtcaggcaaggttcatgtgtttgattcctgctcggcttcctatgggattggcgctcttgctgtagctgctgcccgagcagctaaggcggggcaaagtgttgatgagatttggaacttgtacgaacgatgagagagaacttttacatatacttcctcgtagatacgctagaatttctgcaaaaaggtggaagaatcggcaaagcatccgctcttttcggttctttgctaaacataaagcccattctttcgctggatcgaacgggcgaagttgctgcgattgataaggttcgcggtcacaaaaaagcggttgcgcgaatcttagagctgttggcggcggatgtacccggtaagacaatccgcagtttacatattgctcatgcaaacaatttggaaggtgcggaacagctgcgcgcggccatcatgcagcaatttgttgtagagcatgtggactacattacactgggacctgttattggcgcacacgctggaccaggcaccatcgcagcgttcgtgagtacggtgtaaga

SEQ ID NO: 63904 - DNA, 425 bp, Heterodera glycines
  Genomic contig location: Contig_ID=SeqID_33995; Location=1370..1794; Strand=-
  SCN-specific regions: Sequence locations=1-425
ttgtgtcccgtccaatcgattccgcagggtcttgcagccattctaggcgttccaagagaaagcggatgccaaaacaaatacggaagccatgagtgaatcacttcgacgtgtcaaatcgggccaagttacttacgctcgtgcgcgatacgaacacggacggtattgacatcaaacagggccattttattggcattcaagatgggcgcattgtatcttcacagccgagtcttctggatgcttgcaagaagctgctggaggaaatgattgaagaaagcagcgaaattgtcactatcctcaccggagaagatgccgttgatgcagagacggaggagctggaggcgttcattcaggcggcttatcccgacattgaaattgagcttcatcctggcggacagcctttgtatgcgtacctgttttccgttgag

SEQ ID NO: 63905 - DNA, 73 bp, Heterodera glycines; identical to SEQ ID NO: 56411
  Genomic contig location: Contig_ID=SeqID_33997; Location=88..160; Strand=-
  SCN-specific regions: Sequence locations=1-73

SEQ ID NO: 63906 - DNA, 423 bp, Heterodera glycines
  Genomic contig location: Contig_ID=SeqID_7125; Location=188..610; Strand=+
  SCN-specific regions: Sequence locations=1-239,263-423
atgaggacaacattggaaacgggtaagtgaatgttatattcaatttcattcatatttgtttctatttttaggcttctcgacgcaactcccggcccgagtgatcagcagcagaagtgaatgaatgaattgttaagaaatgatcgaccaatttgaattatgaaattattgacgtgttcataaatattgttttatttttgttggattgatcattgatcaacttggatttgtgttatgccattatgataaattcagtgattttgtgggtcagcggagcgaatgcgttgtctttttgcttttctcattaaagccatttttgggtattctctgaatccgaatccgtcaccccgggtaaaaccaaaaagtctcagaaactcctccccttaaaataatagtccgtaaaaacttttctcaagcacaaccaaa

SEQ ID NO: 63907 - DNA, 907 bp, Heterodera glycines
  Genomic contig location: Contig_ID=SeqID_7126; Location=83..989; Strand=-
  SCN-specific regions: Sequence locations=1-38,61-69,98-369,391 -463,485-907
atgtcagacagccgaaaagaagcggaggaaaaaatggcaaaagcaatgtaaaattaaaatgccaacttcaattttaaattttgttttttttttttttcagtttcatctccgccgactgttggctttgtgtcttcgatttgcttgagccgtcacaacttggccttggcatttcaatgatcagccaccgttttgacatttacgtggacgaacacttcaaaacccgcaaatgggcactgaaatttatccgaattcgaggcaaaattggagaaaatggcaccaaggaaatgaaaattgtcaaatattacgattggaaaccattgccaattccgcaaaagccgttgccaaagagagtcgtcggattcaaagccatttcaatagagtaaaatgaattaattaacaattttcaaatgtaaatgatgcaattatttcattttcacagatacatcgaccaaaatgccatcgcttttctccgccgttttcgtcaacttttcgccaaatgtcaaatcaatttgtccatcgatatatattacatttacactgaccgaattatggtgttccttttgcacaacatttggccaatgatcggaaaaaacatttatgccattgaattgcgcgtcagaattttccgccgtttgcgtcaattcgtcgatccgtcaattctcaacaattgttcatcgcttcgcgttgtcatttcatgtgccgatgatttcttcatcgaattcccatctgctgacaatgccatggcgtcggatggccaagcgttggcaaaatggcttttcactccacttcaagacaatgtgccaaagatgctaaaatgctcgttggacatggattatgatgggaatttggtgacgaatgttgaagccttcaaagcggtgatttcgaattgattttatttgtgattaaa

SEQ ID NO: 63908 - DNA, 623 bp, Heterodera glycines
  Genomic contig location: Contig_ID=SeqID_7126; Location=1778..2400; Strand=-
  SCN-specific regions: Sequence locations=1-623
atgctcaacaaaaacagacaaacggtggccaaatggcttttcactccacttcaagaaaatggtgtgccaaaagtgctcaaatgttcgttggaaaaagatgatgggaaatggccgttgaaaattgaagcattcaaagcggtacttaccgtgaactaagtaatttattaatttgtttccttcatattttaggcatttgccaatgcttcatctcctgccaatttcatcgttgtcatttcgtttttgtggtcttttgctgtgccatttgtgctgaccaacgaatttactcgagaacagttggcattgaaacggattaacaatagccatcgatttttgttggaccgttgtccaattgtgcgaaacgtaagcaaatggacaaaatgggaaaaggaagcgattggatggcaatttaatggccaatggaacaaaattaacattcgaattgataatgagcgtcaaattggggacgggtcagtgaataaattattcaaaaaatccaaaattattgcatttatctttttaggcttctcaacgcaatgatcggcccatgtgttctccagaagaagtgaatgaatatgtattgttgagaagtgatcgatcaatttaataattatggaattattaaa

SEQ ID NO: 63909 - DNA, 123 bp, Heterodera glycines
  Genomic contig location: Contig_ID=SeqID_34003; Location=91..213; Strand=+
  SCN-specific regions: Sequence locations=1-42,79-123
tttttgggccccagggtcgtttgggccccaacccaaaaatagaaaaatgtgcttttttaaaaattaagattctaaaaactaagcctgaaggatccctcgccacttggcataagttaggtttaa

SEQ ID NO: 63910 - DNA, 1959 bp, Heterodera glycines
  Genomic contig location: Contig_ID=SeqID_7127; Location=182..2140; Strand=-
  SCN-specific regions: Sequence locations=1-6,29-33,59-231,273-364,386- 610,633-697,722-1733,1755-1959
  Gene Ontology: Mol. function=xenobiotic-transporting ATPase activity; Cellular component=mitochondrion; Biological process=transport
atgcagcaggacgacttgttcatgggcatgttgacggtgaaggagcatctgatggcgcaggattggatggtcggagacactaaacggacgatgcgcagacgcgtcaatgaggtgggatctggggggggggtggacagtggcagtggcaaaatgggaataatttaaggtaattgacgagtttggtctggaagagtgtcgccatgagctcgttggattcagcggagtaattatcatttttaaaaatttacaattgcaatttctaggtcgaaaagagcattttgggtggtgagacgcgtcgtttgctgttcgcttccgaacttgtgaacaatccgcaaatcatttttgctgatgaaccgaccacggtctgatttttggtctaattttcgaaaaaaatccaatttttagggcctcgacttttcaatggcggaaagtgtgatcagcgtaatgcgtgccctggctttgtctggccggactatcatttgcaccatcgttcagccgccattggacatttactgggtatgaattcacataagactttgacccccaagtgcctttaggttctgggacccgatcctctttcgattcgtaaaattattatcacaattgtcttttttccaattgaaaatgaaattgtaaacttgccttgtcttccttttttgttctaccaatatccctctaccattgaattgcagcactgaaatgtttttattaattatgaaattctgcagatggccgcaggaaataatgcgcgattgactcgtgacgtaagtttattttcatataattgtggggaatttggtcacagcttgttatcatgggccggaatgaatttttagtggaagaagtttgtaaaaatttatgagcataaaactgaagcgtatcgaacgcaagaatattcaaaaaagacctaaaagcattttctaatcataattaactaaggatccaaaaaattttgagtgcaataatcgccaattttaaaattatttggcgttttattttaaagtttttgttggtttatatgtttactacacactaccaaaaaaaaattcctattttaattagtgatgtacatccgagagttagaatctccagatgagcactctctggttttattcaatccgcttcgttcttgctttcgtcctaatagagatgttcgagaataatgaaatttgattttttaggctaaaagattgttatagttgaggaagaaataaatttataaattgggttttgattcaatatctcataacaccaaccgtcaaaatttaggaattgttttcggcaattgcctgtcagcgacgctctatcgttcgtctggacactgaaagagcccgattccgtcgtttgaacggagctcagttccgtgtggttgtgcgattgtcaggttatttttaaaaacgatatccaattttagcagtttaatggtgaacaaaccgcgcgcattgtcagctcaccctttgttttcattgtttgaaaattaaacaaaaagattaaaccagggggtcgtcggggcttctgatcacgaatatgaatatcggatttgcaattatttatttaccatagtttatatcatatatttagaaattttgacaaatctaattaattattgaccctaaatctatgcttttcaaaatcactgattttcaaatcaatgttattagtgcgtgatcagaagccccgaaatccccagcagcggggttggtctttatcgataacagaaaattatttttatggagcccatatccattataccttaaaaagtagttaaatttatatcttacagaaaattcctcgatttaggaggcttcttgccaaactttgctgctgttatgccacagcaacagaacggtgggttgtcatttcccttcgttttaccaatctgctcatttttggcacattttagtggtcaatgttgctgcggttctcgccaatgccaatcccaatggacagaattataat

SEQ ID NO: 63911 - DNA, 1582 bp, Heterodera glycines
  Genomic contig location: Contig_ID=SeqID_7128; Location=345..1926; Strand=+
  SCN-specific regions: Sequence locations=1-4,26-36,58-230,252-310,334- 534,571-629,651-1515,1537-1582
atgatttttacggaaaatgtggtgccaatttgtttggccaattccacttctgaaaaagttttcaacaataatttgcacattgtcggctggggacatcagaatggtaattaattattaaatgctgtttaattaaaaatgattttttttttgttgattcgctaattaggtataagatcatccaagaattaaacaccaattaacattgaatatggacacacaaaattctttataaaagtgggcatgtattttacagaagccgactatgatgaagagggcaatgaacggtgctaggtcatttcgcgacaagtgcaaaaataaaaatcaataaaattgggcacttcgcgacagtgcaaaaatgggcacttcgcgacagtgcaaaaatggtgtataaatggggcgtttcgcgacgggaccagagcgtttgggcccccgtttttgggcccccgcgtttgggcccccgtttttgggcccccggggtcgtttgggcccccgtttttgggccccggggtcgtttgggccccaacccaaaaatcgaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaacagcaccgacaaatgcaacggccgaatctggacggacctccacgaccaattcattcgcctcgcaactccgcacacatgtccagcagatgcgtcacgtgttgatgctcaaatggtcacgaccacaatcaaaaggcgcgcaattgccaccttcgaaccgccttctgtcatcagagcagaagcgcttcaaaatgtcccgtctccgtcggcaattttggtgtcaaaacaagcagcaaaagatgtgaaaaactgcaccgattctgtatttgccgagaacgctcgaatgatcacgtctgttgcgttcgtgcccttgtgtgacattagaatggcggtagcggcacttgatacggagttcggaaatttggcggttttccaaccgctgattgactggtgtgtaaactttttttaaatttaaaccccactgaaattacaggctattaatcaattacgttggacagcccaggcccaatggcacatggtctcaaccaacttttcgccctgaacaatggaacgtctacacacgcacgcttaatgccgatgcacggaccaacaaccactccgaggcggagcatcatcgtctacagggcgccttcaattgccgacacccgtcgatttttcacttcattgacgtgctacgtcgtgagcagaagccaacagacgtcaaatacgcgtcattcatggccggagaggaccccccaccaaaagaacgaaagtttttgccgacagatgaacaaattcttaatttg

SEQ ID NO: 63912 - DNA, 80 bp, Heterodera glycines
  Genomic contig location: Contig_ID=SeqID_34012; Location=221..300; Strand=-
  SCN-specific regions: Sequence locations=39-39,69-80
gtcctgcccataatatctgtggcatggaataaattttgtaactgcgctgcctaacggcggtgcttaaagtgcgctaaaaa

SEQ ID NO: 63913 - DNA, 80 bp, Heterodera glycines; identical to SEQ ID NO: 51817
  Genomic contig location: Contig_ID=SeqID_34012; Location=833..912; Strand=-
  SCN-specific regions: Sequence locations=69-80

SEQ ID NO: 63914 - DNA, 1621 bp, Heterodera glycines; identical to SEQ ID NO: 34013
  Genomic contig location: Contig_ID=SeqID_34013; Location=1..1621; Strand=+
  SCN-specific regions: Sequence locations=1-129,151-724,746-1205,1227 -1621

SEQ ID NO: 63915 - DNA, 743 bp, Heterodera glycines
  misc_feature (36)..(36): n is a, c, g, or t
  Genomic contig location: Contig_ID=SeqID_34018; Location=264..1006; Strand=-
  SCN-specific regions: Sequence locations=1-73,105-341,385-446,468 -604,626-743
atgtggttttcgtgcatttctcgtcgagttaaagcngcagaaaaaataagtaaaaacttaaaaatccgcgtcctttttataaatatcttttttaaaaatttaatccagtaaaaatgaatatgacatctaatttcagtcaaggacatttttggattattctaatcaattgaaatctctgacgtcgatcatttttctgattttatgtttcttagtcaatttgttgacactaattgcttataaacggcaccgaaaagcgactgtcacgtcattgagcggaaactgttaatttactcgctgcttacttttgctggccacgcccttttggcggtgttttttgtatgtaaatttaaatttaaaaatatttttaatttaaatttttattaactacaaaataaacttattccaatttcagctttccgtcagcgaattcgtctggccattttatccccagtacagtgccatcatttacatccaatacccatgggtcaccgatctttgcactttggtgttgtccagttggctgctgttgtgcacaagcgacaaatttcggcaccaattaattggcacttttttgccaaaacgccttttgccgtcaacgagggcacaaaatgttgttgttccattggacaaaaacaatgtcttaattacagtgcagccttatcattcatcaaaatgggcagcgagatgacagaagcggataattgattattgaaaaagagatgcttattttaattttaaataaa

SEQ ID NO: 63916 - DNA, 657 bp, Heterodera glycines
  Genomic contig location: Contig_ID=SeqID_34019; Location=227..883; Strand=+
  SCN-specific regions: Sequence locations=1-147,169-417,440-458,480-629
atggcactcggaggatggaagcgtgagcgtgctcgactccgttctctacaaaacctgaaccgcctgttcgtccgcccagcgctgaccaaagaacaactcaaggaagaatatgaagcgcgcgtccgaaaacgtcaacaaaactctgctcccgtggcaccagcaatgcaacatcgccagacaaatgttccgactcccgtcaaaaaaaatggaccaaaccagaaggaggccagcgacgacatttccaaaccgccggaagtttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaacaaaaaaaaaacatttattccagtacttcacatttctcaccaaaatttttcctcaaaaaaaaaaaatttttttttctcttctacaaccctaaaaaaacaaataaccacttttccctttgttggaggtctgacttttctaatttctgcttctccttcaaaatttcaattcttttatcactgctttccatttcaccttatttccgccaaaagagtaagtggcacatgtccttcttttggttatttttatttttga

SEQ ID NO: 63917 - DNA, 855 bp, Heterodera glycines
  Genomic contig location: Contig_ID=SeqID_34020; Location=1..855; Strand=-
  SCN-specific regions: Sequence locations=1-192,215-855
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaattttttctccatcttcctttttgatactaaagcatcagagtgctaaaattaacttgtaaataaaatttggtgcgctttagagcactttctgaaaaaatatttatgaaataaaaaaatcgatttattcaagtgtccgtttggggtactcaaacaattatggggagggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaagctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaaccaaaaaaaaatttttggataaaattatttaaatgaactgact

SEQ ID NO: 63918 - DNA, 570 bp, Heterodera glycines
  Genomic contig location: Contig_ID=SeqID_913; Location=840..1409; Strand=-
  SCN-specific regions: Sequence locations=1-240,262-452,474-570
atgttgtcggaaagtgcagacaagaccttgctctcgcattcgttgacgaacgattctcaaactgctgcggcaattcagatagtaactgcgttgaaagacacaattttgtcgccaaatgtttcattagttgtgatttgtttgtactcttatcaaaaagaatcacttcaaactgaattcgaaaagcagcgaattgaggtacttgtcgtgacggtcgatggctatcaagcacaagaaagtgatttggtaattttggtaacaacaagaacgagtcttcgagatggggcattaagagcacttcaagcagcacgtccacatttgagtcgcgaaaaagaagagcggatgagcccgaccaaggtccgagtgcacgccgaaatgagacatggaggccgcagcaacgtcttggacaattcagcggtgccgtttttgtcagaagtcgcgaaccaacgggtcctcgtggtgcttgctttgtgtgcaaacgtgtcgggaatttggcaaagaactgttgatatgcggatggacaatcagcaggacgtggtcaaccaaggggcaaagggcaatggaaataaatag

SEQ ID NO: 63919 - DNA, 3783 bp, Heterodera glycines
  Genomic contig location: Contig_ID=SeqID_914; Location=325..4107; Strand=-
  SCN-specific regions: Sequence locations=1-409,455-459,517-633,655 -903,925-1332,1355-1492,1514-1529,1551-1693,1725-1922,1945-2002,2025 -2529,2552-2938,2960-3387,3409-3450,3472-3534,3556-3590,3612-3783
  Gene Ontology: Mol. function=DNA helicase activity; Cellular component=alpha DNA polymerase:primase complex; Biological process =mRNA catabolism, nonsense-mediated
atgtacatgtgggccaaagcgagcgctttcggagacgaagaagcggcatctgcaattctgcggacaccaaatccaaaggagtgcaagcgaattggatcgcgaattcggctgtttggcacaactgctttggcgacgcataagcatattcgtgatgacttgcgccaactggcacaaatatagacagaacgaacacctgatgcgccatctcttcaattttggtcccgatgttgaatttgttgaatgtacagcaaatgacgtgtactggggtgcaggagtggcgctttcggatgttgaaaaaatccgcgacataaaccgatggcctggtaaaaatatccttggacggattctctcagccttgatgaagaaattcctgcgtaagaaatctggtgaaatgaaaacaaaaaaaaacaataaaaaaataaataaataaataaaaaataataaataaataaatccaagattttttttaatattacatataataataataataatttaattataattatattaaatcctataaattttttcaaataacaccgcaataacaaatgatttattacagaaatgtcggcaccaacagcaccaccaaatgttcgggacctgagcgagttcccgccgttggaaaagttaacattggaggatgtaaggaaaaagaacaaaattgcctcggcaagcccaagtggaaactcaaatatttctaaggaaacctgtagtagtgcaataagtgtggatttagttgcttcggcaagtcaaataacttggggaggggaaaaagggaacagtgggcaagaaaaaggggaaaagaatcaaaaattaaataaaaatgttgcttcggcaagcccaagagattatgaaaaatttgcgaatcaaggatttgacaaaaacccggatgaaatggctgaagaaatgatggaagaattttcaagttttaatgtgagagaaaatgaaggaaaaattgttgaatacctggtttgccaagtagaagaaaatatagtgattggaggaaaattgaggacaatggcaaacaaaggctggccacattttgtagcaatctcaaatgaggtggctgaaaaagcaagagagtttaaaaagaaattgcaaatgggagacatagttggagtgaaaaaatttgagtggaaaaatgattaccgatacttagcaaaaagagaaactgacaaaagtcatttcaacaaaatgtggtatgtgcaaaaaataaacagtcaagcaacagtcattgacctcggtcatataagatatgcaattctgagggaacatccgggtttggtcttaagaatcagagaaatggtctcaaatggtgtcacgaaaaagctttgtgctatcattatttctcctggtctgcagttgagttcgagatgttatcggcgtcagctttctgagttggaattggagtctctccaagaagggcagttgataaaagtttggactgcttttgttccagagcaaacattagtagaaaattcgttcatacttccacctcaaagccaatttcgactggggactgaaaagcagatagaggaaggcaaaggagttctctccattgtcggaaatcatgcgccgtggccataccaatcgaactctcgcaatgtcttctttccgcttttgccagagatgactctgccggaaattgagttgtcagaacaaatcatgagttcagcgattgcctacagctttgaagatgaggaaaagagaattgttgagtgcaaatttgaaggaagagcagaatggcagaacgacactttttggttgagatttgctgaaattgataccgaaaaaatgaaaaaattgaaagaagtttggacagaagaagcgaatgtcttcttcagaactgcgttggatttgccgcactttgcttttggctatgtcaaacaaattgacattgagagaatcagagaggaaggaaaaccaaaatttaatttttggataatggccaaagtcaccaatgtccaagagagaaagtttcgtgatgttcatgccgaattggaagcagcagaagaaggaggtgtctttgtagtacacccgatcattccgattggagtgaaacacagaagggattgctttgcttctaatttgccatcaaaaattgcaaatttggaaacaaaacaagggaaaatgatgcgtgcggtattaggcagaactgaggagataattgaggaaaatgtggaccaaaatgcttcggcaatacaaattaatcacgcattgatgaaaaaattaaatgaaaagcagcagcagacagcaaaacttttgttgagcaaggagtcgcactttgtttttcagcatgctccaccgggtgttggcaaaacgtatgttgccgcaattgttgcagcaattcttttgtcgatagaaaaagaaataaaaattgccattgtgacagcagcaaatttgccacttgcaaaattagtccaagaattgaatgatgtatttggttctgatgagatggaagaatcaggttcagttgcattcttctcgggttatgccaaagaaaagtacaaagaaatgttagaaaagttgaaaaggcatttgttgatttccaaaatttcgaacgaagaaataataagcaagtttgagacacaagacgatgtgaaggaaattgagacttattgtaagaatttcgaagttcgaccacgcttaacgaaagaacgaaaagtagcgaatttgtactcagaagttgcggatttgcggattgtcttcaccacagtgtcgatggcagaaaatttgattcacacagctttagacggcacaacagtcttaatctttgatgaagctactcaggggtcgtgggtctgcttagcacatttagtagccagaatgccaaaattggagaaagtcttggtaactggtgaccaattgcagcttggtgttcatctgcagaaactcccgcctttgctacaatccggttttggtcttgaatcaatggttgatcagttgatcatgtctccgacagttgttcaaactcgtctaacgacttgttacagaatgcacccgacactggtgaaagcagttgcttcggcagtatatgagccaaatggagaaaaattcgaaccaggaagagcagctgaagatcggtccctcctgacagcttcgaagtttcctctaccaattcaaaattgtccaattgttctgctgaatgttgtcggaaagtgcagacaagacccgctctcgcattcgttgacgaacgattctcaaactgctgcggcaattcagatagtaactgcgttgaaagacacaattttgtcgccaaatgtttcattagttgtgatttgtttgtactcttatcaaaaagaatcacttcaaactgaattcgaaaagcagcgaattgaggtacttgtcgtgacggtcgatggctatcaagcacaagaaagtgatttggtaattttggtaacaacaagaacgagtcttcgagatggggcattaagtgagaattcagaatttttgaaggattcgagaagggctacagtagctttaagcagagcaaaaagtggtttatttttgattggcgatttcaaaactttaagtgagggagaggtgtggaataagtttttggaaacagcaagtgaggactctcaaattgttggtgaggaatatcttcagatcctacgaaatggtcgatacatgcgtgatcgatatgggcaattaattgatggcattggcagagtagtccaggatctacagtggttacaaaagaatgatgaaaattggcgaacgatgcaacagcagagtacttcaagcagcacgtccacatttgagtcgcgaaaaagaaat

SEQ ID NO: 63920 - DNA, 1138 bp, Heterodera glycines
  Genomic contig location: Contig_ID=SeqID_915; Location=64..1201; Strand=-
  SCN-specific regions: Sequence locations=1-357,379-466,488-533,593 -647,671-706,728-976,998-1138
atgccgactgcgaaagttgtcatatcgcaagatggaaggaaactcgtgccattcttcacatcagcatatccattttccaatcacttctcctgccgatttgtcattgatgggcttgaattttcctccagcgaacaaatgtacatgtgggccaaagcgagcgttttcggagacgaagaagcggcatctgcaattctgcggacatcaaatccaaaggagtgcaagcgcattggatcgcgaattcggctgtttgacacaactgcttggcgacgcataagcatattcgtgatgacttgcgccaattggcacaaatatagacagaacgaacacctgatgcgccatctcttcaattttggtcccgatgctgaatttgttgaatgtacagcaaatgacgtgtactggggcgcaggagtagcaatttcggatgttgaaaaaattcgcaacacgaaccgttggccaggaaaaaacgtccttgggaagattctctcagctttgatgaagaaatttttgcgtaagaaatctggtgaaatgaatccaaaaaaattacatataataataagaataataatttaatttaattataattatattaaatcgtattcattcaaataacacagcaataacaaatgatttttttacagatatgtcggcaccaccagcaccaccaaatgttcgggacctgagcgagttcccgccgttggaaaagttaacattggaggatgtaaggaaaaagaacaaaattgcctcggcaagcccaagtggaaactcaaatatttctaaggaaacctgtagtagtgcaataagtgtggatttagttgcttcggcaagtcaaataacttggggaggggaaaaagggaacagtgggcaagaaaaaggggaaaagaatcaaaaattaaataaaaatgttgcttcggcaagcccaagagattatgaaaaatttgcgaatcaaggatttgacaaaaacccggatgaaatggctgaagaaatgatggaagaattttcaagttttaatgtgagagaaaatgaaggaaaaattgttgaatacctggtttgccaagtagaagaaaatatagtgattggaggaaaattgaggacaatggcaaacaaaggctggccacattttgtagcaatctcaaatgag

SEQ ID NO: 63921 - DNA, 1110 bp, Heterodera glycines
  Genomic contig location: Contig_ID=SeqID_915; Location=1328..2437; Strand=-
  SCN-specific regions: Sequence locations=1-82,104-455,477-644,666 -755,777-782,805-842,864-1110
atgtgcacaccaccagtaaatacactttttgctaaagttggtttggatttggcaggtccatttccgaaaacggaaaatggaaataaacacattttaaatattatttgttggtttactaagtttgtgatttctgtgcctctaccagacgcaaaagctaaaaccatagcctcggcatttttaaagaattgttatttgcgttttgggggttgtactgaattaattactgacaatgcaacggcatttacgtcagatttcttcaaaagtttatgtgctttgctttacataaataagacatacgctattccacattggagtcaaggaaatgctgtaactgagagatcctttaggactttccataatattctctctaaatatatttctaaggatgagcctgactttgatgagcatttagactttgtaagcttttgctataatacttcggtacatcgttcgacaaatgaaacaccattctttcttatgtatggtagagatccgattttctgcattgatctaattttagatccaaaaattagggaaccagtcgcatttagtgatgatgaagaaatacgtcaaaaaattgtagtcacacttagaaaagcttggcaagcagcaaatttggccaatcaagaggctcaggcaagaacaaaatcttcttatgataaattagttagaaatccaacaatttctgttggagacagagttttactcagaaattattcaggaaaaataggtacttcaaagaaattccacttaccttggaaaggtgtatttagagtcatagacatagaaggggtcagaacaacaatactaagctgtaattcgcctcagtctaatccaagagtagtacatattaaccaacttaaaaaatgcatagaaccccttgggccagcatgcactattcctaagcttgatgatgatgaagaaaaagcattacatgaggcaaatgcaaaggaattaataaatgaaccgggacattaccacaaattaggtcaaaaatcaaattctgaagttgaaaaagaagtagaagaaacggatgaacctgagcaaatcagtccgagatataatcttaggaaaaatccgagagcaagaaaactcagtttaaataattaa

SEQ ID NO: 63922 - DNA, 1209 bp, Heterodera glycines
  Genomic contig location: Contig_ID=SeqID_916; Location=1367..2575; Strand=-
  SCN-specific regions: Sequence locations=1-139,161-373,395-449,471 -688,717-1003,1025-1209
atggtaatattgagtcaaatgacttatcagattcatgaaaaggacaccaaaatcacagctacaatttctcaagaatgggaagaggttgaaagccaaatgatcaaagcagtgattggtgattacagaaaaatgtggttaataattatgtctctaattattaccattctgtcaattgacttggcgataagattgacaattggtttaagtgaatttttgcagggaatgggcgcttaggcaatttattatttggtacaacaattcagaaagctgggagaagagtaagaaaattgagggagactaaaattcaacaaggagaaatttatgaagagccaattaatcagattaattggccaccaagaattagaagggcaggaaattcatttaaaaaatctttcaccagacctttcaaaagaaataggcatggaccaaatccaacacaaatgagcactcattttgaattaaattctttgatgggacagcttgggtcgttaaataataataaaatgacagtgaccactctcgtctctcttaataatttccaaatgaaatgcttagtggacacaggctcaagcacctcagttgcaccaaaagcgttagctgattacttaggtattaaaacatttaaatcagaggcacatttaatgagtgcttccggtcatccagtacatgtcaaagaagctgctcgtgtgactttaaaaataggaaatgaatatgtggacataattattcgtctttttgatgatgaactttcatggacaatgaaagattataattttattttgggatgtgatgctcttgcttcactgccgcctattacttttgactttcaaaataaatggctatccataggaaatgctactttgccattgggaaatgccacaaataaaattttatatggacttaaaatatatgcaactgacactactgaattaagtcctaatgagcaatgcatcgttaaggcaaaaaccaaaagtcttcaaaagcttcggcatgaaattgtttttaatgaaattgataaaaaacttttaaatgagggaattgggtttgtgccatcattatctgatttcaaatcagaaacaatcagtgtaattattacaaatcccacctcaactgtaaaaagaatttttaaaggaacatgcctcggcaatgcaaatgaagtcttaaaaacggaaaatagcactatttttactgaaattgagaaagaggaca

SEQ ID NO: 63923 - DNA, 297 bp, Heterodera glycines
  Genomic contig location: Contig_ID=SeqID_916; Location=3506..3802; Strand=+
  SCN-specific regions: Sequence locations=1-297
caggcactttttccgcggtcacttcgatcggtcggccaccgacgtttacatcgacttcgcggtacacaccggccgcttccgccccatccggctcgcgcacccaaatgtggtgatgcagggctttgatggtctcaaaaaaaacatgcttccgattaaatgcattacagtatcaccttgtagaattgctcaatgaatgagttaaatgtaaaaatgatgatcgataggccttgagaaaagcaattggaaaatttaaaaaaaaattttgtgttcattgaatctaatagaatatgaaaaaaa

SEQ ID NO: 63924 - DNA, 1388 bp, Heterodera glycines
  Genomic contig location: Contig_ID=SeqID_7129; Location=470..1857; Strand=-
  SCN-specific regions: Sequence locations=1-218,254-653,758-853,884 -1048,1070-1154,1176-1388
atgtttttccgttgtgacaatttcactgctggaccgcctcgaccgacaccatctcgcaggcgctcgacttctgctggatccgggggaggtgcggggcgatcagaccgtgaggacactggtcttcaaacggcgggggacgtaggataaataatgatttatccttattttattgttttttgcaacgattgtttttcgcgttaatttaaaatatttttgcatccttcatttaattttccttttgattgttgtcttcgttttcggtcttcgtgttctctcaagttttatatattttgtgcttttgaattattgtaataaaactacaaaaatttggtgcttttccccgtggactttcattcagcaacaacaaacgcccaaaggcttaattggtactgttatttgagttcctaattgcaatttgccttattctctaattccttgtcagtaaagtggtgttgaaaattaagtaaatctttccttgaccccaaaatctcaacccaaaccccagcaaatcccaaagtccctccccgaaaatacgccttttctccaacggatgacccaaaaatgtggggagagattttctcaaaagaaatagcttcacaatgtgcaacagatagagacttttgtacacaatcaaatgtcgggggttaaagatgaaaaattgaaaaatatttaaagaaatttagagaatactttaatttaaaaatttttgattaaataaattttaaaagataagattcataaaactttttaaaatattccataacattaaaatatcaaaagaaaaattatcaaaaaagaataaatatggaagagttcaatgaataaaatgaaacttgcgacaattcatctgaacatattttattatttttaaaaaataaattttgggtcatttaaaaaaactaatcttaaaatagctaatacggctacgccatgtaacaattcttaatcacatttttacgaaaaacttgcgcaaaaaatagcatgtcagaagaaaacgaaggtgccaatgccacaactaataagtgaaattgtagggagagtttcattattctaaaaagaatatttatcatcggttttgaattttgtaaaaatattaaagttgtgaagtaatttttagcaaatcccgtcaaaaaatgatttatcttgaaaaaagcttcaaaataattttttaagtgtaagtcaaatgaaaagcattaaacaattattacagggctcggattcgtacttcgatgccaagtacatacttagatttcggcttttgtgcttggaaaattttaactgtacttatttccaagattgtacttggaatcgggatttttgcatatgaatgtaaaaaatatacattttatgaaaaaaatttcaaatttttggcattttgtcaaaataaa

SEQ ID NO: 63925 - DNA, 2272 bp, Heterodera glycines
  Genomic contig location: Contig_ID=SeqID_7130; Location=95..2366; Strand=-
  SCN-specific regions: Sequence locations=1-39,61-423,445-575,599 -737,777-779,802-1090,1112-1882,1905-2272
atgaccgatcaaattatcgatcgaaaatcaaagcaaaaccaaaactttccaaatccaaattatggtcgagaaattggggtgaatcacccaattcagaatacaagagattttggaaatggacccaattttcaaaattttcatccggttcggaatatcaatcaaccaaattatcaacagcgaccgaatccaaattttgaaaatttggcaccacaacccaatcactttccgaacgttcaaaatttcgagtttgtccctcagcaaaatttccaacaaaatcaaattcctgatattgtaatggaattacataaagttactctgtcaaaccaatacgcaaatacgctccgagaaattccgaacctatacggaacggaaggtcgggacaaaattaaggatttcttcctaaatgttcaaatgtgtgccggagagtggagaccagaaaagcaaaaagagttgctacagacaaagttgaaagggaaagctttgaaagcgtatcatattgcgctgaacaaatttggaaatgaggcgacatttggcattctaaaaaccgaaataatgtccattttgagagagacagactacaaagaagcaaacgcattttccgaattgacacagaatggtaaaagaaaaccaaatgaagacattataaagtttggtgagcgaattcaacggttggttaattgctcatacattggtctggacgaaaaccagttggatgaggtgtcaaaaaagcacttcatttcaaacataaatgatgtgaatttggccagatttttggaatgccagaccaaagcaaaccaaacctttgatgagcttttgatgatggccaaccgtttgagtcttattgaggacggaaaaaaccgagaacgaaacgaatcagttggaattcctgttcagtttcagcaaaccggcccacagcaaaaaccgtacagcccatttcaaaacccaaattacggacaacgttttgaaagaaattttccaaattttgggatgggagcgcaaaataatttcaggccaaaccgacagagtggtttcaaaaaccaaaccttccaacaggaaaaccgaaattattgccccaataagaattttgatcattttcaaaaccaaaatttggtcccttatcaaacttatggcccgaaaaatcaatgggtatccgacccacaaaacggctttcaaaacgatattttttatgagagcaacccaaattcccggccaagtcaacgttttgtccattttcaaaaccaaaattccgatcaccaacaagacgtcaatgatcataaaatcgaggcgatcagcgcaaatagaacccagttcgattcaaatcaacaatcaaatccaatggcaacgcagaacatggagttgaatatgattaaggtgaaaggaaaaggaactgaaaaatgcgaaaagaaatcagtcaaaattagtcacatcgaacacagcgaaccgcccgcctacgaaaaatttttcaattcattaatcgcccattcaactgaatttccctcaccaaacccgacacaaatatcaaattcagaatgtattgtgttagagttgaacgttgctggattaaaagcaactgcattaactgactcagcagccgaaattaatgctgccaatccggaatttttacataaagttgcagtggaaaagggagtgaatttgattgattggggttttagtccaaacaaaggaaagtcagaaattccttttgaagtcgaatcttttacgggtggaagagtaccagtgattggagtactgaatgtgccgatggaaaaaggaaattggcaaggcaaaattaattgtgtggtcaccaaaaaacctttcccttacgattttgttcttggacaaaatgcgttaagttctcttggatattacatcggaaatgtaattacaaatgaaataattaatttcggtgagagtccaaaacattcgaataattcattgccaaactctggtcgaatctcctccctaaaaattgtaccgcgccccatacaatcgagaatcatttccaacgaagtgattaaatcaatttcccctgtcaaacgcataaaattcattcaaaaggtttcatccaattcaaagattgcttccaacaaaaccgatcaaaccccctttgtcaaacttcaaaaaatccccaaaaagatcccgagcccaccaatcaaattagtcattaatgcaatccgtcataaaaatgaggatttggatcaaaaacagaccaaacgggaacgacgacgtgtttttgttaattccaagtacaaaaatgtttttcgccaaccaa

SEQ ID NO: 63926 - DNA, 333 bp, Heterodera glycines
  Genomic contig location: Contig_ID=SeqID_7130; Location=4792..5124; Strand=-
  SCN-specific regions: Sequence locations=1-333
cttgaggaagagcaccgattggtgaacactgttcgctcgttgatccgcattaagaatccgaatgatcgactctgtttggccagagctgtgttgctaggtcttcacgattggcgttcacggtcaccaggcggaggcggaccgacagcattcaaaagtttcgcaaatcgccagcacacccacgggcctgaggcacgtaacttattgagacgtgccgcaattccccgcaacaaacacatgtacacaattgatgacgtccaaaaagtacaagattggattgatcaacgatacgggccaggagaaattcgaattgcagtttttgagaaggaacgtgag

SEQ ID NO: 63927 - DNA, 812 bp, Heterodera glycines
  Genomic contig location: Contig_ID=SeqID_7130; Location=4079..4890; Strand=-
  SCN-specific regions: Sequence locations=1-195,219-346,368-812
atgtacacaattgatgacgtccaaaaagtacaagattggattgatcaacgatacgggccaggagaaattcgaattgcagtttttgagaaggaacgtgagtaccgaattgtgttcaaggcagcatccggcgaggcagccaagttcaacttgtgtcttttgttcgaacccgataaaatttggttgtataaaatcggatggccattttggtaaggaaaaaggtgcaaaatgacgtggaacgagtgcactttgtacatccgtttgcattgtccgcgataataatggcaatttacagcaacaaatttgacctaaacaacttaattttgggttttcggtattaatttggcgaaattttttcttaaaattagtgctgtttctctgttccttttctgcacaattacgacttgcttctcttacggtagagtcaattaattcttgcacaatttgtcattgttgaatcaatctccgcgtcctcctctcccgtcgctgaagaacaatttgagttttcggaaacgaaattggtcgatgaacacgactcaaccgactcagtcataagatggtttggaaggcgatgtctgtggtgttcaaaaagcattgtttacatttacagttagcacaaaccaaaaaggaacgtttaattgttaaaagtggaagcagtgctggctctacttaagtttacgtgtccaaccgacttttacgcgtccaatcaaagactatccccccgtttcttaggtcatatctttttttcatacttggtcaatccatacatctttggcatcattgaaagctttaagtctcaggaattcaaaaataaa

SEQ ID NO: 63928 - DNA, 637 bp, Heterodera glycines
  Genomic contig location: Contig_ID=SeqID_34024; Location=289..925; Strand=+
  SCN-specific regions: Sequence locations=1-10,32-64,86-378,401 -582,604-637
atggaaaaatcaattaaaaatgtgttagaacgcctctacaatgacccaaaatcccctgctgcgttcgccggtgttgacagactgtggctggaagccaaaaaagaattaggaaataaaattcgtaaaaatgatgtaaaacattacttggagggacatcgcacctacactttgatgcgcccaaggcgcgtaaattttctgcgcgctcgaacgactgcagccggttttatgaccgactgtcaggttgatttggctgattttcaagcactttcccaacacaacagcggcaatcgttatttaatggtggtaatcgatgtcctttctaaacggattttcgtaacacctcttcgtaccaagaaatccgatgacatggtagaaggctttaaacgagtgttttcaactatgccaatgaaaccacacagaattttctccgacaagggtacagaattcagaaatcagcagctgaaaaaaattttgatgaagaggaagttgagaaatatgagagcacacattctgagaagaaagcagcattagccgagcgcgcaatacgacaaatcaaaaatcgtgtatatcgttactttgcccaaacaaaaaccctcaattgggtggacgtaattgatcaaatttgttgatggcatta

SEQ ID NO: 63929 - DNA, 953 bp, Heterodera glycines
  Genomic contig location: Contig_ID=SeqID_34031; Location=359..1311; Strand=-
  SCN-specific regions: Sequence locations=1-304,348-631,654-822,844-953
atgtcaaacaatccgctgccgcctaccacgactttgactgacacaaacgatttacatctgctcgaaatgctgacattggaggaggaggaggaggcaagcaagggaagaataactgcttcggcaagccaaaacgaagatcaaactaggaatctttctagggaaacttgtagtaatgaattcggtgtacaatcagttgcttcggcaagtaaaatagaaggggcatgcacgggtcatatggtaggaaacgggcaagaaaacagtgaaacaaataaaaatatcagtcaaaatattgcttcggcaagccaaagtactaatgaaaaggaaacgaaaagaattgcagaaataaatcattgtagagaaatgattagaaaaacaatggcagctttggcaataaaatgtgatactgagaaaacatctgaactgagagatactaaaaaagtgatgaaaagaatccaacagaacctattaataacatagactgtccttctagttctggaataggtttaagatgtactgatactcttgcatgggcaatggttaaaccagaaagcgatgaatatcaaaaaaagaaaaaaagggataaaaatagtgatgatcagctaaggatgattattttccagagaatgggtgagtgtgcaatggctgttcggctgggtaaagaggacaaatggccatattttgcattagttcatccaaatgtaaaactgaatcagtatccacgcttaggcagtataatctcagtaccgaaagtggaaaagcttgaatattttagttctttgaattctgagttatactcatcaaacccaaacgaggaaagtggaactatttataatattataaaaagtgtaagaaatgagataaaagcaattgatgtcgattttaatgtatatgatgatgagagtgatgataacattctttccgcatcaaattggaccggatgtaaaaaatcttga

SEQ ID NO: 63930 - DNA, 110 bp, Heterodera glycines
  Genomic contig location: Contig_ID=SeqID_7133; Location=543..652; Strand=-
  SCN-specific regions: Sequence locations=1-110
agattctcattgattcctatgcgagttattctgctgacaaaaatcggcttttccaaacattggtaaaattcgaatgccgcggaattgagccgacttcgttcgacccccgg

SEQ ID NO: 63931 - DNA, 1150 bp, Heterodera glycines
  Genomic contig location: Contig_ID=SeqID_7134; Location=537..1686; Strand=-
  SCN-specific regions: Sequence locations=1-747,771-779,801-1150
atgaagtttttggaccgcgatgttcttcagacaatgcaacttgtgacaaataaacattgtcttattgttgataaatatttcgatgtttttcctctccgtgccgttgctcggtacttctcttaggaattacttctcattgggctgtttttcaggtgcaaattgcgtacgactcgttccaatgacatgaaattgcttttgatttaccgtgggagaacgattgagtccaattcggatttgcacttgtggcttcggcattgttttgtcggatgtattgagttcatcgtcagtttaattcccccgccccacctctttttttatagttatccgattttcaggaattcaaatttaccagtgaaatcttacgcgaccttcaaggaatggggcaacgaatctttcaactcaattactgtgttttcgattatcaaggacgttcatcttcccaattaatttcgcagtataaaattgacacactcttttctatcagtgcttttcaggttttctctttgatttattcaaaatttgaaactgaattaagtgaccgaccacagcaatttttgtgtcaattttttagaaatgccttggcgccgtcttttctttcggccgtcgttgtgagttccgtccgcttatttctgaccttcttcgactccctccaaaatcatttgtcattgatttcgaagggtacaaagccaaagcagaggacagcgaagtgataaggcgagtaggaaaagctcacttccttttttggtgtaaaatttttaaaaatatgaaaaatgaatcgaattccattgtttacatattttcacaactgaagatttatataatattctattaaatcctttcagtgtttggctgaatagcctttgtgatgaacattgcgatgactccgccaacccaaaagcgctctccctcaaaggctttgattattccgctctttcgttggatttaatcgaaactttgcacgaagtttcttttctcttatcgatataagcctaaatttctgtttatttttaggattttgttaattcaacaaataaacaaagttttattctgaacgttgagtgcgacgatgaaatgaatttggagcggaaagaagaaaatcggataaccggggagaaattcaaagtgaacgccaccgcggaaggggacattt

SEQ ID NO: 63932 - DNA, 230 bp, Heterodera glycines
  Genomic contig location: Contig_ID=SeqID_7134; Location=1..230; Strand=-
  SCN-specific regions: Sequence locations=1-51,75-102,129-230
atttatttaagattttaaagtaaaaaagtgctttgtttgcttcatggtgtgtttgtttatttcttttattttgggtggccttttctttaatttgcttccaaattgggaattaaaatttaaaaacaaaagtgggaaatgcaattggactgtccttcttagcctgtctttgcgcttcaaatgagtgccaatttgatcgggtcactgaccttcgtccgtcggattacgacgac

SEQ ID NO: 63933 - DNA, 284 bp, Heterodera glycines
  Genomic contig location: Contig_ID=SeqID_34032; Location=1..284; Strand=+
  SCN-specific regions: Sequence locations=22-44,80-91,113-284
gaaaacgaaaacacgaaaaaattttgttaatttcagccataatcaagaaacataaaactttaaattgtattaccaaattgaagaaattgaaatccaagattttttggaaaagagtaaaaatgaataaatcaagaattcttagctaggtcataatccggaaaaaccggtcaaaaattcgccggatcggaccggattggcattttcaaaaatgaccgatttccggacccggaactctaatcgtctccctaatcctgagcccaattccgtccgcgtccgaactagtc

SEQ ID NO: 63934 - DNA, 95 bp, Heterodera glycines
  misc_feature (49)..(49): n is a, c, g, or t
  Genomic contig location: Contig_ID=SeqID_34032; Location=591..685; Strand=-
  SCN-specific regions: Sequence locations=1-95
acgcaatgcgaaaagcggcggtgcgattgtgcgcaaaaatggaagcganaatgagggcacaaattgacgaaacggcaaagaaattgttggcctga

SEQ ID NO: 63935 - DNA, 928 bp, Heterodera glycines; identical to SEQ ID NO: 34033
  Genomic contig location: Contig_ID=SeqID_34033; Location=1..928; Strand=+
  SCN-specific regions: Sequence locations=1-122,149-928
  Gene Ontology: Mol. function=neuropeptide Y receptor activity; Cellular component=integral to membrane; Biological process=G -protein coupled receptor protein signaling pathway

SEQ ID NO: 63936 - DNA, 767 bp, Heterodera glycines
  misc_feature (202)..(202): n is a, c, g, or t
  misc_feature (259)..(259): n is a, c, g, or t
  Genomic contig location: Contig_ID=SeqID_34039; Location=602..1368; Strand=-
  SCN-specific regions: Sequence locations=1-147,169-216,272-767
atggtcgcctttggaagcatggcgcgcaaaaagtcctttggacgcggacgagagccaacccttaaacaaaaagtggaaattgaggtggaaaaaacactggcatggtaacttattagtcaatgaaatagacatatgaaaaggttatcggaaatttaacagcaaaaaatgttggtagagagaaacaaaatttttatttctgttnacaaagggacagtcaaattaaaattgaaataataatttatattttagccaatttaanaatattaaaaaaccaaaagtggcattttttgtcttatgattaagccataagtaatattagtaaagccattaattgatgaggaatgttggcacctgtacgaaacagtcgatgccggccacgagtgtgaagtaaacggagcacgtctgcgcgatcattgccgcggggtaaccaatgggcgaaagcgacccatagccaatggaaagtgccaaggaataacgacgaatggagtcgacaaagaacagaaacaacgccagtgattatcacctgattagggcggaatgattggcgctcggatgggattagtggtaataaggcaattagccctaattatccgtgattggattttgtgccttaccaatgcgtcggaacagccgagtgccgaaaggtacaaactgccgctgtacgactgacgaagcgagggacgactgtagaaaaaacgcattacagtaagattgatatgattttaaaggaaatgcccctacagggtgctaggtcgtttcttaataaa

SEQ ID NO: 63937 - DNA, 467 bp, Heterodera glycines
  Genomic contig location: Contig_ID=SeqID_34040; Location=360..826; Strand=+
  SCN-specific regions: Sequence locations=1-125,150-203,225-236,271 -439,462-467
atgcgaaaagcgaaatgcgaaacgccaaaaaatgcgaataatgcgaaaggcgaaatgcgaaaagcgaaacctcggcccataggctacggtagaggtaattaattaatcacttacaccgtttaccgtattttaaattaatttttacagtacatctttggtggagaacggaacgatcggctgatttatttaatgcactattcatttgtgtttatttatttgattttactcattaaaatattaattatttaattaatgaattaattaattaatgatcattgaacgacgaacatttagtcaacatttaactcattccaacagatttttaaactgctgttggtcagtaaagattaactttgtttcatgcagtttttctcagcaaacagaaaattagagaagactttggaaaactttaaagagataacaggcggagttatggcattttaggaaaactaaaatttaaagtaaaa

SEQ ID NO: 63938 - DNA, 141 bp, Heterodera glycines
  Genomic contig location: Contig_ID=SeqID_34041; Location=332..472; Strand=-
  SCN-specific regions: Sequence locations=1-141
atgtggcatcacaaatcacggcattcccttttgtccttttctgttgccaatttttgtctcttttctctgtttttttggcattttgacgcaattttggccagggaagaaaattatgaaccaattccggatgaaaaggctacg

SEQ ID NO: 63939 - DNA, 802 bp, Heterodera glycines
  Genomic contig location: Contig_ID=SeqID_7135; Location=456..1257; Strand=-
  SCN-specific regions: Sequence locations=1-56,78-468,491-553,577 -642,664-761,787-802
atgagctgtaaaattggtatttttacttcaaaaagcacacactcatctagcagaagcagttatttggacaaggaaattgcaaatggtgacaaggaattgctgaatggcctaattaggggcctaaacgagctaattgatgattacagttgcccacacttatgcccaacagatgggcacattgtgcaaaaatttgtgccaattttgttcgacacacttcgaaaatggcaccaacaaaaagtgaaatatgtcaaacgcagtcaaacaatggcattggcatgctcagtggtcgaacatttgcttgcccgattggagacactgatcacaatgtttgttcgctttaccgtaatttatcctttttatgatgaagccccctcccccctcacctctgctgtttaccgtaattcctcccaattaccgtagtgtcatggtattttttacaatgggatttcgtacaattttttttcatttcaattgaacttagaacttttcctcaaaaaaacataatgaatttcttttttcctagaaaaaaagaaaaacctagttttttttggaaaaatgaaataaaattgaaaaatctatttaaactcattcgcattcgcttaccaaagcattgaaatgccatcagaaaatttagatgagaggtaaatttgaaaatttaatttgattggatgggttgtaatgattttcagggatttcaataataaatccaaattttctgaggctttcaaaaccaaaatcaaatccatatttcttttggaattatattttggcattttttaaattttccagagaagccacataa

SEQ ID NO: 63940 - DNA, 1248 bp, Heterodera glycines
  Genomic contig location: Contig_ID=SeqID_7135; Location=1709..2956; Strand=-
  SCN-specific regions: Sequence locations=1-123,146-723,745-816,838 -967,990-1123,1185-1248
atgagtcaggccggcggattttttatttctattctagcattacgccaagttgcggtcgaattacgccaaaatgcacaatttgaattgccctcaggccaacaatcatttaatcctgacaattttaagcaaaaagtgaaaaacaaattcgactttgtgataagaacattgaaagaaatggagaacacagaaaattatgagcaaatttggaattggaagcggcggcgattaagcagtagtagaagtggtttaagcataagcccaccacctcataatggcattgttctcggctgtgtgcttctccattttggcatcgcattgtccaaacgtgccaacgtggaacatacgaaatttgaaaatttttcaaaactgaaaaatgccaacggcgaatgtccaactgttcagtatgaaaggcgagattaccaatgtggcaaagtgccattcaggtgattagccccgctaatatgcgtcattagactgtgattaattgctgggcggagggagagaccaccggaacgagtgaatttttgcttcaatttttgggcactcgaaaaagtttgaaaaaatacaaaaaatttactttttttattagaagtgcaccgattgagctacaattgttcaacgaagcaattagcaattatacccgaacaatcagaatcatttccaacaaatgccaagattggaaatataattaccgcgactaattagccaattaaagtttttcacaattaaaattttaattatatgtattagtgacagaaactagaccgggctaggcgagatttttaactaggtatccggaatctggctttttaatcgaataattttataaaaattttgaaaatcaatgagtcaggccggcggattttttatttctattctagcattacgccaagttgcggtcgaattacgccaaaatgcacaatttgaattgccctcaggccaacaatcatttaatcctgacaattttaagcaaaaagtgaaaaacaaattcgactttgtgataagaacattgaaagaaatggagaacacagaaaattatgagcaaatttggaattggtctgagatttttgagcaaaaattttctggtaaaatgtgccaagggcaatttcatcccctttttggcaaaatttttcaatttttaattgtgaaaaatatattaacctaaaaatttaaatttaaattttcgaaaaaatgagaaaacttaaaaatatgtgtatgtatttcaaaaaatggtatctaaaaaataaa

SEQ ID NO: 63941 - DNA, 757 bp, Heterodera glycines
  misc_feature (94)..(94): n is a, c, g, or t
  misc_feature (100)..(100): n is a, c, g, or t
  misc_feature (103)..(103): n is a, c, g, or t
  misc_feature (118)..(118): n is a, c, g, or t
  misc_feature (127)..(127): n is a, c, g, or t
  misc_feature (134)..(134): n is a, c, g, or t
  misc_feature (155)..(155): n is a, c, g, or t
  misc_feature (163)..(163): n is a, c, g, or t
  misc_feature (170)..(171): n is a, c, g, or t
  Genomic contig location: Contig_ID=SeqID_7135; Location=3086..3842; Strand=-
  SCN-specific regions: Sequence locations=1-18,41-182,219-414,447 -554,576-757
atggttattggattaaaatggtaaggaaaaggattgttaaataaaatgtgttaaaattaatttatgtttttgatagtaatttttgatttatgtnagatgnatnagtttgaaaaagtgngtgattatntgatatnaattgaatatgttttggaggnatattatnggatttnnttgagaaaccgtaaaataataatatgtttttatttattttaaaataagccatttctcagatttggccaatgcttttgattctcaaaaaggaattggctttcaaccaaatgagcttattgctgatcagttgaccggcgatcagtttcaagttcaatttgtggcaatgttggcgaccttcgatttgaatgtccaaaggagagtcattagtttgactagaggtaagcattccaatttttatttgtgaaatttaaatttaaaatcaaatttaattatatgaatttcagtcctgcaaagtgagtacgaggctttttacgcttttcttgattggaattccattttcgggcagcatcagcagggcacttccggacagaatcagcagcaggggccgcctcctccgccacccgccggcggcactttctgatcagtaaaaagtgcactgatcagtacaattcatgttcattactctctgtttgtctgtctgtgcctgaatttgctgagtctatcctacaaaaaatatcgccaatttggcattccgtccttctcattcactggaaatataattaccgcgactaattagccaattaaa

SEQ ID NO: 63942 - DNA, 363 bp, Heterodera glycines
  Genomic contig location: Contig_ID=SeqID_7136; Location=31..393; Strand=-
  SCN-specific regions: Sequence locations=1-86,124-307,331-363
atgcatcagtttcaaaaagcccgtgattatctgatctcacttgcatatgttttggagccacattatcggatttccttgcgaaaccgtaaaataataatatgttttttatttattttaaaataagccatttctcagatttggccaatgcttttgattgctcaaaaggaattggctttcaaccaaatgagcttattgctgatcagttgaccggcgatcagtttcaagttcaatttgtggcaatgttggcgaccttcgatttgaatgtccaagggaaagtcattagtttgactagaggtaagcattccaatttttatttgtgaaatttaaaatcaaatttaattatatgaatttcagtcctgcaaa

SEQ ID NO: 63943 - DNA, 707 bp, Heterodera glycines
  Genomic contig location: Contig_ID=SeqID_34044; Location=61..767; Strand=+
  SCN-specific regions: Sequence locations=1-707
aatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttctcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaaacgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaac

SEQ ID NO: 63944 - DNA, 400 bp, Heterodera glycines
  Genomic contig location: Contig_ID=SeqID_34050; Location=1..400; Strand=-
  SCN-specific regions: Sequence locations=1-62,84-244,278-400
atgaacaccagcgaaacgcaaaagaagcatcagctgaccacttccacacccatcggttgcactgtcaaaaaccatcaaaaaccaccgctccgcaagcgaagtgttgccgacggcagtggcgaccgtgagaatggcacggctgccacaattaattgggccaaagcggacctttcagtgtgcgtaagaaacaattcacaaaattttggtttgtttcccccactaaatatttgaaaatttgatctttttactatttttcaaaaaagtaggagtcatatttacggtgattactttaatttacaccatttttgaagccctaaacaattcctcaaattctttcagttggcttaatgcgtccaaaaatgtctcttctcctgcggattcttttgccgcggtgaataaa

SEQ ID NO: 63945 - DNA, 347 bp, Heterodera glycines
  Genomic contig location: Contig_ID=SeqID_34051; Location=762..1108; Strand=+
  SCN-specific regions: Sequence locations=1-210,238-347
atgattccttcggtttgtaatggtgaaagtagcagttccgacgacgaatattacaacaatttttccaaatacaaagcgaaggcagcattggcattacgaagaaatgattgcaaaagtggcaaagagattactaaaaatgggaaaagcacaacgaagaaagtctcttcagaaccatcggatgttgagggtttgaagaatgaaacgattttctttttgaacaataaaaaatactactttagttttcacatcttgtccattatctgaacaattaatttcgcgggctgaagtcgatcctgagatttgtgtagttcaaattgcggacacttccgtaaactctgttgttgatc

SEQ ID NO: 63946 - DNA, 307 bp, Heterodera glycines
  Genomic contig location: Contig_ID=SeqID_34057; Location=704..1010; Strand=+
  SCN-specific regions: Sequence locations=1-307
atggtaagtttatcatcggatagacagtgaaatgaatccgacaaaaaatgcgataaatgggacataacacatacaaacattcagccaaatggaaaaaaatcaaataaattaatatattgtcccattaagaatgaacatttcattgcggacattagcgttgctcccaaattatcaattggagcatttagcctaattgtgatggccttctaattgtgcacgaaattgccagaaataattgaaaatccgatggaaagatggattaaagattgccctctgtatgcccgtccccattcacttgccgaatgta

SEQ ID NO: 63947 - DNA, 133 bp, Heterodera glycines
  misc_feature (11)..(11): n is a, c, g, or t
  misc_feature (43)..(43): n is a, c, g, or t
  Genomic contig location: Contig_ID=SeqID_34057; Location=35..167; Strand=+
  SCN-specific regions: Sequence locations=1-133
atcgacagttntggctctgtccgggggtgattctcaacgatgnaatgcatgttcgcacgtcccaataaatttgattttcgtcaaatatgtgccactatgcatcagactgcacttttgcaaaaagatccagtga

SEQ ID NO: 63948 - DNA, 182 bp, Heterodera glycines
  Genomic contig location: Contig_ID=SeqID_34059; Location=97..278; Strand=+
  SCN-specific regions: Sequence locations=1-43,95-182
atgatggtaaatttctcaaattcgttaatttaagctatcgaagtttatataaatttaccaatttttagaaattaaacatttttttattattattctcgagaaaatctccccaaaatgatttcttttttttgtaaaaatttatgaactttagggggtcaaaagggccgctttataagatgcga

SEQ ID NO: 63949 - DNA, 843 bp, Heterodera glycines
  Genomic contig location: Contig_ID=SeqID_34061; Location=37..879; Strand=+
  SCN-specific regions: Sequence locations=1-336,358-426,450-821
gccaatttcttgtgttcttcaaagcattggatattatagaagtctcgatggcactcgtcacagttaatttccgggcacttttccgcacatgggaacccgagtcccatccggcaacatttcttgcagcgctccttgcattcaattcggtgtcgttctttggtccaaaaggtcacttcacagctaacacaaaaatttttgacgcaaaaaaaccaggacaccgatttgatcccgtcccagtgattgccttctcttatcacgcaaacttcgtgcttacggacaccttcccccttgaaaattggcttaagtccaaatttctaaaaaaatgtaaaaaatgggttaatttcaagctaatttggttaccatttcaaaagccgcaatgcgaaacatatccgggaattccctgtcccaaaatttttgtacaacctcaaggtgttggaaccaaaagttttgtcacccatgctaatccctgatttttccatcagttcgatggccaattccatttgtttcttctccgtcttcatcagataacggaatttgttttccgttatacctttccctatgagctggtagcttcgagcaatttccaaagcataaaaaagacctaaacacaagtaaaagatcctaaatttgtgcggaatttatgggatttggaactcactaaatttcccctttggcgtattaagccgacccgattcattgatttgggcgaggggacaaaagcgagacattttatgaagggagtaaaaaaagccgttgagttgctactgcgagaaaattctttcgggaaaaatacaattttgtttaattatcagaaatatcaattaaaaattatcaaattaaaaa

SEQ ID NO: 63950 - DNA, 713 bp, Heterodera glycines
  Genomic contig location: Contig_ID=SeqID_7140; Location=1102..1814; Strand=+
  SCN-specific regions: Sequence locations=1-73,105-160,182-554,581-713
atggctgatttaaagaaaatgaaaagagatacagaggcagagaaaacgtgagtaaatagagcaaagttaggactataaaaaattataagaaaaaaattttattacttcaaaaatgaattattggagggccgagtctaaaaatggtctccaaaaaacggcatttttcaagaccatcaaataacaaaatgttttaaaagtggttttggaaattccgaatttaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttctttttttgttatatcaggttacttttttgaccataaaaaaatcgagaaaaattagtgggccaattttcaatttttgcatggtcgggaaaaaatactaaaaaattgaataagcaaataaaaaatgaaacaatggcatgaaatgaaagaagactttctgacgaacaaaattaaaaaagaattattaaaataactgcagaaattacggagttatgaatttttgaatttgtcaaaaaaaattgtgcggaaacttatgttacaccctaagtaattgaattcctttatgagattggaatttaagcccgagggcagaaatgaaagaacga

SEQ ID NO: 63951 - DNA, 396 bp, Heterodera glycines
  misc_feature (99)..(99): n is a, c, g, or t
  Genomic contig location: Contig_ID=SeqID_7140; Location=2391..2786; Strand=-
  SCN-specific regions: Sequence locations=1-396
tggtacttttgcttgccgctgccacggtttgctcacttttctattgattttcatctccgttatgccaagccggtcagtcagttgagaattttgaataanaatcaaaaacaatttcaatttaataccaaaattccatcaaaattatgccattttcattttccatttttgttaaggcaacttaattttgtcggcaaatatttgacgggcatcgaagggtacaaaatggtcgactcgcagtctctgcggcgctttgttttccattttcttcgtcaggacggcgtttttctgctgcgaatggtggccacgcacgcgggcgaattggcctgctacgatttggccaagaaattgtgggacaatttcatggttcacaaagagggggccaaaatgcacgacgta

SEQ ID NO: 63952 - DNA, 1055 bp, Heterodera glycines
  Genomic contig location: Contig_ID=SeqID_7142; Location=1..1055; Strand=-
  SCN-specific regions: Sequence locations=1-373,396-720,742-1055
cccaacatgttgttgtactatttcgccagtgcggtaaagtccatccaattccatgtggacgacgacataatcgacaaattgaattattattacacaacggcaattataattggtaattgtgcgcgggaggggtaaaaagagcgtaaaatggacttttgaggggaaaattagcacaaaatcattgtcaaaaagtgtcaaattgccaaaaggcacaataagcgcttaattaccattttaccggtgaatacaccctataagtcagtaatgttattttacattatataatttttgtcataacacattgatgtgccattttcagctacccaattcatgccatcgtttcccccccccccgctaattaattcggattcattcccaacggaattgggtgggtcacaccaactgaagcccttaaggagcgtgtcccatcataggcatggaaaagagcattgtgaatgaatggtgagggagaggagaatgtttgagtagggcgacaaccgacggacggaaggctaatgaattggggggggatgaagcagagggatgaagcaacttatttgttggccataggaaatgagcaaaagcatcgcccgggcaatacaaataaaagcttttgctgaaaagatcacacgaactcgtcattagcagaaaactgagggaaatggagaaagtgttttattgcgttgaaaagggaaatggagaaaaaaatgaaatattagagggtaattaataggaaaataaatataaaatgggaagacattaaaagcatcgcctattttgtaattgttaaattattattgggttcattttcagttttcgccattctcgtctcctccaaagaatacctcggttggttggttactcttcgcttttaatgattttttgtaattgccctcattaggcaaccccattcaatgttgggtgcccgccactttcaccgagccgatggagcagtacacggagaattactgttttgtacaggtagcaaataattgaatagcataagatggctatttaaatggaattcagagcacctattttctgcctctgaatga

SEQ ID NO: 63953 - DNA, 314 bp, Heterodera glycines
  misc_feature (4)..(4): n is a, c, g, or t
  Genomic contig location: Contig_ID=SeqID_34069; Location=375..688; Strand=-
  SCN-specific regions: Sequence locations=1-239,261-269,293-314
cttnaagaaaaatgcgccccttttgcgcccttccgccgacggaaaaagcgaacaattggataatcatttggccgaattggaacttttgatgaacggcgcaagggaagcgctttcagtggatgagctcctccaaaacgagactcagctaatccttgttttgtttgagatgaaaaattcaatttttggcgataaaataacgcttaattcaaaaaatttgtgtgagggggaaaactttttgcagtttttgtttattttgcatgaaaatgccattggagaactgatgagaaaagctgaatttacggcacaattgaaag

SEQ ID NO: 63954 - DNA, 278 bp, Heterodera glycines
  Genomic contig location: Contig_ID=SeqID_34071; Location=287..564; Strand=-
  SCN-specific regions: Sequence locations=1-278
atggtcaaattgagtcaaatgacttatcagattcatgaaaaggacacaaaaatcacagcttcaatttctcaggaatgggaagaggttgaaagccaaatggtcaaagcagttattggtgattacagaaaaatatggttaataattatgtctctaattctcaccattttgtcaattgacttggcgataagattgacaattggtttaagtgaaatttatgcagggaatgggcgcttaggcaatttttatttggtacaacaattcagaaagctgggaaaagg

SEQ ID NO: 63955 - DNA, 2198 bp, Heterodera glycines
  Genomic contig location: Contig_ID=SeqID_7145; Location=165..2362; Strand=-
  SCN-specific regions: Sequence locations=1-365,387-550,572-597,619 -627,655-914,936-1058,1086-1465,1487-2198
  Gene Ontology: Mol. function=oxoglutarate dehydrogenase (lipoamide) activity; Cellular component=mitochondrion; Biological process =embryogenesis and morphogenesis
atgccgcatcgtggtcgtctgaatgtgctcgccaatgtgtgccagcaaccgttgagcaccgttttggccctgttcaacacgttgaagctaatggacgagggctcccgcgatgtcaaataccatttgggcgtgtgcattgaacggctgaatcgccaatcgcagcgcatgatcaaaattgcgttggttgcaaattcgtcatatttggagggttaggcattgaaaatttggattttcgacgaaaatttataaattgtttagctgtcgacccggttgttcagggcaaagtccgtgctgaggcattttacagcaacgatttgcactgtgaccgtcacatggtgagtttgattagcaattgtcttttgtgtagaaaatttcttcaacaaaaatgcgaattttttgaattttcgccaatttttctttgattatgaatttagactgataaaatttggactgttcattagcaaatccaataggttatagaaatctgaccgtattgaatatcttaaacattttcggaaaaattgtaagttttaaaaaaatcgttattaacttttaaaatcatttttagtttcgtattgatttgaattttttatattgaaatcctttaaattcattgtcgccatcgccaatttcccctcccttccccaaaaaaggcgctggtgcttcacggtgacgcctccttctccggccagaacctggtgatggagacgttcaacctcaaagacctgccccactattccatcgacggcaccattcacattgtggtcaacaaccaaatcggcttcgccacggacccgcgcgcctcgcgctcttcgccctactgcacggatgtcggccgagtcatgcgcattccgatcttccatgtcaatgcggacgacccggaggcggtgatgcgtgtaagaagcatttcagaaaataatatttttgggattattacactaataaacaattatgagaagtgaactgcttaagagcctcccttttatggctccacaaaccacaaatctcattttttgaaattttttaaaaatttttcactgaatttctttgcgatctatttcaaatgtttttgctttattaaattttcgagttgatttgtatccttaaaaaaattccgtaggtgtgcgatgttgcggcccagtggcgcaaaggagttcaagaaggacgtgatcattgacttggtgtgctaccttcgtcacgggcacaacgaattggacatgccgatgttcatgcagccgttgatgtaccagcgcattcgacagacaaagccgttgttggaccagtaccaggagaagattttggcggaaggcatcgctgaccaggcacattattggcatttcactgtgtttttaatttttcttagggaaaattcgatttttatcagggccaaattggattggacacttttccgggtttggtggccttttcacactcgaaaatgcccagtttgacatacttgtcttttataaatttagtttaaaaatttgtgattcctaattatacccccttggactcctcacgaggggagggtgaaacccgttggccaactcgtaaattttttttaactccccctaaaactccaacccaaaatcctggtacataactctttgattgtgagggttcccatatatttgaatcaaaaaattcatattgccccaggaatatgtggacaaagaattgaagaactacggcgccattctggagaaagcgcacgagagtgccaagcaggtgaccgagctgtgcaaccggaactggtcggacacgccgttgtacgacggcaaaatcccatcccaattgttgcccaccggcattgagcgcgactcgctggagcacattgtgaacaaaatctcgcaagtgcccgacgggttcaacctgtacccgagactgctccgactgctcaaaggtatgttggtgggctcaaattcagcatttttttttgtaggccgaaaagaaatgctgagcgaaaacaatttggactggtccattggcgagtcgttggcgttcgggtcgttgttgatggaaggtgtgtttttattgggttctttttggggtaaattccgacttaaattgtgccaggaattcacgtgcggttgtctggtcaggatgttgagcgtggcgccttctcccatcgccatcatgcgctccatgatcagctgattgaccaaaaaacgtacaaccctctcaacgacctttccgag

SEQ ID NO: 63956 - DNA, 1776 bp, Heterodera glycines
  Genomic contig location: Contig_ID=SeqID_7146; Location=294..2069; Strand=-
  SCN-specific regions: Sequence locations=1-387,409-452,474-1244,1274 -1776
atgttccccatccgaccgccgcccagcgctgtgcacatcaatgccctgctcaacccgccggacgagttcgatgagaagccgaagcacaacctgttccgctggctgcacacaccgcgcaaggatggccgtccgaaaattgtgaccattcgcaagtggcgcaaaccgcaatgggcttcgttcatgccaagcttgatcacggtccgaaagattttacggcattttttgcttccatttttttcatttttctaatcgattttacgcgtcccatgccatccacagtttcttaggccataacttttttcttaattggtcaatgcttatattcttggtaccaatcaaaagcttgaactctcgggatcttataaatccaagaaaacagcaattacttgcattagaaaataaattacaatgagaaaacatgaaattcaaggtttttcgagtattttcaagaataattttttgtctattgcttttagccgagaatttagttatacaaaagcttctgtagactttaagctttcgtttgataccaagaatataggcattgaccaagtatgaaaaaagatatgcccaaagaaactgaggatgatagtcattcatgggacgcgtaaaaccgtatatttgcattttttgattccatttttttttgaatttcaatcaattttcagtttttcatcgctccgagtgccgtccctgtcaacttcctcgtcatttgtcacattgcatgcaataccaacttccagaagatggaacgggagaatgaagagacggacgagcggctgacgccgaatgcgcaagtcactgcacatgccgtgattgtacgccagcggaacggcactgatcagcgcacagtggcgaagtggaagtgggaggcaaatcgaatattggacactgctatgcatcaacagttcggattttctattttcagtagccgcatggcaaacgacgtttggctggacactctgttttggattgaccgcactgaggtgggcacgaagttttgcactgatcgacgcgcgcttcggcaggctggtggccacgcatttcaaactgcgcaaatggaagctgggcgagctgggtattcatcgggcaccaagcggatgggactggggcggcacggcgactgtcaccgttatggacgaccacccgttgatgaagccactgccgcttgccaagtgttctgcaccaaacggcgtgattggcttccgtgccatctacatttggtcgtggcgaaatttttttgcaaattttcaaaaatttcccccatttttcgcacaggtgcgtcgacctggaagttactttcaatgagaagccgaagcatcaactgttacgatggctgcacacaccactcccagatggcagtccgaaaattttgactattcgcaagtggcgacgcgcgcattggtctacgctcacgtcgagcctgcgaacggtcggtcggaaatttttttttttttttgcgtttttccgattccaattttttttttgttgtaattttttcaatttttccagtatttcgaagcgccgagtgccattgcggtcaactacgtcgtcgtttgtcatcgggcatcgcgtcgcaacatcgaggtcgttgagcgggagaatgaacgaacgggcgagtggctgacgctgcgttggcgtgtgcccgtggaggctgtggttgtacgccagcggagcggcacggatcggcgcacagtggcgaagtgggagtgggacgcaaaccatactttggacactatgctgtgcatcaacatccaggacagcgacattgggtag

SEQ ID NO: 63957 - DNA, 660 bp, Heterodera glycines
  Genomic contig location: Contig_ID=SeqID_34073; Location=343..1002; Strand=+
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 63958 - DNA, 316 bp, Heterodera glycines
  Genomic contig location: Contig_ID=SeqID_34074; Location=45..360; Strand=-
  SCN-specific regions: Sequence locations=1-63,88-231,315-316
atgaacgtaaattatatagaaaaaagaatttacaactactgtcgaaatcaaccactgtcgaatacacctgctggtacgtgcaaaagtgccgacggagacaaaaaataaatatttatgccatactattttccgatgtaaaggaaccataataacaaataattcgctcagctccaataaatgtctatgataaaaattttactaaatcttttgtataattatagcttatcccatagagaaagaggaacagaaagaggaagagagagaggatgagaaaggggaagagaaagatgaagggaaagaggaggagaaagagaaa

SEQ ID NO: 63959 - DNA, 594 bp, Heterodera glycines
  Genomic contig location: Contig_ID=SeqID_34075; Location=38..631; Strand=-
  SCN-specific regions: Sequence locations=1-62,119-135,160-293,315 -320,342-379,401-594
atggcatcatccatcggttcgtccgattcctttttccgttcaacaactgatcaaagtaatggaaaaattttaaaaaaattacgaaaaaagaaaataattattaaaaataaaataaattcaaaatctaacttttatcagcaccagcagcatcagcagcagaagaagtgggcaaatacgaagtgttcagttggcacggaaatttgagtgatcaattgtcagctgaactgttcgtcactgatcagcagctgctgaaggtgggccatttttgaatggacaaatgatcaaaccgcggcgggaggggaggggaggccaaaaacagagaaagatttatggaaaatttagttcaaaatttccattcgtttttaaaggttttccaatgatataaaattaaaaggagaaagggccgacctattcctcgaacaatttgatggcattttgccaaaaccattcaattatgaaatgaacacaaattacaaattatttattgggctgtaattatttgttatatttaaggaatgccgagaaaaacttgcgaagtccgaattgaaggaaacgaaattgctgtggaataacggtgaactgaatgctgaaagt

SEQ ID NO: 63960 - DNA, 387 bp, Heterodera glycines
  misc_feature (350)..(350): n is a, c, g, or t
  Genomic contig location: Contig_ID=SeqID_34079; Location=17..403; Strand=-
  SCN-specific regions: Sequence locations=1-387
atggcccgccaaatcgggcttggagaaaccggagagcacttctggattcctccgaagttcctcgttaagagcaaggaagagctgatagattatgtctatcctaacttccaacaactccttggcaatgacaacgagctactcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtgcgaagtggctgcgttgaaccggcgcacagactcgggcatgcccccgcacagtctccggcttanagtcggatgcgtcgtcgtccttcttatcataaagtga

SEQ ID NO: 63961 - DNA, 1005 bp, Heterodera glycines
  Genomic contig location: Contig_ID=SeqID_34079; Location=538..1542; Strand=+
  SCN-specific regions: Sequence locations=1-12,34-146,168-290,358 -496,519-748,773-888,921-1005
atggtgatatcatcaatgatgatgagttgtgcctcacgaatccgtcgggcaaataagctctccagcggaatgcttgggagtttgtctaatgacacttctctacccagacgaaacgtggaatgggctgttttcccatatggcagcaaaatgactgcacacccagtggatgccgtagcaagcactttgtaggtgtatggggcctttcgcaagcgcctaataatcacattataggctttctattaaactagtcaacgagatgccatttcatttccacgaattcgaagtttttcaaaaaataattattacattaaattttcaaatattattattcattatttaaaatgaaattttttaattgttatcatttttgtgataggaaaataaaattatttgttttgggtttagtttattttttatgggtttttcgtgaaggatttttatattattttcgaaagtatttattcgtgcgatttattaattttatttaagttcagcgaaatcttttctttcaaaaggttcagttctcattacgattgttgtcggcgcatataatatattaagtgttattttattcagctaaataatatttgcattttaaatcgagatataaaattagttttaatcagggggttcttcaattatttttggattttttgctttgagagttctattttttgcgaaactattcatttatttgtttttattagttgctatttttatttttaccatttaatttagacactctcaaacaaaaatgttattttctatcaaatgaattaattttttatctactaacctatgatgaagattgattggtaaaagatttcaatctgttttgtcattgtttatttgttatactgaagacattattgagtacagcagaaattcatttttttaataatattttatttattttaaatgcaattataatttgatataatcatcagttattggacttcattatgatgtatattttgcttttaatgtagtctagactaattttta

SEQ ID NO: 63962 - DNA, 56 bp, Heterodera glycines
  Genomic contig location: Contig_ID=SeqID_34080; Location=71..126; Strand=+
  SCN-specific regions: Sequence locations=1-56
gctatagggaagctatccccgaaggattcggtctcaccataaatctgggcgcatcg

SEQ ID NO: 63963 - DNA, 986 bp, Heterodera glycines
  Genomic contig location: Contig_ID=SeqID_7147; Location=277..1262; Strand=-
  SCN-specific regions: Sequence locations=1-986
atgccttctaagcaacgaaatttgcgaaaaaatgagcaagagcgttatcagcggcggacggagaaatctgtcagtcgggatacctcacccgtctcagtcgggagtgcagatgggaatggtgaggcatcagcatctctccggggcaccaccaccccaagtttaagtgctttgcaaataagcacgcctgcttcttccattggaagtaaaaaaaggggaagacccttgaaagcaggagcgaagccaattttggcaacgcaagaaactgtgtcctcaattggcacacctcgaactgctgtcacccaaagtgaccaaggttcgccgtgcaaaaaaaggggaaaggtcactgagtgtgacaaacccacgtttgcaaatgaagctattgcttcaacgcctgtttcgactcaaagtcgtggagggcgaccagttaagcaactgggagggcatgccggtaaaggaagaggcaaaaccaacgagtctatgagcaaatgctctgaaatggaccaaagtgtggaaaacgctctaagtccggcaccctcgcacattgtgtttgaaaaaattgatttcagctctgtgcaaattaatttcgccacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctaccacatatggcag

SEQ ID NO: 63964 - DNA, 419 bp, Heterodera glycines
  Genomic contig location: Contig_ID=SeqID_7148; Location=1012..1430; Strand=-
  SCN-specific regions: Sequence locations=1-354,377-419
atgcgcgttgtgcaacgacatttgatgaacatttccttttttgaccgtcttcaactcggcctcaaattggcattgctttcgccacgtttcaatgcgtttgtggacaaacatgttgatgacgagagcgaattgacaatttggagagcaatcgaaattcgtcgcaaggtcagtgtcagaacaacggcaccacaattatttgtgattatcggaattatttgtgattatcggcgctgtcaattctgtgccatttccattgcccgaccatccgttgtccaacaaaattcgctctgaatttccgtttcgactcatttcgaaccccaaactcaaatttggtaaaaatcaaatttcgttttcaactaaatttacagtattgggcctaaactccacaagagccaaagaaacttttatatgggaataaa

SEQ ID NO: 63965 - DNA, 372 bp, Heterodera glycines
  Genomic contig location: Contig_ID=SeqID_34084; Location=676..1047; Strand=-
  SCN-specific regions: Sequence locations=1-372
atgacccgcgtcaatatctggatttattacgtaagttttgaaaaaataatccaaaaaaaaaacttgacacaaaattaatgtgcataattttcagaaattggaatatttagaaaaaaaattaagaaaattcctctccctagacagattgccatcagctcttgcataggaatagccttctcaaacatcaacataacgatgaacacacttttctcgcatatcattgggccccgaatgcaatccaagcagcagggaatgctggagatgttcggcggttttggacgaatgttgggcccgctactcatcgggtttgacggggggtagtcgagagtcttgaatctgattacattgatcagttttgagtcggataataaa

SEQ ID NO: 63966 - DNA, 49 bp, Heterodera glycines; identical to SEQ ID NO: 51181
  Genomic contig location: Contig_ID=SeqID_34086; Location=404..452; Strand=-
  SCN-specific regions: Sequence locations=1-49

SEQ ID NO: 63967 - DNA, 539 bp, Heterodera glycines
  Genomic contig location: Contig_ID=SeqID_7150; Location=420..958; Strand=-
  SCN-specific regions: Sequence locations=1-62,86-279,301-382,406 -483,515-539
atgtccgcggcgcaatgtcatgtaatccttgttcgctacactaatttatgctatgagaatggtacaaaaagtatcccttcagctgtccttcagcacatttttttaaattttgaggtgtaggcccaaaacggaaaagtaccaaaattactatttaattgcatatttttttttgttttgaaatttatgccaaatttcgcttaaaaatttcgataaatttaagaaaaaaatcgacaaaaaatgtcaaaatatacaacagatgcaaatttctgtttatccgaacaaataagaatatttttagaaatttatgatgaatttcgaatgaaaatccgtcaaatcaaaggagaaaatcgacaaataatcatttaaatcgatcggacatttctcaaataattcattcatttcttttccaatgatcaattggcgatccgtaactttgactacctaagggaattttggaaaatcaacagtttaagcggcttgatgttttaatatattttaataacatataaaatttgttttcggcggttttaacaattaaa

SEQ ID NO: 63968 - DNA, 376 bp, Heterodera glycines
  Genomic contig location: Contig_ID=SeqID_7150; Location=1050..1425; Strand=+
  SCN-specific regions: Sequence locations=1-28,50-376
atgaattgccgatggtaataaaaatttcaaatttttcatttaccctaaattcattttcctcgcatttgagttggatttgcaacgacgtttggatggacattctcccatcttttgaccatgctcaactcggactcaaaatggcactgctttctccacgttttgatgcgttggtggacaaacatttcgatggcaaaagcgaattgacaatttggagaccaatcacaatttgcaaagatgctgttgcagcagtgccgaacttagctgtgcttatcgaccaaggcaattcagacaatttcgtgccatttccattgcccaaccattcgctgcccaacaaaattcgctttaacaacctttggattgagtaatacaaacacaa

SEQ ID NO: 63969 - DNA, 166 bp, Heterodera glycines
  Genomic contig location: Contig_ID=SeqID_7151; Location=201..366; Strand=-
  SCN-specific regions: Sequence locations=1-166
atgtctgttccaatcagtttgttttcatttcataccgcttcaaagcgtaatcaatcgcaacagaacgagcgggcaattggccttgaagcagcacttgatcaattgactgttggacaaatgacaactgagaagcacgctgttgaagctgcaaagaaattggactatt

SEQ ID NO: 63970 - DNA, 56 bp, Heterodera glycines; identical to SEQ ID NO: 58360
  Genomic contig location: Contig_ID=SeqID_7151; Location=1842..1897; Strand=+
  SCN-specific regions: Sequence locations=1-8

SEQ ID NO: 63971 - DNA, 485 bp, Heterodera glycines
  Genomic contig location: Contig_ID=SeqID_34092; Location=79..563; Strand=+
  SCN-specific regions: Sequence locations=1-41,63-154,189-416,471-485
atgttttgcgttcgccgcccacgtcgtcgtcctcaatgctcagatccgatcttgcgcagttatcgtcgtggaaaggtgaaaatgttttcaaaaaaacgtaatttaaacttaattgttttctttccaaattacatttttttttgttctatgagtcaaaatttttaaattatttgtttataaatatttttgtcctttacaggagcacgtggtgctcgaattggggagtccgatggcgatccgagataatgacgaggacggggcaaacaaagaaattatcgatcaggaattggagggtgagtgaaaatgccattataaatttttgctttcaattattattattattattcagtcactctcgaaggcaatgagaaagagtgttaggccaaggcgcacagagtgcaaattttgatatgatgaatttaaaatattaaatttaattatttttggttttaaattttcatttttaaaatcatttctaagctcaa

SEQ ID NO: 63972 - DNA, 231 bp, Heterodera glycines
  misc_feature (192)..(192): n is a, c, g, or t
  Genomic contig location: Contig_ID=SeqID_34094; Location=756..986; Strand=+
  SCN-specific regions: Sequence locations=1-106,133-231
tggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaactttttattaacattntggtgcgtttcagagcacgttctaaaaaatatttatgaa

SEQ ID NO: 63973 - DNA, 222 bp, Heterodera glycines
  Genomic contig location: Contig_ID=SeqID_34097; Location=654..875; Strand=+
  SCN-specific regions: Sequence locations=1-56,80-222
atgacattccaatctctggaactcaactcaccagcatttcaatcgccaggactcaatccaccagcattccaatcactgggactcaacccaccagcaattcaatctctgggactcaattctcaagctttccaatctctgggactcaaatctcctgcattccaaacattgggactcaacccaccaacatttcaatcactgggactcaacccaacagcattctaa

SEQ ID NO: 63974 - DNA, 618 bp, Heterodera glycines
  Genomic contig location: Contig_ID=SeqID_34098; Location=535..1152; Strand=+
  SCN-specific regions: Sequence locations=1-163,202-224,248-303,332 -369,392-415,437-444,466-516,538-563,586-588
atgccaaatcaaattttttcgccggggtttttgactattttggagctgggcgaaatgagcttggaccaagaattgcaacgtggtaaaccaaaaaaatcaaagaatcaactgatcacaatggtaaaagatatcgtgagcactttggatgttttgcacaaaggttattaactaattagtttattaattaattattaattaattgtcaataatagagttaacgattctaaattaaaattatttaattaatgtgaataatatgaaaaactgttcaaagacaaaaaaaaatattgtaattacttgaacaaaataattaattattttaaatttaatacatgttcgatcctttccttactgattttatcgaaataattttaatttgttttttaagttgcaatgcatttggacttcaagccgttaaatttgctgttatttaaaaaactcagtcttttttcttccacagatgtttcaataaaattgacggattttgatggtaattaaggattaattaattaattcagcttttgattaaaatagtgtaacatcattgaattaaataattcatgtttatgaactctttttaaggaattcaaatataaattttattttagtaattaatta

SEQ ID NO: 63975 - DNA, 89 bp, Heterodera glycines
  Genomic contig location: Contig_ID=SeqID_34099; Location=722..810; Strand=+
  SCN-specific regions: Sequence locations=1-89
caaaatttaaataacgggcgctaagcgcccgtccaaggccgcgaagcggcctaacaagctaaaaaacgggcgcgaagcgcccgtatgag

SEQ ID NO: 63976 - DNA, 329 bp, Heterodera glycines
  Genomic contig location: Contig_ID=SeqID_34100; Location=272..600; Strand=+
  SCN-specific regions: Sequence locations=1-197,220-250,289-329
ctttgatttgggcccggcacattttatcgcattctcaacagagttctatttttggcccaattattatcgctttgaaagtttggcagcccaatggcattggctgattcgagatttggaagtaaaaacttgaaaacttactttttttttttaaaactaagattttttaagaaagctaacttgaacagacatcaggtgccatggatcatcacaatgggccatcgtccaatgtattgttcgggtaaatagagacaaaaaaagaaaaattaataaaaaatcaaaataatttttcagatttttctggcgatgattgcacaagatatgactcaatt

SEQ ID NO: 63977 - DNA, 368 bp, Heterodera glycines
  Genomic contig location: Contig_ID=SeqID_34101; Location=390..757; Strand=-
  SCN-specific regions: Sequence locations=1-178,201-368
ggtttataatcaactacgccggacgtcttcgcaacaacggcacacgcactcgtccattgtttcgttccgaagaatggagtgtgtatgagcgcacaatgaacggcacggaccgcacaaacaacttcgccgaggcgtatcatcgcacgttgcaacatgcgatcggacatggacatcccccaatttggaaattcatcaacattttgcgtgagcgccagaaaataattgacgtggacttcgaacatttcctcgctggaaatgctccgccgcagaaagcaaagcgttaccgtgaagcggacagacgaattttgaggattctggagcgctacaatcgggaaaaagcgcagccgcaaatcaacgatgatcactag

SEQ ID NO: 63978 - DNA, 385 bp, Heterodera glycines
  Genomic contig location: Contig_ID=SeqID_7152; Location=56..440; Strand=+
  SCN-specific regions: Sequence locations=1-130,152-249,272-385
atgaatctcctaaacggaatgccaagcccttggaaatttcacttagaagcgaaatggacgacaatgtgagggaaaataagtgggtaaagcaattgccaatgaatgctttcttttcagagaaccgtccgattgtcagctgatggacgacccaatggttgaagacaaaagagcgccctttctcgggaggattttgcagttttgcgaagtaagttaattcacaaatgaattcacgcgttttccttcccgggattaaatttttaattataggaaaataagcggaagtactgctccacgacactttgttccacactctgtgactttgtattgtcagctgccaaacaataattctttttttgttgacaaatttactttttaattattaaaa

SEQ ID NO: 63979 - DNA, 1606 bp, Heterodera glycines
  Genomic contig location: Contig_ID=SeqID_7153; Location=573..2178; Strand=+
  SCN-specific regions: Sequence locations=1-1606
atgtataaatgccaatcctggcaaggaacaactcggaaaaatgatcggacgcgaagggtttttggcattgccatgggaattggaaatgacgatggagacgtacaatttggtgatggtaaaaaagacaatgcaaattaacaacaattgtcaaagatagccattctgacgagcatggaaagagagacaacagcgaatggcattgccaattcaattcacaaatttcgaaccgaacaaaggctggatgaaatcagaaaactgtcaaaggtaacgcaaagagcaaacagtccgaaattaaataggtaactcagtcaaataactttgtcagttttggtttgccgaaattgggcagagaaacgttacattcgatgactttatgcagaaagttggaaaagagacattggttgttctttcaacaattacagctttattttctgagttttgtagcgaaattccatgcaacgcttccagaggacgagttacgacgaagaagaagtgatcaaaacccaaacaatgatcacttggctttcgcaaatgcaactttggtcagtatcaaagcaaaaaggaaaacaaacaaaaaaaaatcagattattaaacaattaatgacactgccttccaaacttcagtttccagcctgtttttgacatggataattccaaaccgataactgaccaaggtcagttcttcatgttggttttgaaacataatgctgacaaactgaatggacaacaagttgattgcatgagtggtaatgtgtaagaggatgcaatagaaataaacaaatggtttttgagtggatttccacggaaggccaagttcaacgacacggtttatgggaagtaagggaataaccaaagacgggtttacggatgaggttgttactgtcgatgggaattcaaaaagtaaatgtaaactcaaaaaagctatgcattggcatgatgcacgaaataactgtcgaagtgaaggccctttacaaaatgttgccgaacgatgaggaaggaactgcgtgccgtgaattaaccgcgagtgtggacaatcagtgggagggccggaacatcttcaaacagtttctgcaaaatctcagatacgactgtcaccttcgatgtcgaatggaatttattcgtaatttatgtcactgtacgggtccaacactgagttatctgatcaaagacgaagacgaattggccaagtggccgctttgtgattattcaaaatgcgaaactgagtaaactaagaaagcatttgcttaactaacgcattacttccgcagaatctccggacgcaattacagcgatgaagaatgcagcaaaaactgtttcagagattgcgaacagatacgcttcagcgtaacacatgaaaagaagggcaaaagcttacgaccagggaactttcttaacactcactcattacggtgtttttattgactaaacaatttcagaactgacaaccgttgtcctaaactggggctcttttgagtatctgacattggaacaggattgggtttggtctgtgaccacattcatttcggcaatcgggggaagcatcggaatgtggctcggactgtccattttgagtttgatccaggcaattttggattgtcattgctaa

SEQ ID NO: 63980 - DNA, 58 bp, Heterodera glycines
  Genomic contig location: Contig_ID=SeqID_7153; Location=2462..2519; Strand=-
  SCN-specific regions: Sequence locations=1-58
ctttgctcactccttccgtggcttcttcttcggggtgttcttccttcacaattaacag

SEQ ID NO: 63981 - DNA, 787 bp, Heterodera glycines
  Genomic contig location: Contig_ID=SeqID_34102; Location=36..822; Strand=-
  SCN-specific regions: Sequence locations=1-171,227-237,270-766
atggaaccttttattgtgcgtatcagttacgcagggaatttgcgcccctatgaactcgctgaatatgaaactatttcaatgttgaaagtgcgtgtcgccgtttttgagggtgtgcctccaatccagcagcgtcttttttttcaagtagtcaatttgtcatagaagaaagtcataattttttcatttaaatatatttaaaaatatcataattaaatatttttttaaacgaaaaacatagtaaaagcaaataaaaataaattatttccccccttttcagatgatctgagccgggctgcagtgatcaattcaccgcgtccaaaaccatcattttgcgcctcaaacccattcagtggactcattgttcgacgctccgcttccatgggagacgcgcggtaattttcaaaacgaaattattaacaaaaacaatttaattagattattcattaattttccagaattcgccaaatgactgctcacaatcggaacaccgaaaatggacaaaatgaaaaagacgaaatggcggggaaaaaatttaaaaattgaaaaaaaaaacaaatgaatttgtatcttccctacagataattgttattctgtaagaactttttttttgataatacatactagagaagtacgggaccggaacctggtactgaaaaaacgtacaagtgggtaccagtatctaagtcccggcctttcaccccgaaaagtaccggttccggtttatctcgaaattgccggtcccgtacaactctagtacatacatatgtaatattattattataataaa

SEQ ID NO: 63982 - DNA, 432 bp, Heterodera glycines
  Genomic contig location: Contig_ID=SeqID_34104; Location=340..771; Strand=-
  SCN-specific regions: Sequence locations=1-140,300-317,345-432
atggctcatcgaacacctcttttgttcgcggcggctgcactgggagcaggtgtggccgggtttacggcctggtggctgtggacgcggcgtgatgtcgccggcggcggcggacccaattttggcggcgacgaagtgcccaacggtggcggcgacgaagtgcccaacggtggcggcgtcgaagtgcccaacggtggcggcgacgaagtgaccaacggtggcggcgtcgaagtgcccaacggtggcggcgacgaagtgaccaacggtggcggcgtcgaagtgcccgacggtggcggcggcggggccaatattggctgggcgaatgaagaagaggaggaaggggggcctccccatccgctccagaatccattgccagatcagcagaattaattgaattttttttatttttgcttttttttgttgttgttgaataaa

SEQ ID NO: 63983 - DNA, 375 bp, Heterodera glycines
  Genomic contig location: Contig_ID=SeqID_34105; Location=211..585; Strand=-
  SCN-specific regions: Sequence locations=1-2,70-293,315-375
atgaaaaagaagggagagagagagatggacagagacggagaaagcggggaagagaaagaaatagagaaatatcagctcactcatttatacctgaaaattattatgatagtaagactaaaaaaattattgaaatttattagaggcaattaaaggatatttgttaaaattttattggttttaataaagcatcaattacaaaaacaaatgattaaatttatttgttgtcagcgtgatttcaaaaaaagaaacattaaatggagtaataaaaaaagacagacgcataaacaaaagaatgactgggaattgattgtcctgagaaagtttgtcgttgcaattcatccaattcagagaaaaatgcatttttagcacattaaa

SEQ ID NO: 63984 - DNA, 78 bp, Heterodera glycines
  misc_feature (44)..(44): n is a, c, g, or t
  misc_feature (72)..(72): n is a, c, g, or t
  Genomic contig location: Contig_ID=SeqID_34106; Location=130..207; Strand=-
  SCN-specific regions: Sequence locations=1-6
atgtcttctctctctctctttctctctctctctctctctctgtngtctctcgtctgtctgcttctctctctngtctct

SEQ ID NO: 63985 - DNA, 780 bp, Heterodera glycines
  Genomic contig location: Contig_ID=SeqID_34107; Location=1..780; Strand=-
  SCN-specific regions: Sequence locations=1-194,226-569,592-780
  Gene Ontology: Mol. function=guanylate cyclase activity; Cellular component=brush border; Biological process=receptor guanylyl cyclase signaling pathway
atcgtcacttttacgaacatttgctccttctgcacgccttacgtttgtttgcccaatgcttcatttgtcggctcttttgccttaattggctaattaaggatgtgatcaaactgcttaatgacctataccaacgatttgatcgaattgtcggccttcacgacgtgtacaaagtggagacaattggtaaattagtgacaaaggaataaaacagaaagatacaataagcaaacgcttcttttcattaacaggcgatgcttatatgatcgtcggaggggtgccgaaagagtcccaaaatcacgcggagaaaattctgaatgttgccattggttttctgatggagtcgcgatttgtcaggggtggcccctctcctgctgtactccgttctgtgctttttgcaggtgaccaaccccaccaacgaattggccatttccatccgaattggcgtccattccggccccgtcgtcgccggcgtcgtcggagtaaaagtaaagcttttccatttcccttatcttaagagtgctttaccaatcattttttcagatgccaaggtgtttctttctttacataaattgtgtttaaatttgtcgtcagatattgcctttttggtgacacaattcatttggccaatcgaatggaatctttgggtgcgtttgaacaattcgcacaaaattaacggattttagggatgccatccaaaatccacgtcagcaaaactgcgaaggctttggcaatcagaaacaatccgtcatttttgttcacagagagaggggccataaaaat

SEQ ID NO: 63986 - DNA, 59 bp, Heterodera glycines
  Genomic contig location: Contig_ID=SeqID_34108; Location=823..881; Strand=-
  SCN-specific regions: Sequence locations=1-59
gatcgtcgatttttctgtatttttcataagactaatttacaataaaatgtatttttaaa

SEQ ID NO: 63987 - DNA, 144 bp, Heterodera glycines
  Genomic contig location: Contig_ID=SeqID_34109; Location=92..235; Strand=-
  SCN-specific regions: Sequence locations=1-144
atggtggacaagaaccttttcaccaaggagcagcaggcgaaaggtgggcaaccgacaagaaaactgcacaacggcattttttcatccctccattttcagatgccaaacgaccgcaaccactcgctgggccccaattcgtttcga

SEQ ID NO: 63988 - DNA, 1302 bp, Heterodera glycines
  Genomic contig location: Contig_ID=SeqID_7154; Location=520..1821; Strand=-
  SCN-specific regions: Sequence locations=1-44,66-512,540-638,660 -902,945-947,969-1302
atgtcggaatcactgcaaggaattctggaaatattccgaggaaaacccacaaaaatggagaagaagaaagtaattactaatttagttttctttcggaaaattagctcattatttggccacgatttatgtttccaattatgtcggaatcactgcaaggaattctggaaatattccgaggaaaacccacaaaaatggagatgaagaaagtaattactatttcgttttcttttggaaaattagataattgtttggccacgatttatgtttccaattatgtcggaatcactgcactggcgtcatttgaaagctctatgtgtgctctatatttacatttacatttcaaaatagaaatgactgatttaaaaataaaaaagttatggcacacggtgcaaaaaaaaagccaagataggtatgtgttgccgaaatgtccgtgccgaactggccaaacttgaattaatacaagactttttgccaaaatatgaagatgcgccagtgttttcgactttgattcatttcgatatcaaaaatatttacctagaatgtttatgcgcaaaattttgaggactgaatcttgagaacgagattcaatttgggaaatgtttttatcggttcaattttttttaacatttttctcgggttttcttaataaatttgtctttaggaaatctttgaatttaaaaatggaaccggcgcgtgaaattgcgaaagtaatagtgcattttctgaactaaacaatttgattcattttagacaaacatcggaaaaactgtcaccgagaatgaagagggcgaaaaaagagaagatgaggcccggaaaaaagcagtggatcagtacaaaaaggagatgtcaccagcggatcgtaagcttctgtgtaagtgaatcaaacttgtttattccaaagaattaacttgtttcaaaaaagttgtgaccagaaaacttcaaaacacttctgatcattttgaccataatttggtgaattttggtggctttgtcaactccaatatacactaatagaggactttggagctatagatttataccaattttttaatttgaagcttctataaaagttatgatgcattaaatttagcgacgcgtgaagcttctcactccgccattgcgcgagcgagcggtgcctatgttccgacatatctgagaatgaacggtgattgcaccggagcggtaagtttgtctccttttaatcactaatcattgacactacctcaggcgtggcgaagaccaatccctcgctgtaaaactgttaaagagttgaagatggacgtagtcattggacagaactga

SEQ ID NO: 63989 - DNA, 656 bp, Heterodera glycines
  Genomic contig location: Contig_ID=SeqID_7155; Location=165..820; Strand=+
  SCN-specific regions: Sequence locations=1-44,66-368,390-433,455 -461,483-656
gcaaatactacttcattggacaaccgaacatgcacaacagtcatttacagtaatattacattgtttttccaattggggcatgtgatggacttttagctgaatacgggcattttttttcttaatttgaaaacaatttaagacagttatcggatcagttacgcacagaaaatgaacagcgcactgagtgaaagcatatgggaagcatcaaattgtcatggtaaaatttgagtttaagtgaaagaaatcttgggatttaacatttatggcccaaatcataaattagaaagtgtctcatataataaatctgatgattttaatggattcgtggccagccacccagcaaaaaccttgggttctgattactagataaaaaatgaaattcatgacctaaattctgttccattgtctacggacggatttcaatgaaaacccttaaatattactctaaatgtttatccaattttgcatttattttctttttcggattgccttcgcatcgattggaattttgaacatggtaattccacctttgagttcgacaataaaacggtctttttttgcattttctgcattcttttgcactaattggattcctttttttcagttgcaattcaaaaattacttgtggcaatggcgaaattgtgttgtccaacaga

SEQ ID NO: 63990 - DNA, 396 bp, Heterodera glycines
  Genomic contig location: Contig_ID=SeqID_34114; Location=98..493; Strand=-
  SCN-specific regions: Sequence locations=1-59,81-396
atggcatttatttatgaacatggaggcgaaaaaaaggtaatttattaaagggaaaatgatagaataaatttaattgattagtaaaatatcggtattcgattgtctttatcaaaagatggcaattccatttctgatccatcacagatggacctcgagaaagacagtgccgaggcgagaaaggaggagccgggcctttttcgcattcttttgggcggaaagccggacaatccgtctgatcccgcggccaaccgaagggtgccgatcagcgcgcgctttctcaccggcgagccaaaatggcgttacttcgttttgccgttgcttttcggtgcctttgttttcgcgattagaccgtggcaatggcaacgcccggggggacgaaaatcagaaggaaagtga

SEQ ID NO: 63991 - DNA, 769 bp, Heterodera glycines
  Genomic contig location: Contig_ID=SeqID_34115; Location=52..820; Strand=-
  SCN-specific regions: Sequence locations=1-238,286-400,423-769
atggacgaacagttgaagaggagcaaagaaaatgcggacaaatacagacacagggcaatgaaactggacgaacggttgaggcggaagacggaaaagattgaggaacaaaagacacaaattgaggaagcgatcaatgccaaacgaatggcggaggacgaactgagcaaagtgaaggcggaaaatgcacttattaagcagcagcaagagcaggtcgacacaaattggagcagttcgttaacccccccccccccccccgcccaaaaaaaaattaattttttttaaaatcctaactttcttttgtgcgagttttttctttttaattttgtttatttcttcggtgctggtgtgatatagggcacccgacacagacccattctcccgctaaaaaaaaaactaaaaatttgttagtttttaaaatgcttaaattcagttaaaattaattttcccagaaaaagaaactaaatgtttaaacaattttgttttgtattacagaatgtaagcaatctccaacatgcagttggtgcaggtcaaacaacaacatcagcatctgctccggatttgggccttcttaatgacagagtgaacgcaattttttttttttaatttgaaaattcacttttcggatttttgcagattcgaactgtcacaaaaaggaggaaggagttggacaaggcacttgctttccttggagttcgtcaaccaaaacgtgcaaaacattccaccaccaaaaaaaaaggttttttttttttgacaaattgctattattaaa

SEQ ID NO: 63992 - DNA, 120 bp, Heterodera glycines
  Genomic contig location: Contig_ID=SeqID_34117; Location=1277..1396; Strand=+
  SCN-specific regions: Sequence locations=1-120
atgctcagttctttccccttattattgtccttggtcggcctcatcgccgtccacgccgaagtcttcttcaaggaggagttttctgatgacagttggactgatcgatgggtcacgtcgaag

SEQ ID NO: 63993 - DNA, 263 bp, Heterodera glycines
  Genomic contig location: Contig_ID=SeqID_34118; Location=371..633; Strand=+
  SCN-specific regions: Sequence locations=1-53,88-229,254-263
atgtttttgttagcctatttatttacaggagaagtaagtatatgaatatcaacaataaaaaatatatttattttaagatttataatagtgcaactaaagatattaaatgaaaaatacaaattgaattagaggaatttctaccaaacattacaatattttttcatacataatacttttcagtaaaaattatagttatatgttcaacaagtatttagctgttttttaaccgattcaaaactataaaaaagaatttttgaatttta

SEQ ID NO: 63994 - DNA, 483 bp, Heterodera glycines
  Genomic contig location: Contig_ID=SeqID_34120; Location=432..914; Strand=-
  SCN-specific regions: Sequence locations=1-483
atttgttctgctacaatggtccttgtcatcgaattttgtgcccaaattctcggctgttccccgaaatcactccgcgacaagctcaatcatcctgaggaccgagtgaaggcactgaaggagctggtcggaaaaaaggttcggacgacataccaggaccggaatgaaatacagaaaacattttttgtcgacggaatatcggaccatggagcggctttgaccccagcatacggcagactcagacaaccgtacaacattaacattgctgcccatttctacgctcgccaccgtattaagcttcacctgccatacgtgccgtgtattgtggagaaatattctggatgtggcgaagacagatactatccaatggaactactcgaaattgtggatgacgactacaccaacaaagagcgatggcttggcaaattgtttaccgaaatcgaggacgacttcattcctgtcaaacgccttggtcgagttgactaa

SEQ ID NO: 63995 - DNA, 318 bp, Heterodera glycines
  misc_feature (11)..(11): n is a, c, g, or t
  misc_feature (289)..(289): n is a, c, g, or t
  misc_feature (295)..(295): n is a, c, g, or t
  Genomic contig location: Contig_ID=SeqID_34120; Location=1069..1386; Strand=+
  SCN-specific regions: Sequence locations=1-162,184-318
atgaaactgcnggaggagcaacaagtgaaagctaagaagccaaacgttgatgagcgatttctttggaaaatcacgagaggccaatttgtgcttgcgattcggctgtgctcaggttaatcaaaaatttttgacgaccaaattaattgacagctttcagaggactggaaacatttatttcacaacaaagacaaggcatgtcggctggaagatggacgagtggcgattggactcgagatgtgtgaagaatgtgcccgaatcattgcctgtgtcagtgacatgattgctgatncaaagnaaagccaaaaaccaccgaaataa

SEQ ID NO: 63996 - DNA, 1175 bp, Heterodera glycines
  Genomic contig location: Contig_ID=SeqID_917; Location=24..1198; Strand=+
  SCN-specific regions: Sequence locations=1-37,74-81,248-620,734 -801,830-1139,1169-1175
atgattggattggccagcttagaagaagcagatcaaatgagaagacaggtgagagaaacagagacagagaaaaatatacgtgagagagagaggggagagagaaagagatagtatgagagagagagagtgagaaaggggaggggaggagagagagagagtgagaaagatagagaacgctagaagaagagaaagaatgagacagagagaaatatagagagtgagagaaagatagagagcgagagagagatagtatgataatgactcgagctttagggtactcgaaaagtatcaaacaaaggaggatttagactgggtttccgagactctacacggtaggaaaaatcttttcacgcgtcaaaagccgacccgaaacccgagactctcgaatagcaataaaatttaatttgacttttatcccattcaaattaggcttattaatcgtctattttgcctcctttcttttttctgttcagattcatctgagactgccagaattggttggaggagaaaagcaaagggttaacgaattaatggaaatgttgtcaattcgttcgagtggaaatggtaagcatcaaattaagttttgttcaaataaagcgaactctttttaacgcaaaaacaatttttattttttatttactttatattttcattaaacaaaacttattttattttaatttaaaaaattatgattttcaatatttttttagtaattaaaaagaaatttattattgttgtttaactctcatattaaaattcatttattttgtccatttgttttttattttcccatttttacgcaattttaattttaaattaattaaatattccctttaaattggttataagatatgcttggtttggtccaattcttctacacaaatgtgctgttgtcaagtgtcaattctgtggccaatgaggcgaagtggcagaatgaaattgcgcaaatgaatgccttcgctttgatccatcgaattgacgcgtttcattggcgcaacggacggatcgccaacgattgggcggaagtgcggaaagcggtgggcacacttgtggacgaattgggcacagaacaaacgggcaaattgacatcacaggtgaaggaggaagcaggggacaatttagaggaaaaaattaaagcaaattaattaattgatttaattaattaattggtttaa

SEQ ID NO: 63997 - DNA, 224 bp, Heterodera glycines
  Genomic contig location: Contig_ID=SeqID_917; Location=1211..1434; Strand=-
  SCN-specific regions: Sequence locations=1-49,74-157,180-224
atgccgtttattttgggcttttatgcatttcagtgagttacgtaaaaacttaaaaataaaataaaaaattaaacaggcggcataaagtcaacgatgctaatcaaaatcttatcaattagtcaacatgacggatcaaaactaattatggggtctaatttcaaaatttccggggggtttcaaaacctaaagtaccgaaaaatttaaggtaaaaattggcaaataaa

SEQ ID NO: 63998 - DNA, 2664 bp, Heterodera glycines
  misc_feature (833)..(833): n is a, c, g, or t
  Genomic contig location: Contig_ID=SeqID_919; Location=967..3630; Strand=+
  SCN-specific regions: Sequence locations=1-244,266-309,331-968,1023 -1352,1374-1549,1571-1641,1680-1693,1715-2155,2179-2185,2207-2664
actccgatgctgaacaccttgcccttgcctatgaacaattgctgtccaataaaagctatcgcttctcaaaccaagctgaattcgccgaccgtataaacagtatgccaattgctgttgctgctccgttgtggcttttctccgcttttgtcgacgatttgctggtctatttggaggcaaattttaagatggacgaatactacgatatgccgatggccaaggatacggtaatgaacgaactgtggacggcatggggaagactgcagttgctacaagcgacggcacaaggcggcgaacgcgagagagagaaagtgaaactgtgccaagtttattgcttcctaggtactactgtcgcacactgtggggttactgtatgaaaaatgagcctaaggcattccagaaaaataaaattttagagagaagaaatttaaaataaaatttcgaaactttatttattggcgagaaatttttttggatgatttgctcgtttcgtttccgattaaaatggacatcttcagcaaaaaaatgctataacttttcgctagagctcgacctggacctgcatccgaggtctgagtttttcctggatccgagttccagtcgagtttttggcgacctggtttttatgaacctggattttccacgattttggccttcaggcctaggcttttttcgctagtagtttttttgaaaaattgccgaataatcgagaccatttgcggagacgttggatgataccaaaatgtttttaaaaaaatttttaacggactttaggggtcaccgatcacgaatctaacatacatttcgacaaacttacgaactgcggacctgcattngaaaaaagttcgaacaaaaagttgaagataaaaaaatgcgaaatttgaaggtttgacttaacgcacgagtttggttccggggttcgaaattggccgaaatggatgttatattcgtaatcagtgaccccaaaaaacttttttatcatttaatatagataatttaagtacatttaaattaaaaatatatatgaaattggcttgtaaactaaaaaagtgtctttttttgtcagcaaatgcatttttttggtttagccaattaggctcataacttgaggattaccgccgatgttttaacagtagtcatttaccgtaacagtcgcaccacttacagtacaccaacaacaccgttcgtcctttttcagattgggcaattcgcaaaagttggccacacattggagacacggcttcttttgcaatcattttagacaacattcattggaaagattttgaagcaacaacactggtaggctttttctcgagcttctgcggaaatccgccagtcccgaaatcccaatcccttcccattttctggtcttttttgcccggggcactatttttactttttacgggaacggaggccaatcataattacgaaggacaaatcggacgaccaatcacacatttggcatttgtctccaaatttatcgttacgacaaaaattaggtcgtttgtctctgtcgtcaaattgtccgtaaatttgtcgtcatttttctttaaaatgaaccaaacatttaagataaggcaaaaaattaaaaattctgattggtgctatgtcattattttaaaaccatcattatgtgcgttatttaaaaaaccatcaaaataaaaattttgcttataacttttctttaaaataaccaaatttttaattcttgatatcattcgatagaactaagtgttctttaagagcctgcaaaatttcaaaaaaatttataactttaaaaaaaagttatgaccaaaaatgttcgaaaaccaaggttttttgagttcctcgagctataacttttttgaaacttaacgaaattttttgaaattttgcagactgatagagaacacttagggctatcgaatatttcaagaattaaacatttatttaccttagagcaaaattataaataattattcgacaaaaattttcataatgatggttttttaaataacgactccgccccttctgattgaccccccagggaaaaggcgggaaaggaagaaatttcttctttgaaaaagggttccattatttcctgctgaaaaacatacctccgatttagcgatttaggagcataatatttagtggattttttgcgcaattttttattgccaattaattaaataataaatatttgtttagcttaaaaatttgaatctcaattcccaaaacggtgcggcgcctctgaaagggccgatttgtacagaaagtgtggctgatcggctgttcgctgagctgaccaacgcgcaaaactttggttttttgcacactcatgccattttcacactgatcaaacgacggaccaatggcattttggcatttctctgctcaaaaaagaagctgaacgaaatcatggaggtcaaagagcgcattcaaatgctgacaagaagcgtagacaaattggattggttggaaatggcatttccggacattctgcacataggcaagcggaaggaagcggggtccaccgatgcctttgtggcggaaatttcattgggccgaaatgtcattgacataacccatattgggatgatcaatgacagcagaacccatttattgtccacaatcgacattaatgcctttttttggcagggttggcattggcattactttatgacctaa

SEQ ID NO: 63999 - DNA, 1869 bp, Heterodera glycines
  Genomic contig location: Contig_ID=SeqID_919; Location=5429..7297; Strand=+
  SCN-specific regions: Sequence locations=1-764,799-933,1030-1263,1285- 1561,1623-1816,1843-1869
atggccgctgatatcactgtgttcgtccggctgatcgaagcggtgccccggggggcaaaatttgacaaaatttggaaagaaaaaaaggaaaaccaaatcatcgatttgtacgacagctttttcgagatggactatagcaacgaatatcgaacacaaatgcattttacgtggaaattgtttgacgctgtccgatcagagctggccgatcttggttttttgatcaacgagaaaaagctgagacagaaatgggacggcatggaaaagcgggcacagcgcgacgccgcggaccaaacagcgagcgacgatggcacagtgccaaccgcgccaattttggtggccaaattacatgcgcaaacgctgcaaaagttggcatttgaaaatgccgaaacggcgaaacggaagacggcagaaatggccaaacatttcagggaaaagctgaagacaggtgaactcataaaaggggggaagcaaacattcggaatttttgcatgtgctaatattggcacaatgacatcaattagtgccaaatcccgctgattatggcatgggcattttggtgccaaagacctctgacgttatgacaactcatacaaaaggcattgtattttattgtacgagttgccttttgtatgagttgcaaagaatttgccaaatgccgacgagaatttcggtgtgtcgaacaatttggccaaaaatgtccatgtttatttttatcgctaatcatggcatgctgttttggcgttagtgtcatttccttgggactctttttggcaaattattttcttttctccattttaaatctttatagaattgagcgaatcaactggcgcaaggcaccaacttttgctttttttggaactcagtgacatcaaagtgctgcttgaacagcttggcatagaattcactgagaaggaatttgaggacgacccaatggaagaagaaggacaaaagagtaccagtgatcagcagcagacagagaaacgaaagaagaaaaagaagaacaggaagaaaggaggcatgaaaaagaaggcagacaaagcgggagagactgtgcagaatggagagagtgcagagaaaccttgtgatcagagtgggagagagaacgtgcaaattgaagagaaggccgcagaaaaattggagaatggaagagagagcgtgcaaaacgaagaaaaccgaaaaaattcgccagcagagaatggcgaaaagagagtgaaaaacgaagagagtgcagagaaaacagagcaaataatctgtgacctgcagagaaaaacaattgagagagcagacagtcatccgccgataataagacaagacagagaatgaaactctgttgatcagaagaaattaattgaaaatgaaaagagagaaaattctgatcagaaaaaagaaaaagggactgaaatgggacagaacggaacttgggaagagactgatcaaagccgggaaattgatgctcaaattggcaacaatttgctgtcattttcaaatggggaggattcgaaagaggaaaaaacacctgcgaaatttttcaaagtttcgggtgaatgcccaaatcggtgtcaattttattagttttatttattttttaaatttttgatagatttaaaaaaacataattttttggccggcaaatatttggaattgatggccgagccgagcaaattcgagagttttacagcagccgaaaacccggaaaggattttattggatttgagtgtttttgcgaatgaaatatcgcgcagatttgaaacactgcaacaattgggacaaaatgcaaaaaaaattgccaatatgaatatgaaagtgccaaaacagttgataaaatattggaaaaaattggaagagaatgcccaaatagaaaatgaaata

SEQ ID NO: 64000 - DNA, 532 bp, Heterodera glycines
  Genomic contig location: Contig_ID=SeqID_920; Location=319..850; Strand=-
  SCN-specific regions: Sequence locations=1-204,231-336,360-488,512-532
atgagttgtcttcgagtagtgatgatgggaaaaatagtgccacttgaaatggttgaacaggcatttttcaatatgcccgaggattattcattggtgcgcatgaatgaaaaatttgggccaataattttatggacgaaatagtgaagttgacgaattagttgtattttcttttgtcgcataaatgttatttgaagaatacccatttttcttctatttctttttatttaataggccgtgcaattattcttttttcaagagctaacaataagaaggttatcattggtattacaaatccaatttattagtttttatcccgatagtatgtgtatatccctatcaatgttaacaaatagttttttgtctcctcttgtacctcaaaaaattgatgtgcctccataataaggggcacgaaatcacatgtttgcgtagccaccattcgatgtgcttgagttgtgaaatgatgaagcggggaaagcgaaaaaaagcaagtttattttatatgaaacatttggcaccaaacaatagaattaaa

SEQ ID NO: 64001 - DNA, 80 bp, Heterodera glycines
  Genomic contig location: Contig_ID=SeqID_7156; Location=16..95; Strand=-
  SCN-specific regions: Sequence locations=1-28,65-80
atgaacaccaaacataataaaactgagactctgtctctctctctctctctctctctccttctctgtgccttcctttctat

SEQ ID NO: 64002 - DNA, 2356 bp, Heterodera glycines
  Genomic contig location: Contig_ID=SeqID_7156; Location=291..2646; Strand=+
  SCN-specific regions: Sequence locations=1-123,156-253,300-364,398 -402,426-708,743-858,880-987,1046-1312,1334-1432,1477-1513,1537 -1888,1910-1931,1973-1984,2006-2315,2354-2356
  Gene Ontology: Mol. function=transcriptional repressor activity; Cellular component=nucleus; Biological process=sex comb development
atgtcacaacatcctcatcaaggtgatttgtggattaaaaagggtatttggaaatttgaaaatccaaaattggactcattgtcagtttatggcacaagtgccggtgccggtggttatccaccgcaacaacaacaacaacaaccacagcagcaacaggcggttgaccaacaacagcagcaatttcttggcgccgcttcagtcgctgctgcagctgcggcccaacaaatgagcaatgtgtgcgagggggggggggaattaaaattaaaattggaaatttaaaattaaattaatttaaatttggctaaagtttacgccgcaacaacagtatgaggtgtggcaacagtattattcccaaattggtgtccaacaccagcagcaacagcagcagcaaacactttcgccattcttgagccattccatccaggttttgacgagaaaagtggggacgggcaaaatggcacaaattaaatggatgttgcaaaaaaaattataatggtgccaaaattgggaggaattcgaattcccggcgagggaggaacactgtttgaaaagtttcgaaatagtcaattgtccgaaaaaaatcaaaaattgatcaaaataaattttttattttgatcctatttgattaaagggaaccagagggagtaattaatcttgtctgattgggaacaatgcaatttttaaaatcatcaaaaataaacaataaagattaaatttgtccaaaagttttattttttataatggtggaaattacctggattatggatttagggataaaatataattagccctaaattgcacattattatcttctccatttactgctagatgaacatatgtgccttgtttcctgcctaatttctttatctttgaccattaaattagaaaattaataggtcattaacaaattatttggcacaaattggtcaaaaacattcttccccatcattagtcgatggccgcccagccgtccacgtcgcttgccatgctgcagcagcaccagcagccggcgcagcaccaaatgctggcacaacagcagcagcagatggcacaacactacggcacttcgcccatggcacctgtggtggtcagcccgagcggaagcggcgcaggcagcagcggaagtgccgggttggcagccgcctcgttggtggtgcagcagcatcagcagtatctgcaacaggctgcactgcttgctcatgttagcacgagttgacttgctgtcgggtggtataagaaagactttaaaattttggaaaaaaatccacgaggggcactcgggattcggagcggtttttccgtaaacttttgggcggattcgggacaataaaaatgtcgggattagagtggaaaccctgcaccctagggaatgggtggaggcgtgggttcaatgcccatccgaggggccgcataatattatttttgcctgtttcagcagcagaatcagcagtaccaccaccaacagcagcagcaacatattcagcagccaagacaagttgcggtcgttcaaccgcaacaacagcaacaacaacaacatcagcagttgcagcaattgcatcagcggacgattggcggtgccaccggcgttggcacttcgactgttgccattggcggcagcccattcatggcatcggcggtccaacaaaatgtaaatatatatggcattttccatgtgaaactaggtcggacatcaccacaagattaagccatggtatcgcacttaacttgggaaaggctcagatttttttggggtgtcgaatcccggatatttctatctcgagaatcacaaataaaaatttttgaacatggattttattttgggcctggacttgaattttttgccaatccatgtccaggaacttcgatgttgctaattgagcaatttgataattaaataaaaggtcgtccatcaatcggcgtttggagttgcccagcaacatccacaacaacaacaacaacagccgcagcaacacgttaagcaggtgcaccagcagcagcagctgatcagccaatcgcatgttcagctgcaacagagtccacaaaagcagcatgaaaagtgggatccgctcaaggagtttggactgcacaaagacgaagttgcgttgaagtcgccgcccagcaatgtttgttctgttgtgccaattgctaattcatgaattggggaacccataaaatttgattaaattgaacgaaaaatcgtcgattaggcgtgtatttatgggctaaaaagccatggaaaatatttaagtgataaagccatttaaatcggaattacatttaagattagtccctgatgactgacaaggatagttgtgaaattaaaaaaaaacacaaaaaaatttaaataatttatgaa

SEQ ID NO: 64003 - DNA, 278 bp, Heterodera glycines
  Genomic contig location: Contig_ID=SeqID_7156; Location=3861..4138; Strand=+
  SCN-specific regions: Sequence locations=1-99,133-190,212-278
atgcagcaggccaaccaagtgttggcaaacactgacgaaagtttggccgactatttgtccactttgctgtccgacaccacggacgaactgcgaaaaatgtaaaaattaattaaatttattttctaaaattttggcggcaaaaatttagattttttcataaaattttttacagtaatgttcttttttgtgcttcttctaatattaaatcttaaatatttttaggtctattttgaataagaagaaatgccgatattgaggggcccaacaataatttatta

SEQ ID NO: 64004 - DNA, 100 bp, Heterodera glycines; identical to SEQ ID NO: 51845
  Genomic contig location: Contig_ID=SeqID_34126; Location=180..279; Strand=+
  SCN-specific regions: Sequence locations=1-100

SEQ ID NO: 64005 - DNA, 623 bp, Heterodera glycines
  Genomic contig location: Contig_ID=SeqID_34127; Location=31..653; Strand=-
  SCN-specific regions: Sequence locations=1-131,153-623
  Gene Ontology: Mol. function=ATP binding; Cellular component=nucleus; Biological process=DNA replication
atggatgctcagccagtgataaataagatttcggatgatgaaggtcgaagaacggaagatgcattcacacgatttatcaaaaggtaggataatctagcgaaaatataaaaatttaaaatgtcttttaagttttgaaaccgatggtgggaatgtgtatattcagcagattgacgagttgagggggcccgaacgaaacactctcgaagttgaatttgcacacatttccgcttacagcgcggtgcttgctgccacaattgaactgcaattttacaggtcaactccgatttacgtgcttttgttttagctaaatccatgaattcattttctaaggttgtatccgtttctgtgccatgccatttgcgaattggtcgtcgagcgttgtgatgctgccgaccaacacgaacatttgcgtcgcaagcaatactacttggccatagtaggggttaaaaccaggcaccaagttcggcatctgaccagcgacaaaatcggcaaacttatccggatttcgggacaagtggtgcgtacgcaccaggttcatcccgagttggcattgggcactttcgtatgcgaggattgtggcgttgtgacgcgggatgtgccacaacatttcaaatacacgcccg

SEQ ID NO: 64006 - DNA, 80 bp, Heterodera glycines
  Genomic contig location: Contig_ID=SeqID_34128; Location=18..97; Strand=+
  SCN-specific regions: Sequence locations=1-80
ctattattatgagccacccaatttggcaaagatcggtctttttatacgcattaaagaagattcagtcgattgcttggagt

SEQ ID NO: 64007 - DNA, 106 bp, Heterodera glycines
  Genomic contig location: Contig_ID=SeqID_34131; Location=325..430; Strand=-
  SCN-specific regions: Sequence locations=1-106
cagttttggcccttcgtccaaattgtcaatctgacggttatccctcttcactttcgcgttgtgttcctccaattcttcggcattttctggaatattttcctctcct

SEQ ID NO: 64008 - DNA, 638 bp, Heterodera glycines
  Genomic contig location: Contig_ID=SeqID_7158; Location=834..1471; Strand=-
  SCN-specific regions: Sequence locations=1-110,132-247,301-381,413 -486,539-638
gctggttatccgttgccttttaagcgcccctcgggatgggaggagccctatcggagagataaaatgggggggggggaagggtaaaggccatttccggtcccggccttacacctccggccctccaaaagaccgtccctggtcgttaaaatttaaataatttccaaaatttgaatgaagtcctcagactttttctttcttttcatttgttttacgatgagaaatttgttttgattttaagccaaaactgaaaataaaataatttaaatatttatttaattactcaaaataaaaatggaaaattccgagcctcgatgggaatgaactcattccttcaaccaatccacagaagctctgccaatgaactaccaaaataaatccgcgtttttttttttttttaaattaatttttttttgaaattctgattcaattggatttgaattaaattggcattgcttttcaaattataagccaagagaaaatctgacgaaatttttaacttttaaaattatataaatttaataattattttattttatttccaatcgactaaaatttagatttttgatatagcccggtgtgactgtatgactatacctccccttcatatctaaggatcgtccctgatccaagaacttaaa

SEQ ID NO: 64009 - DNA, 555 bp, Heterodera glycines
  Genomic contig location: Contig_ID=SeqID_7160; Location=28..582; Strand=-
  SCN-specific regions: Sequence locations=1-97,121-187,209-252,275 -346,369-555
atggatggaaaatacggtatttatctattatatacggtggctggtcattttgatcatcaaaacacgacggtcggcacaatgttcagcagatgtgccattctttccttctttcttccttccattgttcaggaagaacttagcagcagtgagacaatcattccgtaaagaccgagcacctgaacagagcaaaaagaaaattcaaataaatttacccaacagtttcgaaacgaattgggacgactgagcaccgaccgactgaggccacgccagccagccggtttttgggtataaccccattcatacctgttcgaattgaatgaatttgaaatcattcgatagccctaagagttctcaatttccttgtaaatttttgaaaaatttagtttaatttcaaaaaagttattgccaaaagacttaggatttgtttttccaaacattttttgaacacaacttttttaaaaacggaaattttttcaatttaaactttagcaaggtttataaagatttttaggcctatcggatgatatcaaatacattcaattcggacaattatga

SEQ ID NO: 64010 - DNA, 480 bp, Heterodera glycines
  Genomic contig location: Contig_ID=SeqID_34133; Location=243..722; Strand=+
  SCN-specific regions: Sequence locations=1-480
atgaggcatgtgccatatgcataccgcgagaaaattgcggcaatgcttcaagactatctgggaagaggagtcatccaatcgtccatttctccatgggccagtcccatcgtattagtgccaaaacgtgatggtacattacgtttttgtgtcgattatcgagctgtgaactcggttacgcgtaaagatagcttccccttaccaaacattgacaacatactgttaatgctaggaggaaaaaagtttttcagtactctcgattttatgtcagggtattggcagattaaaatggaagacaattcggtggaaataacggcgtttacaactgagtacggcctttacgagttcaaagttatgccattcgggctaacaaacgcggtcgcgactttccaaagattcatgacccgtcttttcgagggcatgatcaacgattttgtcttcatttacatggatgacattgtgatcctcttcagaatcgtttga

SEQ ID NO: 64011 - DNA, 628 bp, Heterodera glycines
  Genomic contig location: Contig_ID=SeqID_34135; Location=223..850; Strand=+
  SCN-specific regions: Sequence locations=1-359,382-628
atgattttgattcttcttcgagtaaatataaattatacaacatgttttattattttggaaattctaaccaaattgctgaatgagaatagattgaattatgaacagaaattgtcaattaatgaaatgattttgcaattagcaattgatacagccaataattacaaaacaaatgaaacattggataaaataatccaaccaaaatttgaagaatatttagaggaaatgttcaaaaaagcggaagaaagtgcaaaaaaagaaagaccatggaacgccaataaaataaattatgacaaacatttgataattttgtatacaaaattcgatgatcatttgatatgggtgagacttaacattcaagcaaaactttaaaaattaaaaatttaggatgaagattctgaattttcggaattttgtcaaaggattagcgacaaatttggagaaattatttaaaatggctaaagaatattcaaattattaccgtcaaatgaaagagaaaggattcatggcctcttatgggttatacgaaattgagaaaatgaaatagcatttgacgcaaaactatgaggcgcaacttggcattttgaatttaatgcaaaagaattggcaatgtgacaaaattgcggataaa

SEQ ID NO: 64012 - DNA, 1167 bp, Heterodera glycines
  Genomic contig location: Contig_ID=SeqID_34138; Location=169..1335; Strand=-
  SCN-specific regions: Sequence locations=1-23,45-191,213-845,867-1167
atgaagcaacaactcgattcaactgatgcaaagtcaacgtgtgcttttgatgagttgatggcaggtgtccgcagatgtggaaacgcggaaaagaacggcagtgctgttggaaaaattatgttggtaaaggtctcaattttagagcaaaaggcagacgcaatgcttgatggcggcgcccagatttcactgatttcagtggaatttttcaacaaaattttgaatagttcaacattgaacaaagaatttttgaagcccgatcgacaaattgcacgtgtcatagacataaatggaaaagaggtcaaatgttacggtgttgtaactttgcctgttaaaaggcaggaaaggacagtgcaagtgcgtcttcacgtagctcaaacatcgtttggctacgatttactattcggaaccaactcactttcggagttagggttcaaaattttttacgagttgtcaaaaacgatggtagacttcaagcaaaacgtgaacacccaaaactcggttcacgtgattttcaaaacgactttaatgccgttagccactacacttgttgaaatgacaagttcaacgaagaaagacaaagaattggcaatttttccatcaaatgacagaaaaaaggtgatgagaattgaaccggctgtcgtaaatccaaataacggaaaatttatcgcaccgatcaccaatttctctgcacttccgattacattggaaaaggatgagattgttggacaatttgagcattttgcgaatccgcgtgaattgaatgattcaatgttgttcacattgacaggcaaaaatgatgaagaccaaaattcgtccaaatctaaaagtgaaatccaattaaattgtgcgaattcaaaagaattccagcaagctggcacaaataaacggacaacttacgtggagaagaaaagcaaaaattgcaaattctgatcacggagtttgaagacatttttgctgtcagtgattgggagttaacacagactaatttggtccaacatgcgatcgatacaaaagacgcagaaccaatccgaagtcaaatgcgcccaatcccatacgcataccgcggaaaagtgactgaaatggtccaagattatatgggacgtggtctcattcgtccatccagctcaccttgggcaagtccaattgttcttgttccaaagcgtgatg

SEQ ID NO: 64013 - DNA, 1486 bp, Heterodera glycines
  Genomic contig location: Contig_ID=SeqID_7161; Location=2769..4254; Strand=+
  SCN-specific regions: Sequence locations=1-48,70-388,410-556,578 -603,626-686,708-820,857-918,940-1486
  Gene Ontology: Mol. function=phosphatidylethanolamine binding; Cellular component=soluble fraction; Biological process=regulation of proteolysis and peptidolysis
tttccatataatttgacagaactacttatttgttagttgataattttgaataaatcaattaattttatattttccatggccgcttaagtatttcgaaggccttcgcggccgataacattgtgccggacgttgtgtcccaagcgccggaaaggctcgtgaccgtggaatacgatggcggagtgtacgcggagctcggcaacgaattggcacccaaaaagttggccaaggcgccgaacctttcatgggacgcggaggagtgcaaaaagtacacagtggccatggtcgacccggacgcgccttcgcgggagcacccgaaaaatcggtggcattttattaagggcacatcagaggcaggagcgttttcccccccccccccccccctccatccatgcaccaaaatccaaactgattggctttctccagattagtttaatttattaggattgaataagcggacggttaaaatgctgaaaacgggggcataaaaagacccataaaggggggggggggggggtggcctgctggtaataatagcgataagccgatcgctggcaccggaggtcgtgggttcgattccctcccaggtctataatttttccaaacctttattaaattgaaattcatattatgccaaataaaatttctattagaaaatgttggcttacacaattttttgccattaatgatacttttcctaattaagttttccaatacaaattaaaccgacggcggattgcccactgactgatcaaatgaattttttgttttgttttggtgactaaaagattagttaatgacaatgtcctggattcaaccaaagtattatattaaattaaaaataaaataaattatttttgatttgagagagtggctccattggttggttgtcaatgtgccgggcactgatgtcgcgcagggagagcaactcatcgattatatggggccggcaccgcccaaagggacgggttggcacaaacaatgaataatgagtgtcataatcaatttgtttgcctattgaaaaaataaaaaagaattttgaggtctccaccgctatgtgttccttgtctatgcgcagaaagaggaggcggtggttaatgccattaaaaagccaggtaatcaatcagtgttgggagactgaaaaatgcttttgaaccctatccatggaatttaaagggtgtaggggcaaggtcaatttgttaaacggtttcctaattaatatttggcgtaaccggggcataaattgccccaaggctgggccttgtccattcgaatcacaacacaaatcgcgaactcagttttgtctaaaaattgctcatttaggaatataattagataattagcaccacattttccagggcgttcgcacttcaacatcagagaatttgccaaggaaatttacgtcgggccgcctctggcagggaatttcttcaacgcgaaataccacggctgaatcagacccaatttgagtgggaatgaaagaaccatg

SEQ ID NO: 64014 - DNA, 979 bp, Heterodera glycines
  Genomic contig location: Contig_ID=SeqID_34144; Location=1..979; Strand=-
  SCN-specific regions: Sequence locations=1-214,236-504,548-845,869-979
  Gene Ontology: Mol. function=carnitine transporter activity; Cellular component=plasma membrane; Biological process=cation transport
tgtgatcatgttttgctgtttctgatcagcccacgtgcatctgtcctattccctgggctatttggtcggctgtctgatgggcggctttatctccgaccgttacggccgtaagccggccatttacggcttctccattctgtccaccatcttcggctttctgctgtccttctcgcgcgagttcgaagtgtttttggtcgtccgatttcttctcgccgcttgcaatgaggcggccgatttggccgcttacgtttattgcatggaaatcactggttttgccatgccaaaatgcccttttgcaccatgccaatgcttctttctccccagggatgcagtatcgttccgttgtcggcagccttttgcaagcgccgtgggcttgcggctacgccttcctggcattagttgcttacatttggcggtcgtggacctcaattcaggtggggtgggcggctcccggacaattcgtcaacaaacttaataaaacgcaattttatgtaaaacaatatgaaaattaatttaaaattcaaaaaataatttttgtaatttatttcctgacgaattgtccattactgaccgattgtctctctggacatcgagtgggcgaggggaagctaaggattgcaaatgatagctgatcaccaccgttttccatctccttgccctgtttctgatccatcatcttccggagagtccacgttggctaatcgccacaaatcgcgtggacgaggcgagtccattctgctatttaccgtattaaagtgatttacaggcggagaaaatcatcaggaaggcatgccacttcaataaggcatagtcaattagcactaatgaccaattaatgagtctaagtgccttttcagagttcgcttccctccgatttggaattggtgcgacacgcggaacaacgcaaatggctaaaatacaatcaaaggccgcactttattgactcatttaaatcgccgacaatggcatttcgtaaatg

SEQ ID NO: 64015 - DNA, 66 bp, Heterodera glycines
  Genomic contig location: Contig_ID=SeqID_34145; Location=22..87; Strand=-
  SCN-specific regions: Sequence locations=1-66
atggctatctctttttttgagaaattttctatgcaacaaacgctctcaaacatgaaacgaagtgcg

SEQ ID NO: 64016 - DNA, 146 bp, Heterodera glycines; identical to SEQ ID NO: 56264
  Genomic contig location: Contig_ID=SeqID_34145; Location=194..339; Strand=-
  SCN-specific regions: Sequence locations=1-79,113-146

SEQ ID NO: 64017 - DNA, 146 bp, Heterodera glycines; identical to SEQ ID NO: 56264
  Genomic contig location: Contig_ID=SeqID_34145; Location=446..591; Strand=-
  SCN-specific regions: Sequence locations=1-79,113-146

SEQ ID NO: 64018 - DNA, 146 bp, Heterodera glycines; identical to SEQ ID NO: 56264
  Genomic contig location: Contig_ID=SeqID_34145; Location=698..843; Strand=-
  SCN-specific regions: Sequence locations=1-79,113-146

SEQ ID NO: 64019 - DNA, 484 bp, Heterodera glycines
  Genomic contig location: Contig_ID=SeqID_34149; Location=48..531; Strand=+
  SCN-specific regions: Sequence locations=1-211,373-484
  Gene Ontology: Mol. function=protein binding; Cellular component =axoneme; Biological process=eye photoreceptor cell development
atgataaagaagcgattagagaggaaggaaggtaaagataatgcagggtagaagagggggaggggggggaaatatatgtaaatcaaaaataattacagaaaaaaatgccacgaaagaggagctgaatgaggatggcataatggcacagatgaaagaaatgtttaagcagatgaatctcggaaatttgaacgatttaatgggaggaatgggtgaagaagaagaggaagaaatgagagaaggtgaagaacaattggaagaagaggaggaggaagagaaagaagaggaaaaggcagctgagaaagaaggagagggcgaagaagaaaaggaagagggagaggaggaggagaaagagcaggagaaggaagagggagagggacagtgcagcaaaagtaatgaagaaggaggacaatgtatggcaaaagaaggcgaagagaacgcagaaaagtcagagacgaagatgaaagaggacagagatgaattgtga

SEQ ID NO: 64020 - DNA, 49 bp, Heterodera glycines; identical to SEQ ID NO: 57477
  Genomic contig location: Contig_ID=SeqID_34150; Location=112..160; Strand=-
  SCN-specific regions: Sequence locations=1-49

SEQ ID NO: 64021 - DNA, 2822 bp, Heterodera glycines; identical to SEQ ID NO: 7164
  misc_feature (2729)..(2729): n is a, c, g, or t
  Genomic contig location: Contig_ID=SeqID_7164; Location=1..2822; Strand=+
  SCN-specific regions: Sequence locations=1-19,41-851,873-1442,1466 -1576,1598-1734,1756-1914,1938-2043,2205-2226,2249-2822

SEQ ID NO: 64022 - DNA, 288 bp, Heterodera glycines
  Genomic contig location: Contig_ID=SeqID_34155; Location=426..713; Strand=+
  SCN-specific regions: Sequence locations=1-288
gctggttggatttttacatctgacaggtcttgtgagggcccggagccttctttcgaagggcatccaggaccaacatgggaccgccgcatagatgcccacttattggacagcgatggagacgatcgagacatgtacatggtcgggttgagctggcacaatctttgccattctgggagtacacctttggcccaattaatgagtccccggtcgtctgtgtttcgcaccactacatcctttatagcggactcctccacggctgaccactgctgaaccctctgcgtccggact

SEQ ID NO: 64023 - DNA, 109 bp, Heterodera glycines
  Genomic contig location: Contig_ID=SeqID_34156; Location=1105..1213; Strand=+
  SCN-specific regions: Sequence locations=1-109
atgtctgctgtacaattcaaacagtcatttgacaaagtctgtgccaccacagccaacgcatttcgctttagcctccaatggtgttttgtgccgctggtcgttattcttg

SEQ ID NO: 64024 - DNA, 1009 bp, Heterodera glycines; identical to SEQ ID NO: 34158
  Genomic contig location: Contig_ID=SeqID_34158; Location=1..1009; Strand=+
  SCN-specific regions: Sequence locations=1-244,267-1009

SEQ ID NO: 64025 - DNA, 1231 bp, Heterodera glycines
  Genomic contig location: Contig_ID=SeqID_7165; Location=126..1356; Strand=+
  SCN-specific regions: Sequence locations=1-281,303-397,419-823,857 -961,983-1231
aagcagttcaacggacgcaattcttgaatacaaaaagtcattggaaccgccgagaattgaaataaacggaacaattgaaaattatgcggtgataaaacccccaaattcattattttgtttttagaaataaaatatatgggtaattaagggttcaactgacaatttttctcgtttaaatgctcaaaattcggtgataaatgaccaacgccgtggcagcagtacgtcaatcggatttagtaaagtaataaatgattttattcttaatgtgcaaatgtaaaaacatattatttaaatatttaattgcaaaattttattcttaccatattatagcataaagcacataaagtggattcgcgcaaaatcactcacaaaaaacggttggaaagagggcaggtaattaacacattaatcactttaatacttttaaaataattttgaacgatatttgatcactccaaccatacaaaaaaatctcggtacaattttcatttttcagaccacaacaacagtctctgaagacaaagcactaattgctgaacgagcgccggcattaaaattttttcagcgtgccaacgggtcaaagtttgcgcattccttggaccgatacaacacggtaaagaaaaaggggaatttgatcagtgatcaatcattaaaaaatgccatcgaacaaatattaaccaacgctataatgttgaacatttatcaatggaagtgattagaaatctcgaacattcttggacatgatttcttgaaatttgatatattttttttctaacaattttttttgaactttaaatattcaaagaatcaaatcctcttagtctaaaaatttttttaaataaaaataataaatttacaatattctaagcacaatttattttatttttttgatattcgtattaagattttagttttatttatccaaactttggaattttagtacatatttcaaatatatttgggcatttttgtaatgaaatttcatccttaatgattaatgcgttaattatttcaatttgcattttgggatttcaaaattttacaggatgtttgtgccgaaatgcgtccgctgtcattgcgcagtgccgccgcgcgttccatgtcgccgctgctgcaccagcaacggcgcctgttcagcatcggcggcggcgcgagcggtggcacacatcgctcatgcggaagtgccagcggcatggccggcattggggaagaggacgtactcagctgggag

SEQ ID NO: 64026 - DNA, 65 bp, Heterodera glycines
  Genomic contig location: Contig_ID=SeqID_7166; Location=1893..1957; Strand=+
  SCN-specific regions: Sequence locations=1-65
atgggtttttttttactggatttttgtccagaaaatcgtcgttacggacacggctttttcaaaag

SEQ ID NO: 64027 - DNA, 1216 bp, Heterodera glycines
  Genomic contig location: Contig_ID=SeqID_7167; Location=765..1980; Strand=-
  SCN-specific regions: Sequence locations=1-182,209-230,252-263,285 -331,356-516,538-708,737-824,846-1216
aatattgttgaaataaaacggaccgattttgaacggaatggctccttcccctaccatttgtgcaaaattgtcaatttggctgcgaaggcaagttacaaatgtggcaacattggccgtttgaaggatttggttgtcgcgttgaccgcctacaaaccgtcctcatcatcgcggtattttacacgaataataataattaataaatgttgttttcgtataattttaccacggctaattagggggcatacatatgaatgatccctctgacaattttctagcttttctaacccaagatttttaaaagaaataaatcctaaaattttcatgtaaaatctttaaaaattaatattttttattagaaacaacaaatttcgagacaatacatactacagcataatattctccttttttaacagagaaattttgggcgattcaatgatccgtgaaatgatggcaaacgtattgagaggcttcaaatgtttggtggacaagcaaataaaggcacaatacggacatgacattcaacacttgggcaaactgattgagcatatggaagctgtgattggcaaattgaaaaggtcgtcgaaagagaataaatttaatcagaaaatgattaatttgtttgttcagggatggacgttgtcaaaaggaacgtactgaattggaaacaacactgatcgcatgcattcagcgaagggacaaaattgtatgtttttaaaaatgtttttttttaatttttccatctcatattgtggggtttggatccatggcaactcgtacaatttttaatgggtgtgtccataactttttttaaaatcaaccaaattcttcaaacttgatatcattggaatgctctccaagtttacaagcgatcattaagcagaagctaagagattaagcatttcacgaaaaagttataatttcaagaatattaaaaatccacaaaagcaggctttttggcaatttataaattataacatttttgtgaaatgcttaatgatcacttgtaaacttggagagcattcaaatgatatcaagtttgaagaatttggttgactttaaaaaaagttatgactacacacattaaaaattgtacgagttgccctgacaccgaaaattccaggattatgtgcatagatttttaaacaacaaatttttggtctaaaattcaaagggatccctcaatgttttttcgtgtatcatatatgtacttaataaa

SEQ ID NO: 64028 - DNA, 261 bp, Heterodera glycines
  Genomic contig location: Contig_ID=SeqID_34163; Location=51..311; Strand=+
  SCN-specific regions: Sequence locations=1-124,150-161,183-234,256-261
atgaatgtgagaagaaaaaagtcgaaattgtccagggatggcggcaattgaaattcggctgtgcctgggacattgaagcacagaaatgcatgccgaatgaagaaacagtgaaagcattggcacggggagagaaggcaaagcagaggaagtgacggaaagtattttaaaaatgaaagcaaatgatttgatcgcttctgggattgatcgaagtgatgttgaccgaaacagtttgctacaaatgccaaatttaaatttttgaaa

SEQ ID NO: 64029 - DNA, 1108 bp, Heterodera glycines
  Genomic contig location: Contig_ID=SeqID_34166; Location=97..1204; Strand=+
  SCN-specific regions: Sequence locations=1-214,238-678,701-856,879 -1108
atgatcagccaccgtttcgacttttatgtggacgaacacttcaaaactcgcaaatggacattggcatttattggaattcaaagcaaaaatggagagaatggcaccaaggaaatggaaattgtcaatttcggtcacaaagcattgccaattccgcaaattcaaatgccacgcaaagtcatcggattccaatggatcaacatctcgtaaattggccaatgtcaaaattttttgccaacatttccctttcagtttcatcgaccaaaatgccattgcttttctccgccattttcgtccacttttcaccgcctgtccaatcaatttgaccatcattacgcacaatgctcgcactttggagttcattttgcccaacatttggccattgttcgggaaaaacattcatggcatggatttgtccgccacatttttccgccatttgcgtaaatttgccccgtcgattctcaacgactgtccatcgcttcgctttgtcaatgcctattactatggtttcttcaccggattccctgccgatgacagtgccgcggcatcggatggacaagcgttggccaaatggcttttcactccacttcaaagcaatgtgccaaagatgctcgaatgcgggttggacatgggtgatgggaattggtcgtcgaatattgaacaattcaaagcggtgcattcatttatctttcatttttctttatcaattttcccatattttaggcatttgccaatgcttcttcccccgtcaattttattgtcgtcatgtgttttattcctacgtcttttgctgactccgttgtgccctttgatctgaccaacgaattgacacgcgaacaattggcattgaaaggaactaattttaacaactgttttctgctgatccgttctccaattgcgcgagatgcgaacaaatgggcagaatgggaaaaggaagcgattggatggaaatttattgatcaatgcaacaaaattgaaattcaaatttatgatgaggaacaaatcggagatgggtaagcgaatgcttttttcaaaaattcatatttattgcgtttctatttttaggcttctcgacgcaaatcccggcccaagtgatcagcagcagaagtga

SEQ ID NO: 64030 - DNA, 138 bp, Heterodera glycines; identical to SEQ ID NO: 50950
  Genomic contig location: Contig_ID=SeqID_34167; Location=505..642; Strand=+
  SCN-specific regions: Sequence locations=1-138

SEQ ID NO: 64031 - DNA, 309 bp, Heterodera glycines
  Genomic contig location: Contig_ID=SeqID_34169; Location=74..382; Strand=+
  SCN-specific regions: Sequence locations=1-166,203-309
atggaagtaaaatacggaaatgtggacaaaaacctgaaatatggaaaattaaaaactatcaatattcgaatgataccaattttgaagataactgacgaacaaaaaagttatggccattcccatttgaaattgtacgaaacgccattgtacgaactgctgtcgacccatttttggtgtcatgtgaaggaatggatggatgataaaatgatgaaaatgacggaaaaaagggacgaagcggaggggaaggggggacaaaggaaggaaaaggggcgacgaataatcgcctccggcactttcccgtggtgaata

SEQ ID NO: 64032 - DNA, 385 bp, Heterodera glycines
  Genomic contig location: Contig_ID=SeqID_7168; Location=545..929; Strand=+
  SCN-specific regions: Sequence locations=1-33,55-385
atgaattatgatcttttcactttttgtccaatgtattttatgtcttatgtaacttttgctaattgtattgatacccaatgatttacgaaaaaaacattcagttatcatccattgctgaacagaaaagccaaggcgtcattagcgatcattaaaaaatttgtgacaaattcgtccgccgtttcgccacacgaaggaatggcacaaccattggacaacgacggaaggccattcagtgaacgaattcggcaagaaaagcaggacaaagaagcgtactttaaacaattggcctcagcttggggtgacaaagcatgaaaaacaaattcgattatgtaaagaaaatccgagaaaaaaaaataccgaaaattaaacaaaaaatctcgctcga

SEQ ID NO: 64033 - DNA, 752 bp, Heterodera glycines
  Genomic contig location: Contig_ID=SeqID_7168; Location=2623..3374; Strand=+
  SCN-specific regions: Sequence locations=1-86,111-345,375-400,423 -525,577-752
atgttgattgtttcaagtttcgaatttcgtatgttgttggcacgaaatacgaaattattaagcactggtaagaatgtgggaaggggttgagagaaaatattttttgaaaattggtagaaaaggaaaatttttttgaaaagaaattataatttgatcagttcttttacacgtaaagaacaagaaaaatatatagcctgggcccgtaccaaaagaacgaggtaagggttaacctaccctcagaaccaggggtggggcgcggagagaaaatcacgcggtcgcggatcgcgcggaaaattggaaaattattaggcgcaaatcgaaatttaatatacaaatggaaaaaagaattaaatttaaataaaatgaatttttatgagcaaaaaaagagggaattcattaaacgatttgatgaatgtaaaagtttatatggccaactcaaacagaaagaatttgtgaaggaattgggcatttctgaatttacatttataaaatggaaaatgaattattgccaaattacaataaacgtaataatgtttttttaattaattaatattcatttaatttttatatttatttgtttaaggcaaattgaaaattcatacctatgctgagaaattgaaatatgtgaaaagaagtgaggaaatgaaactaagaaaatctaacgatgagtgataagaaaattgccgaaaatttgggtgtcaaacgaaccagcttaatcggatggaagaagaagttcggcaccaaaacgtgaa

SEQ ID NO: 64034 - DNA, 373 bp, Heterodera glycines
  Genomic contig location: Contig_ID=SeqID_7168; Location=4374..4746; Strand=+
  SCN-specific regions: Sequence locations=1-118,141-345
atggccagaagaattctaaacccagatttttcgtatgggtttcgtcgacgaatttttttggttttcgccgggactggggttaattattcaatggtggcgttaaggattgcagtcgggattagatttttgtatatactttaattaacaaatcttgaatcttgtcccttaatttatgacggcaaagaattaccacgatccaattaaatgctattgtgttttagataattcaaatggattttgcaacggggccaacgaagaaattctgcgaggtctgtcggagctggattgacttatttgaggataaaattcaagtggaaaagttgatgagtaagccggagtgttttgaattaaaataattaattaatttttttaa

SEQ ID NO: 64035 - DNA, 759 bp, Heterodera glycines
  Genomic contig location: Contig_ID=SeqID_34177; Location=32..790; Strand=-
  SCN-specific regions: Sequence locations=1-155,179-296,319-397,422 -520,542-599,640-759
atggccgcccgtgatcttcagtgtgttcaatgccaacaattcatgcataattggggcgtatgtgttgcctaaatcatcctagtaatttatttcgaaaaagtgataaataaatggggaaatacgtcactaaagtggtggtcgtacaaaaccggtcgaatttaaaagatttttaaacttttggaaagtttcgaaaaacaaaaaatctaatttaagttaactaattttgataaaccggttttgctggcaaaggtcaaacttattattagtgtgatatgcatttaacatggccaaggcataatatattttgataagtgaaatgaagtgcatattttttgttttttaaatggcaacaaacagcggcaatttgtggtggtgtgacaatgctaaactgatcaacaaaaataataataataataatttagagagaaggaaattggcgtggacaattaattactttattgggtaattacggtgtagagaatggtagaaatgctgatggtgtcttactccgtcatttttgagaataatttatgaaaaaagcggttttccggagcatttcaaggtcaacattgatcaaagtgatcacaaaaatgacattcaaaataattttttgaaaaatacaaatttaattaattatatgcctctggaaaagtgttcaaatgagggaaaatcaccatcaacaagcagtagtagtcagtgtattgtaatatcgagaattaagaagttttctatggcaaaaacgaaaaaaaagacattaaa

SEQ ID NO: 64036 - DNA, 388 bp, Heterodera glycines
  Genomic contig location: Contig_ID=SeqID_34183; Location=348..735; Strand=-
  SCN-specific regions: Sequence locations=1-20,42-275,297-388
atgccaaaacaaaacgaaatcgttttaaaatattcctttctggacttgacttggtttcttgatatcgaagctgttttctgcgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagtaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 64037 - DNA, 817 bp, Heterodera glycines
  Genomic contig location: Contig_ID=SeqID_34185; Location=60..876; Strand=-
  SCN-specific regions: Sequence locations=1-374,398-649,806-817
catttcaatcactgggactcaacccaacagcatttcaatcactgggactcaacccaccagcatttcaatcactgggactcaatccaccaacatttcaatcactgggactcaacccaacagcattccaatcactgggactaaacccaccagcatttcaatcactggtactcaacccaccagcatttcaatcactggcactcaattctccgcatttcaatcactgggactcaacccaccagcatttcaatcactgggactcaacccaccagcatttcaatcactgggactcaacccaccagcatttcaatcactgggactcaacccaccagcatttcaatcactgggactcaacccaacagcatttcaatcactgggactcagcccaccagcatttcaatcactgggactcaacccaacagcatttcaatcactgggactcaattctgcatttcaatcactggtactcaacccaccagcatttcaatcactggtactcaacccaccagcatttcaatcactggtactcaatccaccaacatttcaatcactggtactcaacccaacagcattacaatcactggtactaaacccaacagcattacaatcactggtactcaattctccagcatttcaatcactgggactcaatccaccatcattacaatcactggtactcaacccaccagcattacaatcactggtactcaacccaccatcattacaatcactggtactcaaaccaccatcattacaatcactggtactcaacccatcatcattacaatcgctgctactcacaccagcatttcaatcactg

SEQ ID NO: 64038 - DNA, 48 bp, Heterodera glycines
  Genomic contig location: Contig_ID=SeqID_34186; Location=701..748; Strand=+
  SCN-specific regions: Sequence locations=1-48
atgatgacacttttgtttgtcaaacctacacttgtgatggtggaaaat

SEQ ID NO: 64039 - DNA, 586 bp, Heterodera glycines
  Genomic contig location: Contig_ID=SeqID_7172; Location=606..1191; Strand=-
  SCN-specific regions: Sequence locations=1-86,109-152,200-403,430 -482,545-557
atggggtttttaaggtctctgatcacgaatcggacattcattttgaccaatttcgaatcccggacccgaattcgaacaaaaagtcgaaaattcaaaattttcaaaattcacttttatgattgcactggaaatcatttaaatgtatgtaatccataattatttaaacataattaattttctattgtttatataattaattcacttttagttgcgtcctcacgagtggctttgcgtgcgtgaaaatgccacacccgaggagatcaacgaaaactaccggaagtttgtccgtgtcgttcacccggacaaaaacaaccaatgcagcgacaaattgtttatggtttaaaaatagagtgccacgggaccgggaatttttgccaaaaccgggacttgccgggacctgagaagccgggaccgggaccgggacctcgattttttttcgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttataataaa

SEQ ID NO: 64040 - DNA, 88 bp, Heterodera glycines
  Genomic contig location: Contig_ID=SeqID_7172; Location=1284..1371; Strand=+
  SCN-specific regions: Sequence locations=1-88
ttttaagccaatttattcacaaaatacattttttttttgttgccaaaatgagcacggaacgctattccttctctctcaccaccttcag

SEQ ID NO: 64041 - DNA, 1888 bp, Heterodera glycines
  Genomic contig location: Contig_ID=SeqID_7173; Location=338..2225; Strand=+
  SCN-specific regions: Sequence locations=1-222,244-425,477-563,585 -606,629-643,665-713,735-784,880-969,1073-1206,1228-1376,1404 -1433,1455-1526,1549-1644,1668-1710,1738-1888
gaatgaatgatgatcagttcagtctggaggaagaagaaggaaaagaacagcaagaagacaggaaaactccgacaaaagatggtaatatacaaatattagaagacattttcagatataatttggtaacttaacgacaattttaaaaaattaattgaaaattgcttcaaatttcagtttcggacggtcatttgaaagcaattttggagagaattggtgaattggagaagcagcaacaacagcagacaaaaggcgagggcaatttaacgaaaatgaaatttttgggcttttctttggtaactgcgcaattgaacatttttcgaatcatttaattattgagaacattttgactggcaacagcagaattaatacaatcagaaaaatcttaaaactcgaccgattctgcgaaaaaatgctaaaagcataggaataattattaaatttattttattttcatttaaataaataaataattaattgttttctattttaagctgctgaggaacggttcttacaatcgcaaaatgatcagaagaaaattttggaaagaatcttcagtgaattggagaagcagcaacaacagcagacaaaaggcgaggacaaattaacgaaaatgaaaaaatatttaatcgaattaaatgtttccattttaaatttaaaaattaatccgatttttaagctactgcggggcaattgtcaaagattttggaaaaaattggtgaaatggaaaaacagaacgaaaacacggacaaaggcgagggaattttagcgaagaataaattatcacttattaaaaattcttttttttgaataagtttcttatgaattaagaatttcatttaaataaattataacatttttaatttttgaaaattaattttaggaactttggagcaattttcaaagatggaaaatgatcagaagaacattttggaaaaaatcagtgaaatggagaagcagacaaagaaaaaggtgaatgaatgaatggaagagaaaaataaaataaaaatattttacggtaaaaataatttttaatttatctaataaattattatataatattattaaaaaatatcgaattatttactttcaggggtttttaaaattccaagaaaattgttgggatgccttcgcttctcacgaggacatcgaaatcagtggtgacaaaagtctcattgtctatgtctatccttcgagaaaagatcatagtatttttaaaatttacatcaaaattcaatttctactaacaagacgcgtggcatgccgtcttcgcaaaatatccgattgtgctgaacaagtctttgtctgactttttttactacgaaatttcagttattaaaaaaaaacgaatttaagtaagcgaattttggtataaaaagtgaaatattttattatttatttcttctttattcagttgggtcatcaagatcggattcgctgttaaacagcagacaaaattggatgaaacaattcaacttgaaaagggcacttttgcatatgaaagcgatggcgatatttggattaacggagaaggaaagggaacaaatgcccaatattcctacggtgttggcgataccgttggaattggcgtcaattcggccactcgacagatcattttcaccaaaaatggacttcgtttgggttagcaaataataaataatataattttacgattttaaattacaatttggttatttgtctattttatgctaatttattttatgtttaaaataatcaaaaatcccttaactttttcacagatacttctgatttggttgatccatcttttgctgatggttcattttatccattcgttactttggtcacttctggtgaccaaattgaggcgaattttgggcccaatttcaaattcgatttggcgactctctga

SEQ ID NO: 64042 - DNA, 666 bp, Heterodera glycines
  Genomic contig location: Contig_ID=SeqID_7173; Location=2401..3066; Strand=-
  SCN-specific regions: Sequence locations=1-38,72-193,247-322,373 -411,441-642,664-666
atggcaacatttaacggggagaaacgagagagtgtagcaaaggatgagaaaaagggaaagacaaaaaaggaagtgcaaatgaccgtcgcgaaagggtgggtgggaaacacggatggcattccgaggcctcaaacattttcggaagtcgaaaatcggaattccgaccccaaaaacatcggaagacggaaatcggaaatttttcaaaaaatataaaatatcataaaaaaatttctaaatattttaataggctaaattttttaattaggtgatttcaaaaatgtttttggttttttgaatatttttcttgaaaagtattcgatggttttatttaaaatttttttatgtcatttttcattattttagaaaatttttgggaaaaggagtgactatttacacgtttttaacggcgcgcttttttcaaaaactttttgggaagaaaagggtccagcggtgccgataggcgccgccgggaaatttttgaaaatttcagtgcaatttattgacagaaattgtaaaaacataattaatgggtcgaggaaaggaaaatataaaattattttgtgatttaaatgaaaaagtaatttctgattttcatattttcccaaaaatatggatataaaatcgcgaaatatggacataaaatggcaaaaatatgttttaaataaa

SEQ ID NO: 64043 - DNA, 531 bp, Heterodera glycines
  Genomic contig location: Contig_ID=SeqID_7174; Location=543..1073; Strand=-
  SCN-specific regions: Sequence locations=1-531
atgttcggcggattttgcggaatatttgttggaccgtttaaaaggtatgaccatttgtaaagcttgaaaagagaaatagatgcgtaaagttaatatcacaaattctcagaaaaattacgttatcgccgacggtggaaacacgaaatccttcgttatgcaatgctacaaattgtcttgctagtgcttttttcgttgaaacatttgtcctaatgaccacgacaataatcacagcaataataatcaccacaatagctctaaatgataaacatggatgtaatggatgtaaaaaggaatttcggtaactattaacatacattataagtagagaccggaaatttcaaatttgcggatcccgctgcgggactggaactcaaaattttttgcgggacgggatcccgcgggattaatcccgcaaatcccgcatttaaaatttgcgggatcccgtgcgggattgcgggattttagaaaattcgaaaaaatttcaattaaattcaaaaaatttccaaaaatcaaaaaatgctgaaaaataaa

SEQ ID NO: 64044 - DNA, 415 bp, Heterodera glycines
  Genomic contig location: Contig_ID=SeqID_34192; Location=445..859; Strand=-
  SCN-specific regions: Sequence locations=1-126,148-298,320-415
ggtgcccatttcggctcgcccttttaccattcgtccgccgctgctcagaattcgtccgccaataacactccgccccaatcgcaacgtgtgccaaccatcgcagtacagcaggtaaaagcgactcgaaaaagccaaatcagcagcaaagtgccaaaacaaacgaaagcaccccgagtctatgctttttggaccaatctcccattttttgggtaattctcatattcattttggagactatttcttggcattttgaggacaaagtccgattttcgagggcaaatctctgtgtttgaaaaagccagttcatttatttgttgatcagttgctgatcactcaacttttcagccgagtttgccgtttggacctggcgccaattatgcaaataatggcattcccggggatgatgagcaaatga

SEQ ID NO: 64045 - DNA, 332 bp, Heterodera glycines
  Genomic contig location: Contig_ID=SeqID_34193; Location=319..650; Strand=+
  SCN-specific regions: Sequence locations=1-332
gaaatgctcagcagcggcgacccacagtacgctcactacggtgggcctttacacgtcaaagtggagacgactgctccgcctgccgtcgcttatcagcgcgttgctggcgttctcgccgtccttgctgaactgctgcaaccagtgaatgaaaaaggatggcaatgagaaagtacattcagattaaggtcaaagacacacacattgagggcatcacaacggagcccaacccgaatttgaacgcattggaagggggcggggacagcgacgggggaggcgactcgaacggagccgaaggcaatggcgaagaagccggaggaccaagtaaagcttga

SEQ ID NO: 64046 - DNA, 212 bp, Heterodera glycines
  Genomic contig location: Contig_ID=SeqID_34195; Location=539..750; Strand=+
  SCN-specific regions: Sequence locations=1-187
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttt

SEQ ID NO: 64047 - DNA, 411 bp, Heterodera glycines
  Genomic contig location: Contig_ID=SeqID_34196; Location=86..496; Strand=-
  SCN-specific regions: Sequence locations=1-88,110-411
atgaaaatgaataagcgaattttgaagaaaatgtgagaatttattcgtttaagaatttgtgaattcatttttaagaacacttcaatatattttgacaatttcagttggatttgcaacgacattttgatggacattttccctcattttgaccgcgcccaactggcctcaaaatggcacttctttcgcctcgtttcgatgttttggtggacaaacatttcgatggcaaaagcgaattgccaatttggggaccaatcagaattgaaaggatgggaacagaagcaaaactatgtgtcgttaaattgagcaatggcaattctgtgccatttccattgcctgaccgtccgttgcccgacaaaattcgctttaattaccttcagattaagtaactgaaattcaaaaacaattaataaa

SEQ ID NO: 64048 - DNA, 721 bp, Heterodera glycines
  Genomic contig location: Contig_ID=SeqID_34198; Location=60..780; Strand=-
  SCN-specific regions: Sequence locations=1-91,118-211,282-604,626-634
ttaattgcaaaaacggcgactgaacttacggaaattgtgacagagaaaatggacagaatttatgtcaaattggagcaacagcaggtgaaaaatgatttaaattcttttaaatttaaattccaatttttccgcaggcgatggccaaattggcaaatgcaaaagaaattcaggtactaattatgtagtaattaagtcacaattttttggaggcattaataaaaaaatgtctttttttcaaaaatttacaaaaatgaaatttcgaatttaaaaattatttaattgcttacaactttaaactctttaatgacaaagtcataaattttgcatattttcagtcgcttctcagcgcaacgatcgacgaaaaaatggccaaacatgaggtggtgaataaatctttttaggggtcaaattggacggggagtctataagaagtgggataatatttataattggaacaattgcaaatttcatccccaaattttcagtcacttctaatcgcaactgatcaaagaattgtccattttttgcttttgccatttcttctgatcgccgccgtttgccttacacttttgctgatcaaagcaattgtcgaccaatttttgaagcagaaatttgaacaaaacaacgacacaacggatggggaagaggaaaagcggactgaagagaaggaggaaacggaagaaaatggaaaaggaggagagaaaggaagacgaggggagga

SEQ ID NO: 64049 - DNA, 366 bp, Heterodera glycines
  Genomic contig location: Contig_ID=SeqID_34200; Location=737..1102; Strand=+
  SCN-specific regions: Sequence locations=1-31,53-89,111-366
atggcacaaaataaccaaataatcttacagattgttgttgttgttgtgccaatagcattggatgcagaagttttgctggcgctggcactcgctgccgcccgtgcggcggcggaaatagtcgcggtaccactcaccgagtgcttgacgctcgctgatgttgaactttacgctactgatgaccgaggaactattgactctgcaactttggacaaatcaaaagactataaccgactaaacgtctaggcgccgaaaaaccacgatattgcaccgagaaagagtgacgtttgcgcgatcttcaagctctgagggccactaccatgtaaaagttgtggtcatgaaaccgacattggaatttttgaaagaaaa

SEQ ID NO: 64050 - DNA, 1507 bp, Heterodera glycines
  Genomic contig location: Contig_ID=SeqID_7175; Location=1094..2600; Strand=+
  SCN-specific regions: Sequence locations=1-77,99-275,305-457,479 -732,754-789,813-841,864-1035,1057-1234,1263-1356,1385-1507
atgaaaaaaattgacgaaattgcaaataatttgagattacggacaaaaagggcagctttccaggtggcctgtcacagtatttctgcccaaaatgctgtaatttttttttaaatctttaagtttatcatttttttttcattttcagtctccaaagccccgttcagcagacaggaaagttcgccgtcagtcggtccgtcgcccgcccacaaatgtacggcgccagcgcgcagccaacatcagttcaaaactggtaaatttccacaaaatgatttttcataaaatttaaattttttaaattttttttgttttttcttagtttgatgcttccgacatggaagacgaaaattttaacaaaaaggtgggggtgaaaatacgggtaaattagggtcaaaaaagctacttttttcagcaacaacagaacgatccgataacaacagcaggagtcagtccgataatgattttttaataaaaaattaaagggtttttttttgggtggtatgaactgaaattttagattttaattctccctccctaatttaggaagaacgaagtgagcttgaccaattgtttttggaagtgcaacggacagttttcggcattggagcaaaatccaacttcaaagaggacgcggtggtgcgacgagccgacaacacattggtcaatgattgggaaaaacacgaggggggggggtctgaaaaagatattttttcgtgtgcttttccaaagacaaataaaagttttttgttgtttttagcaacgtcctctcccgccgcttttccacaatgatgatgaagcccaaaaggctgtggtcggcaagcgattggtcactgacaatgcggccaaaagcggcacctcggccgcgaaccccaaaagggtcaaaacgacgttggacgaccttttgatggatgtggaaatgagagcagagcaggacggaacgcaaacgacgcagcaaattgcgagcgaccaaactgaccaacagcagcaaaattacacggtaagtaattggttcgcctcaaaaaatgaggggttttaaactcaagggggagggggtcacaaaaatattatggtattataattttgcgattgttaagagaatttttttgagggagtgaatgatcttaaaattaagtgtttttttttcagttggtcaatgtgtgttcaacatcaacaacaaaactgtgtgaagtgcaggacggagtgcaaacgacgcaacaaattgtgggcgacaaaacggatcaacagcagcaacagcagcaaaataacatggtgatcgaaaagccggtgagtaatttattcacgcaaaaaaggaggggtgtctaatgaccaagagtctcaatggagggggaggggggttagaaaaaattcattataattttaaatttttgtgattgttcaggtggtgcatgcggtcattgatggcgacgacgaagattctgaaaatgtgccgagcttaatctcaattggcactcaaacctggccaaaaaaaaagataagttgcagtttttga

SEQ ID NO: 64051 - DNA, 1348 bp, Heterodera glycines
  Genomic contig location: Contig_ID=SeqID_7176; Location=584..1931; Strand=-
  SCN-specific regions: Sequence locations=1-146,206-414,435-813,835 -867,889-1239,1274-1348
atggacagcgagctatcttcgaaagtgcaacaacaggcacaaatgtgcagatttcttcgctcccatgttagcgatttgaaaaatctgtcattaaactattctgcacgcctagaattgttggaaaaatgggcaggaaatgaagtgagaatttaaataatagttatttaattatcattataatttaatttaaaaatctataattttagcaatattcgccttatccatcaaatacgcattctccagtgtcgccggcagttctgcacgaaacactggagattattcagcaacagtccaggcaacatgaacaactggcgaacagagtccttgagaaaggcaacaccgaacttgctgttgtacaagtggcactatcgtcattgaaacgagcaatgacaccatcgctgaatactgatcagacatcatcatcatcatcatcagtaaaaaggagaagattgatgtcggaggagcaaaatggtaatgttactaatcatttttttgagtaaaagataattttgcctttatagaagcggcttctttggcgatggccgcctttacacatctgcaaaatcacattgcagaaaaatgtcaaattttgcaaagccgtgtccaaaagctggaggatggtggagctgaaaggatggaagtgcaagtcgacaaaatgcgccgagaaatggagcaaaaccttcgacaagaaatgatggaacgtgaacaacgccttgatgaaaaatggagcgttttgctgttgaaggagcgtgagaagacgcaacagatcgccacacaggcttccgaggtgatcggtaatttgcttgaaaatggtgaaaaagaagggaaggaaaacaatcaaaaggggaaaaagctgatcgtcagtgaacggtgtctgtggtgtttagggaatgaaaatatggtgacatttggggctaaggagtgtttacatgttttttcttgtccaaagtgctctatcccaatcattgcaagcgatgaacccaagtgcttgatttgttttcaaaatatttccgaattggaatatatgaaaaattgaaagagtagaaattggatcaaaaagaaaagaatttacgatcattttttcgctttttctactcttttgcctttgcatttaatgtctcttacatttttgttgcaatttaatacaaattttgcatatttaaactttgactctgacactgtttgataataagaatacagtaagttctgattgataatagtactgtaatttatttatactcataatatttcatttaattctcctgacattttgttataatttatttgatcctattctacgaatttttttcatatttaaacttggcctctaatattgtttgataataaa

SEQ ID NO: 64052 - DNA, 975 bp, Heterodera glycines
  Genomic contig location: Contig_ID=SeqID_34206; Location=3..977; Strand=+
  SCN-specific regions: Sequence locations=1-83,105-975
  Gene Ontology: Mol. function=helicase activity; Cellular component =basement membrane; Biological process=protein folding
atgaaaatatcaatcatcgacctagtattctttggaatgctttttgcatttcttggaaatggtgcatctacttttcccttgaattcggctgtgatggaggtcgagaaggacgaagcggacaattcgactacggtggaggccgaagacaattcgactacggcggatgatgtgacagaggatgcggacaattcgactacggtggaggccgaagacaattcgactacggcggatgatgtgacagaggatgcggacaattcgactacggtggaggttgtgacagaggatgcggacaattcgactacggtggaggctgtgacagaggatgcggacaattcgactacggcggatgatgtgacagaggatgcggacagttcgactactttggaggatgtgacagaggatgcggacaattcgactacggtggaggctgtgacagaagatgcggacaattcgactacggcgaaggatgtgacagaggactcggacaattcgactacggtggagactgtgacagaggatgcggacaattcgactacggcggaggatgtgacagaggatgcggacaattcgactacggcggtgcttgattgtgcgacggagaatgcggacaattcgactaaggaggaaatccaagaggccacgatggaggctaagacagaggacgcggataattcgactacggttgaaattgggaacccagatgacgagtgataattgtcattttcttgatactttgacgagaattttgaatttgtgataaactgtggaaattaacagttacaaatcccttatttgtcagttaatttgttttttttttgaaaatctttggcctaaattacggattcttacggcaatttttttaattatggaaatctgcattccgtcattatggaggtccaaaatttgtgattttttgaaagtcaattttgcgaaagggtccggtcatgtaaactctgatacatcgactaattaaaa

SEQ ID NO: 64053 - DNA, 1047 bp, Heterodera glycines
  Genomic contig location: Contig_ID=SeqID_34209; Location=257..1303; Strand=-
  SCN-specific regions: Sequence locations=1-23,46-103,133-284,358 -388,411-566,588-604,627-671,698-708,731-763,923-1047
  Gene Ontology: Biological process=N-linked glycosylation
atggcatcttccggcattgatataccgccaccaccacctccgccagaacttgcaccgccggaggagaaaaagatgatgttgcaggtaattcaggaactgttacaaaaatatttaatattttttgtattttttgacaattttcttgtatctctttaccagcctgataacactggtacgacggaccaagaaaatgttcaacaacaacaatcagttgaaccgtcgatgccatgccttcacgttgtaagcgatgaaacaatcattgacgctgatgtcccgatggaaattgatgatgaggacgacgacgacaatgatgatgatgatgaagacggcgatggcgtcaacgacgatgatgctgatcgtccatacagtccttcacaggtagtgggcgattattatcttcaattgataattttcagaggggtaccttgataattgagctatttgtcgtaatttgtaccaaattcaaaatactagttcaccaaaatttatttttgggttcagctttgtggcttggtaaaacaagcactttccctgttataatattcaacatttacagtaaatcctgattgtaaaatttgatttctgtagttttatgcacaggcgattccaccgccgccgccaccgttgcaattgaaaacgaataatgaggagacaaacagcaaagacgaataccttgatgaggaggaggaggatgagattacggaagaagaatgtgtagaggagaaattggacgagacaaagcaaaaagtagttgggcataggcaaaagaaatggacaaaagtgaaaagggaagaaaatgagagtaaaaaggtggaacaacaaaaattgatgatggaagaaggcaaaaatggagatgagcatggccaggaaaaggaaaaagaagacgaaggccaggaaaatgaaggcgcagaagaagacaaagtggagcagcaacgggaacagcaaaggcaaaattcaccggtgccaagcgaagcgacgagaaaggcggatgaggagaagggaattcagcaggtccaaaaccatcatcatcatcaataccaacagtag

SEQ ID NO: 64054 - DNA, 978 bp, Heterodera glycines
  Genomic contig location: Contig_ID=SeqID_7177; Location=154..1131; Strand=-
  SCN-specific regions: Sequence locations=1-322,345-353,377-889,921-978
atggcattttttaatccaatcccctccccctcccaagatgccgtctccaaactgctcaaatgcaccgcccttttcccttgtgagcattcgaatcgggtgccggagggcaagtcgtcccaccagctgttgctgtgcggcattttccgtggcggcatcgatgtgctgtgccgtgtccgcctggtcatggacccatccgaccagacggtgtccatgaacatggttgtcaggtagaaattaagccataattcatatcctccttccctaatgggccagacgatttttaagaattttttttgttgttgttaaaaatgtaggaaatttgaaaaaacattttgaaaaggaagggcaattaaatttttaccaaaaattgtttttaggaaatataaattatgggaatttattttgtaatcaaaaaataatcattttttcatgttcagatcaatggacgaaacagtcagtcaaatgatcgcaaacattgtcagctgaggaacggcaaaaaacattcatctgttgttacatcaatgataatatttctaaatttacactatttgattgatggctggattttatttatttactcgttctttgttttattgtgtccacaaaaataataaaaagtctttcggtccaatttaattaaactcaatacttacaccaatcgacttgtctcatcgagatggatcgaaagatatgtaatttatatgcaacttcaatattggtggtattctttttatttcttttttttaaacattatccccattagaaattttgaagattacattccttgcaaatttgaacatttttggtacgaatctgtaaaatcacattggctcaaaccaataaatttggtcattttttgagtaaaatctcaaatctgaattttttcatgaaaaaaatttgaaaaaaataattatttttttcagaacccgataccctgacccggttcgaaatcttggaccaggacccggcaaaccctga

SEQ ID NO: 64055 - DNA, 1206 bp, Heterodera glycines
  Genomic contig location: Contig_ID=SeqID_7179; Location=263..1468; Strand=-
  SCN-specific regions: Sequence locations=1-11,35-129,151-270,305 -366,414-527,603-941,971-1040,1064-1071,1097-1136,1159-1206
  Gene Ontology: Cellular component=COPI vesicle coat; Biological process=ER to Golgi transport
tgtgccaggctatcgagcgctacatgaagcaggcgattgtggacaaaacggcttcggtgtcctccgccgctttggtctcatcgctccatttgatgcgcaaaagccccgaggtttgcgcacattcattaaacatttcttattatgtttgcaaatttcatctacctatattttcttacttttttattgaaatttttttattttgcattatctcccccccaagaaattaaaaaaaattactaacttagaaatttttcaagaaagaaatcatagaatttttttcataataaaaaattttttaataaatcttttcgagaaattttcagcgattttttggaaaaattttttgaaagatcttacgaattcaccataaaatatatttaaaaaaaaattcttagaattttcttataaaaaaactttctaagattttttcttgagaagtttctaagttagtaaatttaaaaaaaaaattctctggggaaacgagctgctcctattttttacaccatgaaaagtgccgtgaaaattgattttttttttttttttgagattttatttgtctttatttttcatctttattttttcatggcttttcccccttttttcggtcgtccgccgttgggccaacgaagtgcaggaggcggtgtccgccgaaaatcacatggtccaattccacgccctttctttgctcgttcaaatccgtgccaacgaccgactggccattctgaagatggtccaaaagttcaggtaaaagtcgtgtccgggtagtttgggtccgattttggacataggcgcaaatgtggggaaaatagtaatttttggcgaaaacggctaaaaattttgcaaaacacaaccccctaattcgggattcaaaaaaccaaaaatacatccctaaaaatcgaattttggcttcagccccccccccgaaatctttgatctattcgaatttaaattatatatatatatatattttgtgtcctttgccagcaagtccggactgcgctccccgctggcgttgtgccaacttgtccgtgtggcggcccgcctcatcgcggccgaggcggaggagcacgcgctgggcgtggacggcggcggcagcgccgagtcgcgctccgccttcaccttcatcgagagttgcctgcgcaacaaacacgagatggtcgtctacgaggccgcctctgccattgtgcggttgccgcgcattagcag

SEQ ID NO: 64056 - DNA, 1770 bp, Heterodera glycines
  Genomic contig location: Contig_ID=SeqID_7180; Location=1..1770; Strand=-
  SCN-specific regions: Sequence locations=1-305,327-471,493-1075,1099 -1163,1187-1312,1335-1421,1444-1519,1542-1770
  Gene Ontology: Cellular component=membrane; Biological process =intracellular protein transport
cgtcgtgacaaaaaagacgatgaatcggccgccgggaacccttacgaccacttggacaaggccactgttgtccaagaggttttgttttacccaaatatttgcgcttataattggtcaagaccgtgtaaatgacgacatactttttggagaccatcggcaaatgggtccaagggtctttggtaattttctgttttgagacgccccttgaaattttcaaataaaacgtcatttctaagattatttctggcgctggtcacgaatatgacatttgttttgtaaaattccgagctccaaaccagaattcgaacaaaaactcaaatcataaattacaaggaaaacatattttggtaatagttcaatttgtccccccattttttgaattttttttagattttaagtcaaaaacacgttttttaataggttttcggcatagccgatcacgaaaagtccggctctttttgctgattaagccatgcctattgtgatttaaaagcgtgaatttgcaacgaattttttttaggcatatgcaagcgcaaatgcacggagttcgaatgtttgaacacaatttgttgggggcgttgaaaatggactaaaatttctcaaacttttgccaaatttatcagttaacgagtctgaatgttaaaacttttactggattttatggttatggttcgccactccatccttaagccgaatcctgcttatttgttagtccctggttcacggaaaattcctaacttgttaattatcatgcaaaatgtgtggcaaaaaaatatgcaaattccctcatttgacgacgacaatacagaaaatgcccccattttcagacgcgtgccttcaacgagacgccggtgaatgcacgcaaatgtcggcccattctgtgcaaattgctgtacttgctgcagcacggggagaccattggcaagacggaggccaccgacacattttttgccatcaccaaactgtggcaggccaaggacatgacgctgcgcatgttggtctacttgtccatcaaagagttgtgccaaatgtccagcgatgtgatcattgtgaccagcaggtttcctgttcattgtttcaatattttatttcttttcatttacacaacaaatctttctgaaaaattgacattttttttacaaatttttcaaaactccgggcgggcttttgatttacaaaatttcaacagcttggtacttttccgttttgggcctatacctcaaaatttcaaaaattcttaacaaagggcggctgaagtgacaatttttataccatccctattgcattaattagcgtagcgataaaggacctcctttttcggtttggtgcataaattattggatgtgaaagttatgccaaaacggaacatttttccgtaaagtttacaattgaatttgatgatgaccgtgtccagatacctatttgcgcttttgtcaaaaatcaggttcaaatctgagttttttctattcctgatcgcctaaacagcattatataaatgatagaaattgattgtatccaataatttgataataataaaatttttgaaaaaatcgtcaattattcaaacaaacaaaattaatgctactataaaccataagacgagattttaatgccgataggatatttgggatttaaaaaatacgcgcaaatgtcccgtacgcaaatgggggatagccgaagatgaccccctttcccctttagactgactctggacatgaccggccgtgaggacgtgtaccgagcgcccgcaatccgcgcgctttgccgtat

SEQ ID NO: 64057 - DNA, 354 bp, Heterodera glycines
  Genomic contig location: Contig_ID=SeqID_34212; Location=219..572; Strand=+
  SCN-specific regions: Sequence locations=1-354
atgccaaattgggggacgattcagtggaaggataaaaagacggacaaattgagcaaagtcaactttatgcttgacggagattccattgggtgagtggcatcagcttttgctttttaacaatcaaatttaaattgcacttcattcaggccattgtcgccaccaaagacggaccaaatgaatgaaaaaagtcaaccggaaatgaaccccgggctcagcagacagaggaaaaaagtgaatgaattgttgagaaatgaaaaatgatcgatcattatgaatggaaattgatctgatgattgcttctttcgtttgaaaatagagttcgaagttgtatgcactaaaaaatccaaatatgca

SEQ ID NO: 64058 - DNA, 49 bp, Heterodera glycines; identical to SEQ ID NO: 51181
  Genomic contig location: Contig_ID=SeqID_34213; Location=563..611; Strand=-
  SCN-specific regions: Sequence locations=1-49

SEQ ID NO: 64059 - DNA, 661 bp, Heterodera glycines
  Genomic contig location: Contig_ID=SeqID_34213; Location=375..1035; Strand=+
  SCN-specific regions: Sequence locations=1-432,454-661
gttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttt

SEQ ID NO: 64060 - DNA, 475 bp, Heterodera glycines
  Genomic contig location: Contig_ID=SeqID_34216; Location=1..475; Strand=+
  SCN-specific regions: Sequence locations=376-475
  Gene Ontology: Biological process=DNA repair
cgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaaccacaacaacggaggaaccgacaacctctacaacggaggaaccgacaaccacaacaacggaggaaccgacaaccacaacaacggaggaaccgacaatcacaacaacggaggaaccgacaaccacaacaacggaggaaccgacaaccacaacaacgga

SEQ ID NO: 64061 - DNA, 243 bp, Heterodera glycines
  Genomic contig location: Contig_ID=SeqID_34218; Location=500..742; Strand=-
  SCN-specific regions: Sequence locations=1-84,123-243
atgccaacaaataatatgtttttcatcggtttattttcttttttcattatgctgctaacaatatttgatgcccatggtaatttgtttatattttagtttttaaaaataaatattatttaattccaatttatttctattttagttagaagtgatcatgttggcacaaatgtatggcaaaaagatgacccatctgccgatcaaatgccaataaagaagcatcagaaacacaatgaacgaaaacaa

SEQ ID NO: 64062 - DNA, 463 bp, Heterodera glycines
  Genomic contig location: Contig_ID=SeqID_34220; Location=1..463; Strand=+
  SCN-specific regions: Sequence locations=1-74,107-115,159-463
gcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 64063 - DNA, 397 bp, Heterodera glycines
  Genomic contig location: Contig_ID=SeqID_34221; Location=197..593; Strand=+
  SCN-specific regions: Sequence locations=1-215,237-266,293-374
atgcgaaaattagaaatttgtagtcgttctgtgccaaaaaatgacattaccatttttgcgtcaaatcttcaaaaaataatggtacaattagggtccgggggtgtcaattaggcgtcgccggtaaaatctaaaaatttgccccttatttaaaccatctgcccttagattattccattcggtgctagtgcgtttcctaaaaagtgccacccatgcgcgtttcctaaaagtgctattttaatagaatacctataaataaatgcaaatacaatttaattatttatttaaaaattttcattatagcatgaaataatccaacaaatgatgaatttttcattgttcattaaaattatcaccaaaaatatgcactgtccagcataaaatattttaaatataaaaa

SEQ ID NO: 64064 - DNA, 6770 bp, Heterodera glycines
  Genomic contig location: Contig_ID=SeqID_921; Location=86..6855; Strand=+
  SCN-specific regions: Sequence locations=1-1752,1774-1962,1984 -2359,2432-2889,2911-3026,3050-3221,3243-4103,4126-5801,5823 -6168,6248-6429,6451-6728,6750-6770
aaaagtggatgagttcatccagggtggcagtgttgtcatacacccggtccctgccactgcggttgaggacagactgttctgtttccgctgcaacgtcccatcaataattgctgatgaagactccccgaggggaaggataatggcagtcctactgggccgtccagccatggagggcattcgtatggagaaggaaagcgttgatgactcaacggattcgtggatggaagaagagggaccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactcaaatcccgggttccggattgtggtgatggcttgtgccaacattccagttgcaaagctggtacaagaggcggaaggcacatgtgctgaaaaggatttggatggagcacgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgcagacgttttgctcttgatgaaagcactcaagctcagtgggcagtggtggttcacttggttgcgcggatgcccaagctcaaggcattgcttttgacgggcgatcgtcatcagctcggagtgcatctgcaagaactgcctgacatcttccactcaggatatggattggaaagcgtcatcctacaagccgaggcttcggttgggacgaactacactttcctcacaaagatgtacagaagccatccatttttggcaaagctcatcagctatgcctcatatgagttgcacaatgaacaactcattccagcaagaagtgctgaagaacgctcactcattacgggctcaggctttcttatgccagttcaagaatgtcctgtgggacttatcaatgctttttcatcattccgtgtggacccaaaaagcgactcgctcacagatgaccatcaaacagaagtggcatcgttcttggtacaagcacttttggaacattttggcaacgctttttcgtccagaattattgttctgtgtatgtacacgtaccaaacttcggaaattgaacgaaagctgaagcactgcggtgttcgtgcactcacagttgatgcctatcaggcacaggagtgcgacattcccaaagttatttttgatcagtcccaccctgaagggcacacaaatggcacatttcggtcaatcagtaccatccatttttctgatcaaatggtgcccattctcttttgatcagtgccatttccccatggcacctattatctgttgatcagtgccattccccaattttttttttgatcattaggcacacattatcttttgatcagtgccattccccaatttttctttgatcattaggcacacattctcctttgatcagtgccattctccttttaatcaattggcacacatttttttctgatcaatgcctttccccttttgatcaattggcacatattatcttttgatcatgccattcccccatttctttttgatcatttggcacacactctcttttgatcagtgccattccctcatttctttttgatcatttggcacacattctcttttgatcagtgccattccctcatttcttattgatcatttggcacacattctcttttgatcatgccattccctcatttcttattgatcatttggcacacattctcttttgatcatgccattcccccatttctttttgatcattaggcacacattctcttttgatcagtgccattccctcatttctttttgatcatttggcacacattctcttttgatcagtgccattcccccatttcttttgatcagttggcacacattatcttttgatcactgccaccctaattttcgtttgattaaatttgtccatttattttatcagcctccttttcggccatttactttgatcagtcccaccctgaggggttcatttattgcttcacatttacatgttatatttgaatgtggccactttatactttatgttgatttattaatgttaatatatttactgaatttcatatcttgattttatttcacaaattaaaaaaaaatagcaataataatcttaaataataattaaatgcacataaataaaattaaattaaaattaaatattgatactcaattaaatttaactcacgcattcgtcacatctttatacaaattaattcgaatcgcatattcgaatatgtaggggtcccattcagtatgaatccatgcatttttcatagatggctcaaatatgcccttcttacccgtgccaattatcatgcatgagtcttcgctcatgcttgcctcatctatttattcattcatgccatgtgctttcataggatcatgcattcataaactattcatctattatctaaattagcgtatctcatttagatgcgaaccaaaaatctgccttctaagcattcaaatcacgaagtttctgaccaaatagacgacaacgcattaacgagtgatgctaggtcatcaagtgttgagagccctgcggggaccatttatgaatcattcgaggcgttgagcattgatagctcaaaagtagcttcaagccccgaggggtacactaatgttggggctgaaatcgttattgaagggactgaatccaatgaaaaccctgaggggtccggatatgatgaagtgagaaacgagggtagtagcgttacgtttaaagcgatggaagtgacccttgaccaggtcgatgcagagggttttgcgaataatggctttgatgatgaggaacctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggccccaggctttcagcgtaaacttgaagttggtgactttgtggcggtttcatcatttgagtggaaccagaagctgcgatatttggctcaacatcgccaagatgccacacagtcctgcaaattttggttcaacgaaaacacgcaactgttgccaaagcaggctgatgacactggcgtggttcaactcatgtacatgaacatcggacgcaagcagatcaccggggtcgtttactggataaagaggaagatccaaagcgttccatccagcttcgttcacgcaaacatcgcgtgctgtggtctagcggtttcggcacgcataaatcggcgtcatcttgatggcatcaatccggaagacctcaagctgggctcgcttgtgacggtggttgttgccaacattccacaggactcacttgtatcaatgggatacattctgcctgatgcttcaccgtacaaattgggaacggaaagaagagccgaaacaccagaattcttcggtgcaattgcgtctgttcgtcctcatctattggagtggccaaatctgaatgcaaacatgacgcccaaggtttatccatgctccgcggagcttactaaacatcatgttgtggcgatggagcatgttgttggagcagctctccagattgagatggagcgagaggttgacatgatgattgaagcatgctttgaaggaagggctcggaagttcgatggtgctgattgtctgattgtctttggttcgagatcgaagaaagaagtgaatgagttggccaaggtctgggagccggagtcccaagtgaaggtcttcaaagaattggatgagaagcattttgctctgggagtggtcaaggatgttgaggtgctccacgcagagtacgaaaagttggaactccacatcgtcatcttcttgaacaacatccaggaaaggaagaatgtcgacatcgcaagaaaagtggatgagttcatccagggtggcagtgttgtaatacacccggtccctgccactgcggttgaggacagactgttctgtttccgctgcaacgtcccatcaataattgctgatgaagactccccgaggggaaggataatggcagttctgctcggccgtccagccatggaaggcattcgaatggagaagcaaagcgttgacgactcaacggattcgtggatggaagaagaaggaccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactccaatcccgggttccggattgtggtgatggcttgtgccaacattccagtcgcaaagctggtacaagaagcggaaggaacgtgtgctggaaatgatttggatggagcacgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgctgacgttttgctctttgatgaaagcactcaagctcagtgggcagtggtggttcacttggttgcgcggatgcccaagctcaaggcattgcttttgacgggcgatcgtcatcagctcggagtgcatcttcaagaactacctgacatcttccactcaggatatggattggaaagcgtcatccttcaagcagaggcttcgatagggacgaactatacattcctcacaaagatgtacagaagccatccatttttggcaaagctcatcagctatgcctcatatgaattgcacaatgagcaactcattccagcaagaagcgctgaagaacgctcactcatcacgggctcagattttcttctgccggttcaagaatgtcctgtgggactaattaatgctttctcatcatttcgtgtggacccaaaaagcgattcgctcacagatgaccatcaaacagaagtggcatcgttcttggtacaagcacttttggaacattttggcaacgctttttcgtccagaattattgttctgtgtatgtacacgtaccaaacttcggaaattgaacgaaagctgaagcactgcggtgttcgtgcactcacagttgatgcctatcaggcacaggagtgcgacattcccaaagttatttttgatcagtcccaccctgaagggcacacaaatggcacatttcggtcaatcagtaccatccatttttctgatcaaatggtgcccattctcttttgatcagtgccatttccccatggcacctattatctgttgatcagtgccattccctcatttcttattgatcatttggcacacattctcttttgatcatgccattccctcatttcttattgatcatttggcacacattctcttttgatcatgccattcccccatttctttttgatcattaggcacacattctcttttgatcagtgccattccctcatttctttttgatcatttggcacacattctcttttgatcagtgccattcccccatttcttttgatcagttggcacacattatcttttgatcactgccaccctaattttcgtttgattaaatttgtccatttattttatcagcctccttttcggccatttactttgatcagtcccaccctgaggggttcatttattgcttcacatttacatgttatatttgaatgtggccactttatactttatgttgatttattaatgttaatatatttactgaatttcatatcttgattttatttcacaaattaaaaaaaaatagcaataataatcttaaataataattaaatgcacataaataaaataaaattaaaattaaatattgatactcaattaaatttaactcacgcattcgtcacatctttatacaaattaattcgaatcgcatattcgaatatgtaggggtcccattcagtatgaatccatgcatttttcatagatggctcaaatatgcccttcttacccgtgccaattatcatgcatgagtcttcgctcatgcttgcctcatctatgtattcattcatgccatgtgctttcataggatcatgcattcataaactattcatctattatctaaattagcgtatctcatttagatgcgaaccaaaaatctgccttctaagcattcaaatcacgaagtttctgaccaaatagacgacaacgcattaacgagtgatgctaggtcatcaagtgttgagagccctgcggggaccatttatgaatcattcgaggcgttgagcattgatagctcaaaagtagcttcaagccccgaggggtatactaatgttggggctgaaatcgttattgaagggactgaatccaatgaaaaccctgaggggtcctga

SEQ ID NO: 64065 - DNA, 362 bp, Heterodera glycines
  Genomic contig location: Contig_ID=SeqID_921; Location=2307..2668; Strand=-
  SCN-specific regions: Sequence locations=1-152,225-362
atgagcgaagactcatgcatgataattggcacgggtaagaagggcatatttgagccatctatgaaaaatgcatggattcatactgaatgggacccctacatattcgaatatgcgattcgaattaatttgtataaagatgtgacgaatgcgtgagttaaatttaattgagtatcaatatttaattttaatttaattttatttatgtgcatttaattattatttaagattattattgctatttttttttaatttgtgaaataaaatcaagatatgaaattcagtaaatatattaacattaataaatcaacataaagtataaagtggccacattcaaatataacatgtaaatgtgaagcaataaa

SEQ ID NO: 64066 - DNA, 406 bp, Heterodera glycines
  Genomic contig location: Contig_ID=SeqID_7182; Location=872..1277; Strand=-
  SCN-specific regions: Sequence locations=1-275,311-406
atgctccaaaacggccttaccattctgcttctgatcagtgttgtgatcggtcattccttggccaagcttggcccaaccatcaaacataatcctcattttaaaaccgtacaaactgcgcatcatttgcatgatgccattgcgaagaagcacaaggcgagcaattgggcgaggggggaattttgagtgaaaattcatttcgaaataattaaggccgaagttacgcaagtcatttgctccattagcaacgaacaggtgacagacaaaattcaaatttcaaatttaacattttaatttaaaattcataaattaagcgtcaagcattggctttggagttcaaaaaacaattcggcactgatctgattgccatgctgaaaaaggagttcaaaagcgactttgaagaactgat

SEQ ID NO: 64067 - DNA, 56 bp, Heterodera glycines; identical to SEQ ID NO: 52733
  Genomic contig location: Contig_ID=SeqID_34223; Location=284..339; Strand=+
  SCN-specific regions: Sequence locations=1-56

SEQ ID NO: 64068 - DNA, 170 bp, Heterodera glycines
  Genomic contig location: Contig_ID=SeqID_34223; Location=756..925; Strand=+
  SCN-specific regions: Sequence locations=1-170
ccaacgcagaattaaagtacaggctatagggaagctattccggaaggattcggtctccccataaatctgggcgcatcggttcggggggactgccccgaaaacaaaaaaatcgattttttcaagtgtccctctggggaatcaaacaattatggggagcaaaaatccaacgc

SEQ ID NO: 64069 - DNA, 665 bp, Heterodera glycines
  Genomic contig location: Contig_ID=SeqID_34227; Location=113..777; Strand=-
  SCN-specific regions: Sequence locations=1-314,346-534,577-665
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaa

SEQ ID NO: 64070 - DNA, 1008 bp, Heterodera glycines
  Genomic contig location: Contig_ID=SeqID_34227; Location=785..1792; Strand=+
  SCN-specific regions: Sequence locations=1-60,82-223,245-1008
tgaaaaaaatatttatgaaacaaaaaaatcgattttttcaagtgtccgtttggggtactcaaacatttatggggagcaaaaatccaacgcagaattaaagtacaggctatagggaagctactcccgaagattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccattaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaagaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 64071 - DNA, 464 bp, Heterodera glycines
  Genomic contig location: Contig_ID=SeqID_7183; Location=694..1157; Strand=+
  SCN-specific regions: Sequence locations=1-167,190-378,401-464
atgctaattgcttatatccccaaacgaattcatctcaatttgaatgtggtcggtgctgcacttcgtcagcgtatgccgttttctgcggctgtgcttgaccctcacgatcagctgaaagattcagacaagccgatgtcggagcagatgaacccttcattctttaaggtattcattttggctatgaccatgcttttattattcggttcctaaaaagatggtcgattactacttcgacaaaggcgctgctgtcattgagccgaaattggttgagaacttcaaagcttcgcatgggaaatcgaaagaagagagggtcagctctgtcaaagggattcttgcggcgattaaacccgttaacaaggtttaaacttgcggttgctctatattaaatttttaatttaaaggttctttacgtgaccttcccgcttcgacgcgatgacggatcttatggtctcaatttatgatta

SEQ ID NO: 64072 - DNA, 856 bp, Heterodera glycines
  Genomic contig location: Contig_ID=SeqID_7184; Location=370..1225; Strand=+
  SCN-specific regions: Sequence locations=1-193,216-576,600-856
  Gene Ontology: Cellular component=mitochondrion; Biological process =glutamate catabolism
atgagcgtgactccaactaccatcttttgggttggttgctcaaaatacattttgtactagtagtttatttgttgtctgctgtttaagagtcggtgcagaagtcactcgagcgcaccttcgaccgtgccgttccggtggatcccagcgaggagttccaattgcgcattgccggtgccagcgagaaggacattgtccattctgtaggagaatgatggcttcattcgctaattcaatcaacctaaactaatttcagggccttgagtacacgatgaaccgttcggccaagcaaatcattgccaccacgaacaaatacaacttgggcttagacttgcgtactgctgcctatgccaacgccatcgaaaagatttaccaaacctatgagacgtctggctttaccttcgcttaatcgatttttcgacgcattcgtaatgtagttaattctcgggtttttgaacgcgtatcatttagtgtttgtcagatcacagttctattgtattcgattttatccgacaaacctcattcccgtaatttttttgtcttaatcatcgttaattttttcgatttgtctcccgtttttgtctgtgaaccttttccccatctacgagtacaaatagtgataaaaaattaaaaccaaaatgagagatgaaccaattggtgtagatattaataacttcgtgatcgaaaaagggggaacaaagcacagtatgccacttttaccccaaagaatccattctttaaaaaaaattcaatttttttttcgaattagggtccgggtttcagaatttggcaaacccaagttcagatccatcataatcagtatcttcgaaaacccctaaaaactgattttgagcacaaa

SEQ ID NO: 64073 - DNA, 2047 bp, Heterodera glycines
  Genomic contig location: Contig_ID=SeqID_7184; Location=1331..3377; Strand=-
  SCN-specific regions: Sequence locations=1-141,172-240,263-283,306 -341,364-607,629-2047
atggctcagtcacagaatggtggtgtcaaaaaccgtcggatttcacttggttcgcctaaggacctgaaggaagtgcacttttttgaggaagatgaagtccccgatgtgccgttaaatggtgcaagagtcaaagtaatttcattttaagaattatttattggtttatccacttgattttaggtttgctatgccggagtttgtctaactgacaaagaaatcagtaacacgaaacaagtgatttgtagttgtaaattaaaaagaaaagtttttgtcgtgagggaatttaaacaatcagaaaattttaaggcacgtataactcacggcgttaaggacaccagtctttttccaggttaatttaattgagtattgtgcccattcatattaattattcgtctttaaatgcaggctacgaagtttccggagtgatcgatgagtttgggcccaatgcaactccggttgagtacaatttgaaagtcggcgacaaagtcattgtatggcccactgaagaggtacttctctcaagtgcaaatttattcatcaacaatcgttgctcattcagatgtgccaaaatggctatgctgactttgtggcagtgccaaatttgtcgcttcttgtcaagattcccgacactttgtcaatgcatgtcgcgtcgattcttccggccggcgcaacttgggcactctctgcgattgtccatgtgcctttgattccctccgactttctttcagtgtcctcccccttttaggcccgtcctgtcgttgaggccatcgccagcacaaaaggatgttgcaacattttaattgttggcgctggtggacttggactttggattctgacattggccaaacattttcttaccgcgggtcaggagaaccgaatcaaactgattgttgctgactctaaggaggagagactttgcctggcagaacgtaatggagcagactttgtggtgcattgggacgattcaggtcaacttcgggccgttttaccacttaggttaaatctcaaaataccattaacttttaactttgggttttccatgcaacaattcccctaatgcaaccggattggtttctttaaccccattaataattttctgtgctttttaagaataattagcttaaaaaattactactaaagtgtggtccgtgctatttcattttgtcaaaataatgcgttacaaatttggacattgtttcagagtttgaggaatatttaatcatgcggaccaaagacgtcgctaccaatggccttcacattgtgttcgatttcgtcacttcccctcgtacagtcgcccgttcactcaagtgcctttctgaagtttgtatggcaaacaaaaatgattgttaagaacgtaaatttaatttggtccgtttgcttaagggtggtgtccttttcgttggcggtattccgggtttggacgttcagctgccaatcaaattagtggccaaaaaccgtttggccattatgggcgttacgcgtggttccattgagcaactgaagaacctggtcacattgctttcagagggacagctcaatgcccccaattatcgcgtttatccggtggaccaggcatcacaagtcgctgaatggattaaacgccccctaaataaatgaagttttaaggtgttgaagcaattgagcatgtccgaggttgaaggccgagccattttggaggtgtttaatccggacacagaagttaagaaggccgaggaagagcagaaataaacggattgtgataaaccgagtggaggagcctttccctcacctgtgcacttttatattatttgtgacctttcctttctagtgattcatattggagaaggcacagttctatttaatcccggcggacgaaatttgcacagatgtaattaaggataaattttcaagcgtctcactgtcttctcacctcccccttatagtcaattataatacacatcgacttaattttgggctttggcatattggtttttgtaagatagtagagggcttgagattcgagcccgctccacgacattaatatattaaatttcgtctaaaaaataaa

SEQ ID NO: 64074 - DNA, 2088 bp, Heterodera glycines
  Genomic contig location: Contig_ID=SeqID_7185; Location=563..2650; Strand=+
  SCN-specific regions: Sequence locations=1-330,353-780,803-1831,1853 -2088
  Gene Ontology: Mol. function=transcription co-repressor activity; Biological process=ubiquitin cycle
atgagaccaccgaatgtgagttgactaaatggtaatacctagtacgatatccccccatttttagacaaataaatgaaaccgattaaattttcgactctgttcgagttcgggtctgggtttcggaatggatatctttcgtgatcaaagaccctgtggaaacatttttcatgaaacttgaaaactaaaatattttcaagaaaaggggtagcaaaccttagtattgccgataaacaaataatactttattaataaaaagttttcagtttgatcatgacctcacttctttgattagacgtgcaaaaatgaaatttgagtctcgcgcgaaagaggacttactgaatgcactgaacaatttcactgatcttcaaccggacgttgtgaattttacttttccagacggagtgcccagatggtgcctttctttttcgggcactattcccattcaatacaaggtaaagtgttccaattaattttctctcatggaatgacaccctaagggcgctcgatacaacattcccgtggcactttactttttggaaagccatccaaacgtgggcccgttctgttacgtgaagcccacttcatgtatgcgaattcggccatctaaagttgtggacgattctggtcgtatttatttgccatatcttacggaatggcgatatccaaaccatgacactaccggattgcttcaggtttcaatgtttctcaagttcaatcgtttgaattccccttttcaggttattacgattgaattccaagagaaatgtccggtatattctgtgagcaacaattctaaaaacacgggtcattcaaacaatccatatccacactcgggatccatgacgaacttgccctacccaaactcggcccttccctacccaaccgccgatccgccctcgcacataatgccacagccatcctcctacactccgatgccgcaaccgggtgttttaagagttaaccagcagatggatatctttgttttcattgtatcggtacaggaaattatcaggctccatattcaaattcatacccatcggaccccatttcttacccaactcctgccacaaatgtgacggcacaatccgatggagtgtatccctatggaaccgggactatccaaccaacccacattcatgccagtttgcttagtgcggtcgaggatcgaattcgacaacgacttcgagacaaaattggtcagttttgtctataaatttgtatttggactgtcttatcccctattttaggcactccgtttgctgagttgcaatccatcgatgtgaacctgcaagaattgcgtgtagggaaacaaaacttgcgcgatatgctcgacaacattgccagagaccaacgcgaattggagcgggttttagacatttatacggtgcatttaaattagttttttttatttgttgtcgttgtttcaggataaaaaggaagagctcgaaagtgcgttgaaagtggtcgattcaaatggcactacggacaacggagttgcatttaacgaggaacaggcgatcgatgcacaaacgcccgtccatcgacaaatactcaaatgccatgtgcaagacagtgccattgacgacaccatttaccacttgggccaggctttgcaccaaggggccgtcaatttgcagacctatctgaaatatgttcgccagctgtccaaacaacagttccaacatcgtctgttgatgtacaaatgccgggacagatcgcgtttgactatttagtggaaatacaaaaaaatgtgcacactcctcacttgaccatcattgcttaacgcaaatatgcaaattgaacgcattctttttctgtttattcggtagagggaaaataacgaaactcattttaagctgtaaatattgatgggttattcggattaatattatttgagtatgaaaatgttaaatacggtaatggttagagcccggacataaactgaactttctttcgtcctaaggttcttgtttttgcccgggcttacatttatttcttagccattattttagaggaattcgttcgtttaattaaaattttaaacccctttgatgaaacttcgtccttttcattgggtttgcttgatca

SEQ ID NO: 64075 - DNA, 49 bp, Heterodera glycines; identical to SEQ ID NO: 51181
  Genomic contig location: Contig_ID=SeqID_34234; Location=509..557; Strand=-
  SCN-specific regions: Sequence locations=1-49

SEQ ID NO: 64076 - DNA, 306 bp, Heterodera glycines
  Genomic contig location: Contig_ID=SeqID_34235; Location=290..595; Strand=+
  SCN-specific regions: Sequence locations=1-89,111-208,239-306
atgcatacattcgcaacacaacccaccacccataattggatgcattttgttaggtttgtgtcgtgcccggctccgggtttggccagcgtcctggcactttccatttccgcaccaccattttgccgcccattgacattttcgaggacatgctcaaccgtttcggcgccttccacaaacgctttttggccaagtaaatagacgataggcgaaattttttttatttctaatttaaaattttcaggtacaaataatatcttcgatgtgtgcctcccatatgtgtttgtaattattatgaatgatggatga

SEQ ID NO: 64077 - DNA, 360 bp, Heterodera glycines
  Genomic contig location: Contig_ID=SeqID_34237; Location=1..360; Strand=-
  SCN-specific regions: Sequence locations=1-192,216-360
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaa

SEQ ID NO: 64078 - DNA, 898 bp, Heterodera glycines
  Genomic contig location: Contig_ID=SeqID_34238; Location=147..1044; Strand=-
  SCN-specific regions: Sequence locations=1-898
  Gene Ontology: Biological process=growth
agttcatggtcggacggactgctgatcaattttaccatcggaacgcatcggggcaatgagccgattgatcgctgtgagctttggaagcagctgatcagctcgttgcatcgctctaatgggtaaatcagctgctgatgggggaaggaaattttaactgattggaacaaaaaacgaaagctaattcaagaatgtgccattcgcgaaaaattatttcatcgagccgggagggaccaagaatcccttggacaaattcgagactcggtaataagatcaagaaatttccttttcgcataaccgaactctgtaggaccgggagtgattgatgaaccatttgatcccgtcagatcaattggcaacggtcgtctgagtgtggcatccgatgttgggctgttggacccatgcgcgaagccggcgccgccgggcgaacagtgcaacggtgccgtgtgcaaacagtcacttggcgaggtgagtgcagaaaaggggggaacagctgctgatcacgttgattacaaatgccacataacattaattgattagtttgatcgaacattctgattagaatcaacaaatcatttttcggcatttgtgccaactctgcgcaaaatgagtgaagaattgccatgaaatgcaaaatgatgccatttatgatcggctccttaaaaaaggtttgcattggcggtgagctgtgcggctgtccgacgagccaaaagcgcgccagcgcggacgaccaatgccggctggttgagtccttcaccattccgttgtgggtgctgcgcagaggcgtacacaatctggtgttcaattcgacctttgcgaatccaattgatcagctgaacaaggagtacgtgcgccagttcagcaccggtgttgcccaatgctacccgcacaccgcgctcag

SEQ ID NO: 64079 - DNA, 714 bp, Heterodera glycines
  Genomic contig location: Contig_ID=SeqID_34239; Location=15..728; Strand=+
  SCN-specific regions: Sequence locations=1-45,67-447,469-714
atgttcgtcgatgctcttccggcctcaattgtcagtctaaatcttacttcaaatcgtcttgttcggctgacaaaccgaatttgtcgactccagcaactcggcacacttcggctggaccacaaccttttcgaggaactgcccgaggatgtgagtatacaggggaaaaacgggagaaccctaatttgtaggactttctttgctcttcgcaccgatttttgcttgtaatttcataacagattttcaccaaaaaatgccaaatttttgcaattttgagcatttgacgaccatgaaaagttcgcccgttttccccctcgtttttggactgttttgggtcctcgaagttaaaaaagacgttttcaaaaaaaaatttccagctctgtctgatcaactcgttgtgtcatttgtcgctggtcgggctcaatcggctccaatttcttcccccgtctctttgtgttgtcaaatttactgcaccacgcttcattttgttggacatttctggcaatgaacatgcgccgttcatcaccgggcacggcacggctcacaatcaacattctgttcacaatgctgccaccacctcttcgacagttgtttctgttactgctccgccggcactttgtgaatttgctgctgccgcagtgcttaacaataagtgagaaaaatgggagcgggcaacgacgggtgtacttcatttccccccttgtcgtgccccgaaaa

SEQ ID NO: 64080 - DNA, 2160 bp, Heterodera glycines
  Genomic contig location: Contig_ID=SeqID_7186; Location=446..2605; Strand=-
  SCN-specific regions: Sequence locations=1-129,152-1581,1605-2160
  Gene Ontology: Mol. function=RNA helicase activity; Cellular component=cytoplasm; Biological process=pole plasm RNA localization
atgggacgactcatcttccgaatgacagaattgttggagcatattcagaggctaatccgaacggtatacatagtttattacatgttctaatttctgcttttttagaaggaactatcatcgatttttccgactctcagccatttcagcagccgcccattgtcaacgtgccgacgaggggaattttgcgtaattgcaacggcattgacgcagcatcggatgtgcagaaagcaaatggaactgccaccaatgaaggcgaacatcagcttcccatcgccgatcagtctgtgccatttggaggcgcttctgtgccgcgtgtcgcttccgtcactgggcgagggacgcgaggagtgcgcggcggattgggaagagggggttcgttttcagtgctaaacactcataatttggtggttagcaccagcacaaaacaacaacatcagtcgtccaccagtgaatgcggagatttcgccacccaaatcggtcaccttcgactcgacgaccgttttcaacggtagcagggcgagaggaggcggaggaacgacgagtcgtggttttggaagaggggccaatgcagttggtcggttatttaagtgtggttatttggatttttttcaatttcatcccacagaactcggaccaggagaccgtcgcggttttggacatggtgcccatgcagttggtctgtcattcccgtaaatttgagagtaattgtggtcatttttattctaatagaactcaattcttcgaatgatccgccgagcattggcactattttgcgtggtggtggacggggccgtggtcgtggcatgaactccgaaggtttttcccccgttcttttgtattatttatcctaatttcgaggtcaaaatggtggtttgggcaatgcccggccaaatgccgaaaacaacggacgcggaagagagaattacggtgaccgtaggggcggtggtcgcggaagcgaaggagacggcggagaacgtttcgggcgcggcagaggcggaagaggacgacccgaatttggcgaaagaccgtcgaatcacagtcagcgaggaccatccgcaacaaatggcggagacgaacgctttccacgggatggtaacgaacggagtgaaagcatttatgacgagctaaaaagcaaaatttagagccaaggtcgagtcggccaagacacatttacaagaaaagaccgatcgaatgcctttacgaagaggactgtctcgtcagtgaacgctacgtggacatccgtgacgaagacgaagacttagttgtcagtggagacaatgttgaaaagttcacagcgtatgagtaagcgattcatccgataatggaagttgaatttcctctgtattaaggacttggaaggactttgatctggagccaaagctactcgacaacataaatcggtgcaaatacgtggtacctcgcaagatccaatcgtacacttttccgctgataagagacggtgcgacacatttcgccaatgtttttacgctattttaaaaactttgtttaggcttcgacgtgaaggcacacgcggagacgagcagcgggaaaagtgccgcatttttcctgccaatcatcgacaaaattatgaaactgaaaaaggaaggcactttcaagtcgagacgggactgtccgtacgccctcattttgtcgccgacccgtgagctggcaatccaagtgtacgaacaagggcggaaattgtgcaatggtgggcaccgtcgttccgttcgatgcctttaatcggttttttctgtttaggttgcgatgtatctatttcattggcttacggtgaaacagtgagacacgaaaacattcgcaacatttccatcgatggctgcgatattctcgtcggcacgccgggccgtacttgcgattttttccagtccaaaaatgtcagaaaattgcttgtttcttcgaaataattcgtctactccttccttttagctcatgttcgaccttttgaaggtgttcgttcttgacgaagctgacaaactgttggacgaaagtttcattttggatatgcgtgtacttggcagtatgccaaattggcctacggtatttcatcatggaatccaggtccaggcatttcgatgggaaccgcccacttcggcgccggccttttcggcgccgttgctaacaacttttttcctgatcaaccaa

SEQ ID NO: 64081 - DNA, 1844 bp, Heterodera glycines
  Genomic contig location: Contig_ID=SeqID_7186; Location=3367..5210; Strand=+
  SCN-specific regions: Sequence locations=1-484,513-607,635-688,710 -763,786-981,1003-1844
atgtacgggcagccaggggccggtgcagcggtgtattcgtcgtttcagcaacaggtcggagcccacaaaattccgctgtcgaaactccgccggacgaaactgaatcaaagtattcaaaaatttttcaaaaaaattcgttggtggaaaactgaatttttttcaaaagttttctaaggttttttcttggaaataagtgaaaattttttgtctcggtggagtttcgtcggcggagtgcgttttgggggtaccggcaacaggtgtatggagaatggtagaacgatgctgaccccttaccgaaaaatttatctgtttttttgtccacaatgtgttaggcatattgtctaccacatttttttccctaatgtgtcaattttcatcggttggttttcagcacgccgaagttgtcgatcagcagtgctaccaacaacagtccgctgcttctgtgggttacggtccgtcgatgccgggcgcctccgcgtcagtccctcttgaacaacagcagcaggcatcacaaaagggtgccgtcacttcgtcggcggcaaaaccgctgccccaacaacactttgtgcccccgccgccctccttttacacggccggcaaccgttcgtccaacgccgccgccgccgcactgcttggcgttgtgccatcgcctccgatgcttccgccgtcggtcggcggctcggcggtggttggcccaccgccgcccaccgcttacgcgacacagcagcaacagtcgatcaatgccgtcacttcgtcatcggcaaaactgctgccccagcagcccccgcagcctttttacgcggccggcaactattcgtccaaagccgccgccgcttcaatgtttggcgttatgccacgacctccgatgctttgcccgtggggcggcggctcagcggtgattggcccaccgttgcccgctgcttacgcggcacaacagcaacagccgatcgaccccatgccgtcatcgtcgtcatggaattttggccaacagcagcaataccaatttgcggcagatctatcacaccaacaccacaaagtaaaaaacttcggtttgagagaggaggtggtggatgggtagccccaatcaaagaatattttagatgtcgtccacttcatcaacggcagatttgcaccaaaagctgttcgttccgactgccgaagatctttctgacagcatgatatacccatttgatgtgacgcatttgttctgcagagaaaaaacttcggagattttggacccccaggttagcaaatacctaatcattaagagaggagggggtatatgggtagcaccactcaaggaatattaatattttagatggcgggccccacttcatcaacggcagatttgaacccaacgttgttcgttccgactgccaaagttttggaccccgaattggttagcaaataatcattaatttgaattagggaagttacttagacacaggagggcattagttttgcatattcaaaaatgaagcctcttaatttttgtgagtgaaattatggatgacttataaaactgtatcaaaattaaatggttgtggtactcatttgggtggtgcagaagatgacccatattgattttgttcaacaaaagtaatggtcattttcgatttgcatctctttatatcatggaaatgttttctctaaattcgcttttttccttcccaatctccgctcttttcggttttagaatgtattaccctaaaatgattaggcttccgtctgaacttatttccgaattggcgagtgctcttccccttgacccccgctgggccgtcatccgtgtgtcctcggcctttgattttttcgtttatacaaaacagataatttataggaaa

SEQ ID NO: 64082 - DNA, 364 bp, Heterodera glycines
  Genomic contig location: Contig_ID=SeqID_34244; Location=37..400; Strand=-
  SCN-specific regions: Sequence locations=1-364
atggccgccgaatcgcaatacgtaacatttaatcattcaaaaacacatttttaaaatatcccaaattttttagccaattccttaccgaagcaaactcaccgaaccttttgagccgggacaaacgctaattgttaaaggaaaaacagcggaagactcagtccggtgggaaattaattggcttttacaaaaaataattaggcttaattcaatatactaaaagaattattttatcccccccccacccctcataactcaaaagtttaaatcgctttccagtttcaccattaatctccaccatacgtcggccgacttcagtggtaacgatgttcccctgcacatttctgtgcgatttgatgaaggaaag

SEQ ID NO: 64083 - DNA, 740 bp, Heterodera glycines
  Genomic contig location: Contig_ID=SeqID_34249; Location=118..857; Strand=-
  SCN-specific regions: Sequence locations=1-215,237-262,334-335,541 -678,700-740
atgcttttccaacgacaaaaattgccaaaaatttgtgccactcttttcccaaaatgccaaattcggcgatcgtccaactttgtcgagttggcaggcttcactgcctccactgactccaagcagtacgcggctaaaaaactgttgttgctcaaaaacggcagctcccgaagttacaacgacgtgaacgtggcagccggacgttttgcggcattgctcaacaaaaagtacggcattcaggtgggagagaagaagacaaaatgcgaaatattaatttaaaaaatcaaaaaatatttattttagcaaaataaattttacaaaaatattatttaattaccaaaaaataaataaacaaaaaataattttcattaaatgaattaataaattgattaattcaaacattattttaagtaaataaatacattcatttggatataaatatttaaataaatttggtgttaatcaacctttttacattttaattaaaataatcaattaaattaaattttaattaataaaatttattatttttatttaaattaaatatcaaagatataattaatttttttctttttcaaattcagaagggtgacactgtgttatgtcgaacttcaaaaactgttgacgcgttggcactttatttggctgtccttcggcttggtgccatttacgtgccgcttaatcccacttacacaaaacgggaaacagagcattttgtgaacgtaaaaatttgctaaaataaa

SEQ ID NO: 64084 - DNA, 1048 bp, Heterodera glycines
  Genomic contig location: Contig_ID=SeqID_7187; Location=301..1348; Strand=+
  SCN-specific regions: Sequence locations=1-139,174-311,333-771,793 -1048
atggctaaaagaactttattacggaagcgacagaccaaaaatgcacgccatacgcgtgagaacaagcgggaggagagaaaagcgcagacggccaaggcgatgaaagcccggtgggctaagaaaagtgagttttttcaccaaattttattttaaaaaatatctttttttaatttcagcctctccagagccgaatcccaatgccggaacgccacagcaggacgaagcagggccgtcgacatctgctgtaccggccgaagaactaatggagccgccgccaccagcaccagtgccaacgccggagatggacaaggaaattttggaatttggcttttcgctgccatcgacatctgtcacaccaatcggtgatttggtgccgttttcgacaacaccaactgcgccaatggacaccggagagacaaccccgccaccgctggccattgacgagcgatcagagcgcatcgaacaacttgagaagcagctcaaggaccgggacgacaccatcaaatttctgcgcgagcaggtgcgcaatcgagaagcgctgatcagtgatctgcgtcggcagctggacgagcacatggtaccaccgatggcaccaccaacgaccagcaaaagtgagtgaaatttttcttttttaatttcataaaatctgatcattttttcaattttagcatcaccaaacagaggaagatcgaagaaaagactggatgaactgcagcgcagcgccaggcgcgacatcgtcgaccaaattgtgggcgtcatcgatcgtgatcgctcgcgttccgcgagccgcgcatctctggaccggatccaccgagatatccggcacaaatcgcgcactacacgccaaagaagggcaaggagcggaaggaggggatggacgctgaggatgggcttttgctgctcgcccaacttggaacacagaaggcgtacaagcggatgaaggcgattttacggctaattggccgtaatttcaacgttttgccgccgttggaaaaggtgcatttttcagtgaatttttcgtttgatcaatgttttttgggtcatcgca

SEQ ID NO: 64085 - DNA, 161 bp, Heterodera glycines
  Genomic contig location: Contig_ID=SeqID_7187; Location=2119..2279; Strand=-
  SCN-specific regions: Sequence locations=1-88,110-161
acacggcgtccggaaactgagctgctgtaccaaaaaagatttgtatgtgtggcgaagtggtctgtgagaaggtcaccaaagggggggtcccaggttcgattcccagtgcatactattgatgtatttcaattattttaatgaataaataaaaggaaaagtga

SEQ ID NO: 64086 - DNA, 1483 bp, Heterodera glycines
  misc_feature (1424)..(1424): n is a, c, g, or t
  Genomic contig location: Contig_ID=SeqID_7188; Location=1329..2811; Strand=+
  SCN-specific regions: Sequence locations=1-327,349-808,851-979,1034 -1183,1225-1483
atgccggtgctgcactttctgcacaacgcggtgcccgccctgtttctgctcgtccgacttgcgctgtcgccagaacggcgtccgctggtgccgcgactgctctgtgccattgtgcgcgcaccgctccgctcgctgctttggcgacccgtcgcggcacaactgttggtcagcgcgttgtccgctcgcgtttacgtgcacaaccgggccggggcactgtatttgtgcaggtgataatgatgacacgacattaaaactacaattggaaggaagagaagcggttctactctgtatttcaagattttttggcctcgagtccagggatttgacataattttaatttaatattatcaacaattaatggtttttaaatgtcgttacttagttggatattcgtgccaatgttgataatattaaagtaattacataattagtctcggcaaagttcgaaaatttgctgcaactctcggggccactctcagacgaagccaaaaaaggccctcttttttcaaggatattcgacttcctcggcacttttctgatcattcgatttggcgcaaactttttgaacagcgcaaacactgccgggggcaacaaagaggagacgcagcgccggaggggccgcgcggccatttgggcccttttggtaacaacaaatgcacaaatgtattggcatttaacatttaattctgctcctggggcaagcttgtgcctcgagactgagtttggtggcatggcccggccctttcagaggggcacggccaggccattaatccaagaaaattcgaaaacaaattctacaaatgaacagaattaaaaatttttatgttcatttaaaaaaaaaattaaatttctttacaattattgttcactcgcctccgagaaaacaccgaaattcgtaactttaaagctttcaatgctatgttagcaagtttttgttcaaaaaatgctcgatatgattcgttgttattttttctttcattaattcaaattaataacaaaaaagagaaaaataaattattttatcaattttctctgttaactgattttttcacatattttccttcaaaaaatcgaaaaataacccgaaatatccctttgagaatttgtttttctttcaattcttgttcttcattaaattatgcctttattcatatttacaggggccacttgcgttctccgcgtcgctttcatggtgtgatttctttaaaatttcaaaactaaaaataaaattccatttcaaaggctcgaatttggcaacatcgagtgggacccgtgggctctgtttttggccccgctgctcgcacttgcccaagctgttcacattctgttgctgaagcaggcgcagttggcatttttcgctgccctcggcatgcccaacggcaacaatgtgccaattctatgggccaataactaacttggcttanataagtccagacttatccatgtcaaggacgtccttggaaatggacccacttttctgaaa

SEQ ID NO: 64087 - DNA, 56 bp, Heterodera glycines
  Genomic contig location: Contig_ID=SeqID_34253; Location=135..190; Strand=+
  SCN-specific regions: Sequence locations=1-56
actatagggaagctattcccgaaggattcggtctccccataaatctgggcgcatcg

SEQ ID NO: 64088 - DNA, 642 bp, Heterodera glycines
  Genomic contig location: Contig_ID=SeqID_34254; Location=33..674; Strand=-
  SCN-specific regions: Sequence locations=1-134,157-359,381-463,485-642
accactcttggctccggcttcccctccgacttgggcggactcggcacgggcaccggcaccaccttcgtccagccccacaactaccaattcggcaccgccacctcgggctcgttccactcgtctgacgacagtctgtcggtcagcatggactgtgccatgtttgcacccgaagaactgaaggtagataatgcattcatccgtggcattttcctagttgcgatcagagtgaaaaaatgctctgatcagtttatcttagtgatcagcaaacgtcatttgatcgagatgaggtatatagaagtgaaaaaacgaaattagtgatcagtgagtgattcgtaatcagtcatgatttaactgatcggataataattactacaaattctttctgatcgcttttctagcgatactttcaccgagtctagagatttcaaaaaaaggtcccaggctctcgagactgctttttcaaatccctttattttataaaataatctttcaaattcatgtttttatttactgatcaggcggaaatataatcaaaaaaagctgtttatcaataaaactgtcccattttcaggtgtctgttgtgggcaaccaaattgttgtggagggaaagcacggcgaaaagcaggactcacttgggtcgat

SEQ ID NO: 64089 - DNA, 421 bp, Heterodera glycines
  Genomic contig location: Contig_ID=SeqID_34254; Location=855..1275; Strand=+
  SCN-specific regions: Sequence locations=1-40,62-279,301-421
atgaatatgatcagtaagtggagattaatctcaatgactgatcaacccaattttataatgcgatcagaaacaatcagtgagttgcctttttatcgaaacttcataatccaactaattgaaattcttcctaaattgttttgatttattttattttttcaaattattttgttcaattgccttgattgtgttcagtggtgatgaggtgaacatccgcgtggtcattgtcggcgtactctcttcgatcactttgcgttcgaaagtgcttaaaaagggcagggcaattaaaaaacttaattagttaatttcaattttttaaggctcaatcggcaatcaaagtgccaaatctgtttggcactttcggagccgggccaaggccagggatttccccagccaattttccaaccgccaaagcgtcgcttaa

SEQ ID NO: 64090 - DNA, 686 bp, Heterodera glycines
  Genomic contig location: Contig_ID=SeqID_34257; Location=1..686; Strand=-
  SCN-specific regions: Sequence locations=1-128,158-469,491-605,627-662
  Gene Ontology: Mol. function=apolipoprotein E receptor activity; Cellular component=coated vesicle; Biological process=signal transduction
gcgagaaggattgtgcggccggtgatgacgagccgggccgcgaggtgtgcggcgaccggatttgccctgtgggcgagttccagtgcagcaaccacaactgcacacggccattccaactgtgcgacgggcaggacgactgtggcgatggcagtgacgagaaggactgtgacaagccatgcgatgattggatgttcaaggtgtttgttggggttagccgacatttgcggaccgacatttgcggaccactatttcagggttgaactgtctaaaaaaacaaaaaataattatttccaaaaattgcgttaccttttttaattttgatttttccaacttgaacatattttccatatttatccattttcgcgatttatttcatatttttggcatttatgcccatattttgcgattttatatccatatttttgacagccctactgatcaccttaagcaataaacatcgaaagtaataaaacaattttatttttaagaagttaagcttccattgataaatatagtatatagttgctcgttcttaatttcggatccatagttttataacagcaaattacggacaatgttagggaaaaaggtagaactattttgagtttttttttttaaatttaattgtttgtcatgactgataaaaatttaagctctaggctaccaaagcaatttatttttaattt

SEQ ID NO: 64091 - DNA, 58 bp, Heterodera glycines
  Genomic contig location: Contig_ID=SeqID_34259; Location=230..287; Strand=-
  SCN-specific regions: Sequence locations=1-58
atgcttaacagagtttggagaaatgataaagaatttgccatcaaaacacaagagaact

SEQ ID NO: 64092 - DNA, 508 bp, Heterodera glycines
  misc_feature (450)..(450): n is a, c, g, or t
  misc_feature (482)..(482): n is a, c, g, or t
  Genomic contig location: Contig_ID=SeqID_34260; Location=418..925; Strand=+
  SCN-specific regions: Sequence locations=1-221,244-249,278-508
atggcatattttgctccttttccccccatttgtcttttccatttaatttttattttccaattgctcggccccgttttctgtgctaatgtttatttgaaaaagcaatacggtgagaacgagttccgtattgagtcatggggcaaaacgaactgttcactgaacggaattgacattgtgcagcttggaattggccgaccatgtgaagaatggccagattttggtaaaaagacaattaaaaaataattagccatttataattaacaaaaaaaataaataacactttataaatgatttttaagcaaccattttctgtgatggcaaaatacttgaggtaataattaagaattattaattaattacgtttacgtaatttattaggcagtgaattattggggcgagcgaatgcttttcatgcgcgactcaaagcatttcgttgaccgtcctctgctngaagatgccaaaaaagtggtcgatgaatttanaaccatttttgatgtgacggaatgga

SEQ ID NO: 64093 - DNA, 735 bp, Heterodera glycines
  Genomic contig location: Contig_ID=SeqID_7190; Location=184..918; Strand=-
  SCN-specific regions: Sequence locations=1-138,160-569,609-735
atgtcgggttccctaagtgtcggatcccccaaaagtcgcaccacgtgtgagaaagtgagtgagaaatgagcatattgtaacggatgagaaatggcaactttggccgatcgttggtgggaaaagaaacaggaacgaaagggaaagggcaaaaagggaaaatgatgattgttattgaggggaaatgcaaattcaagcaaaaataatataatgcgcaaaaaggggaaaaaggcaattaaatgaaaaggatgaaatgaagtctaaatctttaaatcaaatcgaaaactcaaacggttttggctttaaaattgccaatggaaattgacaacagttttaattttatgattgtaattataacttttttttcttgttatctcgttatttctggggctttaactatgccgaaagcgaattacagatttgttacaacaccctaaaattttttgagtattttaattttcgaaaatttcacccctttttgacccagaaaaaaatttccgagatttgaggggttgaacaatagaaggcccgggccttcaaatagagggtttacggtatgcactttacagaccataaaaaataaaattgttttttaatcatttaaaaaatttctagggcgttttcggagttgctggtcatgaatctgacatccatttcaaccaaattcgaaccccgaacccatatccgattaaaaaaagggaataaagaaaaatgaatatttataaattgtcaattaaa

SEQ ID NO: 64094 - DNA, 577 bp, Heterodera glycines
  Genomic contig location: Contig_ID=SeqID_7190; Location=1396..1972; Strand=+
  SCN-specific regions: Sequence locations=1-231,274-279,303-577
atgtcgggatccccaaagtcgggtccccaaatgtcgggttcccaagttgcaaatccccaaaagtcgggtagccgacaagtctcacaatccattagccattttatgtgagtgtaatatttatcccgcccccatcgcacctttaggctgatcgcgcatcaggatttggatccaaattaacacattaaataaagactgttcattccggcataattacgcgcaaaaatttcaaatttaacaactttttaatttactaaatatacaaacaaaatataagtgtgcaattaaaaaataataatttcacagtttttaaatcacaatgtcaatcgaaacaattattggcagacttcaaactgctgaacatgttatttctgaatatttgaatgatgttttgcccgaaaaacctgaggcaccaaaaatgcaaaagaaaaacgtgctttgatacttttggtaaaaaatataaaagagtcttctgacgaattattagcgcaattagaagaaattcgaggggcacgttcagctcaagtcgatctgatcagagttttaacagctcaagagcgattagatgctgaaagaagaa

SEQ ID NO: 64095 - DNA, 1340 bp, Heterodera glycines
  Genomic contig location: Contig_ID=SeqID_7191; Location=606..1945; Strand=-
  SCN-specific regions: Sequence locations=1-1340
ctgctgacaataaggaactgtgcccaattggaaaaataatgacaacgaatgttaaaatttttgatcagcccgctatttcaatgatggatggcggtgcacaagtttcacttattaaggcggagtttcttaaaaatattttggaaagtcagaaattggaaggcacaaatctcaaaatttggccgaaaacccggaatgtcgttgacattaatggaaagcgtgtagagtgttatggaattattgtgttgccagttgtaagaagaggttgtgaagcagttgaaattatgttccacattacggatgcgcctgttggacatccaattttgtttggaacaaatgcacttgggctccttgggttcaaaatttttgatgctcccaacggcgaattagtggaatttgagtgtgtggacaacaagtctgattctgtgcgtgtgatttacagtactttggttgaaccatattcaacaaaatttgttgaactttcaatttcatcaccgcaatcacaaatttttcacataaagcagtaattttaaaacaaaatgaagaaattgctgcagttgaagaggtgaaggaaattgccaaagctgatgattgtcttgaagatgcatggctttatcattcggtggagatggaaaagtgtctttttgaggatgagttcaaagccgaaattggccaattggatgaggacaaacataataaactcggatcacttttgcatgtttttgcaaatatttccgcttttaatgacagcgatctaacccaaatcgaagttgtcaaacaccatattgacactgaccgttcattccccatcaaaaatcgtatgcgacctgtgccatatgcataccgagaaaaggttgcggccatgatccaagattatttgggccgtggtattattcgtccatctttatcaccatgggctagcccaattgttattgtaccgaaaaaggatggaactttgaggttttgtgtcgattaccgaggcttaaattcggtaaccagaaaggactgctttccattgccgaacattgaaagaacccttctcatgttgggtggacgaaaatatttctcaactttggattttctctcaggctatggcaaataaaaatgccggaggaatcggtcgaaaaaactgcttttgtcaccgaatttgggctccatgaatttaccgtaatgccatttggcttatgcaacgcagttgcgactttccaacggtttatgtctcagttatttggacaaatgatgaatgattttgtgtttgtctacattgatgatgtgctggtggcctcagagtcgtttgagcagcatttgaagcatttgaaattagtttttgaacaaatccgcga

SEQ ID NO: 64096 - DNA, 462 bp, Heterodera glycines
  misc_feature (277)..(277): n is a, c, g, or t
  Genomic contig location: Contig_ID=SeqID_34262; Location=419..880; Strand=+
  SCN-specific regions: Sequence locations=1-234,273-282,308-462
atgccggtttccggaccggtttggcattttcaaaatgaccggtttccgggcccggcctctcaaaaaccggtcaaaccggatttttccaaaaaaacgccggaccggtttgctgggcccggtaaaaaccggtaccgggcccggtccggtccgctctctacatttcagcgatttcttgaaattttttttgaaaaactagttcgtcaaaaaaatttataagatattttttttagaatttgttagaagaaaggctttattttaaaattgctatttcttctanatgtgtttttaaaaaaaattttttttttttgaaggtatggcttaaaaattgggcaattacttctcttatttttacacttcattttgtttcacgttgcagggtcaacgatgttcaaattcgaattgatgagctcaatttgcaatttgtgtaccgtttgggagtgatggcggacaaacattgggaat

SEQ ID NO: 64097 - DNA, 519 bp, Heterodera glycines
  Genomic contig location: Contig_ID=SeqID_34265; Location=93..611; Strand=+
  SCN-specific regions: Sequence locations=1-64,169-187,209-260,314-519
atgtttaagtgtacaatcttgatgattgagaatggaatgtaagtggaataattagaattaagtgataatttttaattcatataattttttggctttttaattttatgaattaaaaaaattgttaataaatataattaaaaaatgtaaattcaataaaaaaaaatttaagtttcggagtatttaacacattttaaatggtttaaattaaagtcttttaaagatgtaaagaatccgtcgtggtacaattttttcttgactcgtttttaattgaaaataatcaattaaattttttgaaaaaatctaattttttatacaaaagtttttaccgtccctggcgggattcccgttaataatttttttttcattttcccgttctcggaattttttttaccagactacttttatctatcagtttcattataggcacatttggagggagaaatatctgagcacagacaaatgtacatggacttggtaaacttcgctaatttaaaataattaaatggaacaaacagagca

SEQ ID NO: 64098 - DNA, 821 bp, Heterodera glycines; identical to SEQ ID NO: 34266
  Genomic contig location: Contig_ID=SeqID_34266; Location=1..821; Strand=+
  SCN-specific regions: Sequence locations=1-90,118-118,140-735,757-821
  Gene Ontology: Mol. function=1-phosphatidylinositol 4-kinase activity; Cellular component=plasma membrane; Biological process =actin filament organization

SEQ ID NO: 64099 - DNA, 821 bp, Heterodera glycines
  Genomic contig location: Contig_ID=SeqID_34267; Location=129..949; Strand=-
  SCN-specific regions: Sequence locations=1-372,394-508,530-661,688 -770,813-821
ggggactgcccgaaaacaaaaaatcgatttttcaagtgtccgttgggggtactcaaacaatatggggagtaaaatccacgcagatttagtacaggctataggaagctattcccgaaggatcggtctccccataaatctgggcgcatcggtcggggggactgcccgaaaacaaaaataatcgatttttcaagtgtccgttggggtactcaaacaattatggggagcaaaaatccacggcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 64100 - DNA, 911 bp, Heterodera glycines
  Genomic contig location: Contig_ID=SeqID_7192; Location=492..1402; Strand=-
  SCN-specific regions: Sequence locations=1-453,477-598,620-911
atgtctttagggcaagactgtatgatcatgattatggatgggaattttatgtaagaaaaatcccgaaataggtaaataaaacatgtaacaaaaaatgctaaaatatgtaccaaaatatgtaaataaaattttgtaaatggttattttttggaaataaattctcataaagggtgaaataggcataaaatgccataaaaatgacctaaaggtttaaaaacacatttactattttaaaagttaatttttagtatctcacttttgaaaaaaacgattttttgggtacttttcaaaaaaaaatttttttttcacaaaaaattctataaattctcaaaaaccctctatgtaaaaatatgtaaataaaagtcccaacttttgttcgcaaacgcaaaaaagaaagtgttttcctactattcagagcatagagaagccaggaaaaaaatatgtattgacataaattcccagccctagtcatgatcatttaatatttatgatcaaatttaaatggtacctttcttatcaactattaaaattgttatcagcaatgattagaattaaggatgacaattcctctgtagtattgctgaccaaatttgagcgaaaattatgtaaaagtaaaattattaattccatgttatagttgcgagcgatatttaactataatgaaccaattgacatataatcgagcagttttgcgcggcaagaagacagagattgattaatctctgcgcgctgcgctgtgcagaaagagagctgctggatgaatagctagctttgctgctgatgaaggacgaacaaaaaattgttaataattctttggttgggagtaattaattgattattgaagtaaatggcaagattatgccgaattcatgggcagaaaaccgggggtgggggaaaggaattgtaataaa

SEQ ID NO: 64101 - DNA, 1518 bp, Heterodera glycines
  Genomic contig location: Contig_ID=SeqID_7192; Location=2126..3643; Strand=+
  SCN-specific regions: Sequence locations=1-202,229-513,535-610,634 -1253,1275-1307,1329-1518
atgcttgtattttttattttttattttgttgcatttgcttatccttttcggcacaatttcgtttctgatcgcactgacgaatctaatgagggattaaaaggaagcggaccagctttgcgacttcgttgcggcgaaaaaatgccagataatagggtaaaacttggtccaacatagaattaatttttgtctaacgaatattaggtaattttttttattttaataatttttctgaaaaggtaatacattattaaattttaataattccaggtcgaatttggacaactttcgccgccttcggactggccatgggcaatttcggtccgttccgaatgtttgaataagcgttcaaaccgcaccgaagtactctcgacttgttccggagttctaattggttcaaaacatgtgctaacagctgctcattgtcttttaacgacaattaattcctatttgcgatgcaaaggaaatgaagtagccggggaatttgaattccctgggaccacgtgagttttacaaatttattttgcatattaatattttgctaaaacttagaaaatttaatccaaattaaatcgaatctataatcacttttgcgccgtgctttttaaaaaaattgaggaacagatgggggtacagttctagtgttaataaggtggaggctactccagcggtctaaaggcactgacgggaaaattttcacaaatttcgattaattttgataagaattggtttaaatttaattaaacttattgtatgttattagaaaatatttgacatcctgtctttaaaattttcaaaaatgcaatgcggatcccacggattcccgcacaaaaaaatctgcggatcgcgctggggatgggaatcaaaaattttttgtgggaggcggattccgcggaagtaatcacgcaaatcccatattaccataaatgcgagtttaacgctgggattgcaaaattcgcgcgtaatcccgccccgtgcaggtctttcatttattacaccgaataaaaactaaaaatggttctaaatgtggctcatcatcacaggattctttttgccaaatagggattaaattcattcagcaaattgcctattaaattaatttttcccattagggtgtatgtggctgcaaaattcataaaactgacaattggagggaaaaattggaaccaaacgagttcgttgagcatcaaaaaatacaccaaatttgacagattcatgtcacaacactacgacaatgacattgcaatacttgaggcaattattaatttaatatgcatctttttatgattcctatttttatattgtttggcattttctttttgaccaaaattgaagttgcatggaacttggaattttaggcaaaaaccgtgacagtgaattgacgggaccaaaaaattagaaccgggactatgttttaaaccggaaaccggatccaacttgtgaattgcaagaaaaaatcaaaagttttatttcttgcgtaaatttattcagctcactcatcctgttgtttatgacatgaaa

SEQ ID NO: 64102 - DNA, 439 bp, Heterodera glycines
  Genomic contig location: Contig_ID=SeqID_7192; Location=4005..4443; Strand=+
  SCN-specific regions: Sequence locations=1-147,170-248,270-306,349-439
atgattgtcaataatacatttttatggcaattaagggggactccggaggaccgcttatgcgcgaataccgaggaaaatggtacgtcattggtttggttattggcaaacccgacgtgtgtgaccataaatgtaagacattaaaaaataaaagcaacttaattggattaatttgttaatagcgtgtttcttgcgcccaacctcttattgtacttggattaaccgagcgaccagagggcgcgtcatctgccaacgaattatttattaataacgaagacgaatggttggaaattttggattattttatgcaattatattaattaattattatttttaatttaaagaatttttgccttaaaatatagattgaaaaatttggacttgtgtttgaaaatgttatttattgtgatggctatttcaatgttttttaaattttttatta

SEQ ID NO: 64103 - DNA, 321 bp, Heterodera glycines
  Genomic contig location: Contig_ID=SeqID_7193; Location=195..515; Strand=+
  SCN-specific regions: Sequence locations=1-50,72-168,190-214,241-321
atgtttgttcattgtttttcggattggttgatgacgcaccgctgttcatccgtttgtgttcatggtaaagttggagcagtgcagctggcggtggcggtggttgattctgttggccaagcaacgcggtatcaccagaggaagaagccttgaaaatgcacaaatttatttaaattaacatatttcaaatatttagtgttctacgaaacccaaaattccataataataaattaaatttcttttagtcaaaactaattaataaacctttttcgaaaaaaaaacatagtctaaaaataaaaataaaatagtattttcagagtgtag

SEQ ID NO: 64104 - DNA, 929 bp, Heterodera glycines
  Genomic contig location: Contig_ID=SeqID_7193; Location=234..1162; Strand=-
  SCN-specific regions: Sequence locations=1-95,117-310,339-345,422 -541,581-606,633-728,755-779,801-897,919-929
actcgcgcacattatcgccgttggcgccttgatggcgctggctttggcccaatttccgcgtttttcacggcaatcattgacaaaatttgctgctgtggcacattcattctcaaaaagaattctcagaatggcattggtgccgagtttcctcaactcaaatttgccttttcaccttccggtgctgttctgttggaaaatgtgaacggttgtgggccaaattcgtccgcaaattcgtcctcatcaagtggccgaaatggtggcacaacttctgcttgttcagaagtttcaaccaccgaattgcctgttagcgtttttttaatataaataattataattaaggctgggatttatatttatgaaaaatttccaaaatatttaaataaatatttacgtaaaattacaaaatattttatgaaaatatgaccaaaagtgagaaatttaaagtaacaatattgaataaattcaaccgatttttgaaaattcaattcttagagagtgtatttttcattttgctgcattttgttattagccttttttgttgacagattttttaaaaaattttgatgaatgcacaaaatggaaaaatattttttttcagataaattaaagcccaagaaaaaattttaaattttgttagcttgaggatgctacactctgaaaatactattttatttttatttttagactatgtttttttttcgaaaaaggtttattaattagttttgactaaaagaaatttaatttattattatggaattttgggtttcgtagaacactaaatatttgaaatatgttaatttaaataaatttgtgcattttcaaggcttcttcctctggtgataccgcgttgcttggccaacagaatcaaccaccgccaccgccagctgcactgctccaactttaccatgaacacaaacggatgaacagcg

SEQ ID NO: 64105 - DNA, 90 bp, Heterodera glycines
  Genomic contig location: Contig_ID=SeqID_7194; Location=989..1078; Strand=+
  SCN-specific regions: Sequence locations=1-90
atgagtttgatgagatcgtatcaattgtgttatcatgcaagtgaagtgccgtattacgtaattgccaagcgtccaatagagtccagcaaa

SEQ ID NO: 64106 - DNA, 264 bp, Heterodera glycines
  Genomic contig location: Contig_ID=SeqID_34273; Location=102..365; Strand=+
  SCN-specific regions: Sequence locations=1-264
aaatttttcgattccggtgactacaacatgaacaagaacaagcctattccaccgccgataggccagaatttgactgctgccaacactcccaaactggccgttccgattgaaactgaacccgagaaaaaaatggaagaatcagctccgattattgtatcgcaattgctcccaatgatgcgtcccttggccggctcaatttcgggttgttcgatggatggcggcgaatctgacgatgagggcggacagcttcaggtttattgttag

SEQ ID NO: 64107 - DNA, 549 bp, Heterodera glycines
  Genomic contig location: Contig_ID=SeqID_34274; Location=301..849; Strand=-
  SCN-specific regions: Sequence locations=1-178,200-373,495-498,521-549
atgcaggaacaactggcgaacctcaacctgaacaagtacaagcagatgcagcggcttttggaggacgcggaggaacgagcggaacttgcggagaattcgctgtacaaaatccgcaccaaaagccgctcctccgccagcctccgcggcatcgtcggcttcgacctccgcccgtccgcttcttccgccgctgtcctccgttctgtacgtcccttcctttttcttaattttgcttccctttgttcagtcttccgcttccatttttgcttcacaatattcgcaacccaacaattatgacaatcattcacttggtggagggacaaaagaggaaaatccattcaatccgaatggaaatttgatgagcaaatccatccacgaagaggaggaggaggaagaagaggaagaggataatgaggtagaatagaagaggagaaagaggagaaggaaaaggaggtaaaatatgcaggaggaagaatgaagaggaggaagaagaggagagaaagaacaggaaatgaaaaaggaggcatgtggggggcatttttgatgaataaa

SEQ ID NO: 64108 - DNA, 468 bp, Heterodera glycines
  Genomic contig location: Contig_ID=SeqID_34275; Location=130..597; Strand=-
  SCN-specific regions: Sequence locations=1-378,419-468
cgacgccaacgatgagaacgcgttactgtgcgcagtccgatcacgcaatttggtcgtgattagcatggtacgccaagcaggcggccaattagtggttccacggcctcgcattggtgattcccattgaaatttttttccaaattttctaacgatcaaattttcaaaaattttcaaggtgtcgaactttgtctgtccgccggcaccggcggcttggacgcactgaaggcatggcacgccgccggtgccaatctgtccaccccggactatgagggacggactgcgctgcatattgtgagtagtcattaatgattcgctcgagagtgtcaaaggtcgtctcgagaccgcttggaaattctgcgtaattctcaaggacaatacaattttaaattaaaaatttaaatatatttaaattatttttcccaggctgcttctcgtggcttcgatgaattgtgcttttggctttgtgag

SEQ ID NO: 64109 - DNA, 561 bp, Heterodera glycines
  Genomic contig location: Contig_ID=SeqID_34277; Location=289..849; Strand=+
  SCN-specific regions: Sequence locations=1-561
aaaaaattgtcaaaaaaaagaattgctgtggaccgcgccggaacatttgcgccaaaacaaccgggccggcactgttgagggggacgtgtacagcttcgcaatcatctgcacggaactggtcaaccgcgagacggtgtggaacggtgtggagcgcgagcaggacattgacggtacggtaccgttgaacggaagttacggtagtggggggggggggggactcgagagagtcacaaaaaatgtgatcatcgtttcactctcgagattaattctcgaacagtctcgggttttcgagaattttccggggatcagttaatgtctcgacttatctgttacggataaagtactgactctcgggggatcggggtcaaaatgctttctctccaatctcgaagtctcgggatctcagtctatttttgcctcaacgtttaaaaaattaatttgttttttccccataaattttgtatcgcctaaaacggaccaatgtcccactacctcacaggccacaaagttcgcggaatgaagagatgtgtgaccaccaacgcctggagagggggagctgtg

SEQ ID NO: 64110 - DNA, 1031 bp, Heterodera glycines; identical to SEQ ID NO: 34278
  Genomic contig location: Contig_ID=SeqID_34278; Location=1..1031; Strand=+
  SCN-specific regions: Sequence locations=1-59,177-277,316-385,435 -459,483-540,568-874,912-1000,1022-1031
  Gene Ontology: Mol. function=protein serine/threonine kinase activity; Cellular component=centrosome; Biological process =reproduction

SEQ ID NO: 64111 - DNA, 1742 bp, Heterodera glycines
  Genomic contig location: Contig_ID=SeqID_7196; Location=322..2063; Strand=-
  SCN-specific regions: Sequence locations=1-347,377-833,877-1742
atgaagcaactgatcacggagaacccaaagcaacaaccatctcaactgcgcgcacagattcggaccaacgtcaacgacgaagtctttgagctgcttggcaccaatgaagcactcgaccaaatgacgaacaggtagaaaacaattcagtcgaataatgatacaacatttactagggccaagaacaaatttgttggcaaagttaactgcggcgacccactgcaaatccaaattccggctggtcttctgaaaaaagacgatgaatccgtcctcatttatgacagccgcgaagtgagggtaggacagtcggatgtcgtactgattttcagccatagcaaggcgtgacttacttattttattttttaaatctttttaatttcagctgttatcaatgctcaaacaaaatcgtcggtggagccttgacggcactttccgcagtgcaccaaagccttggacgcaagtgttcgtcatcggctgttacgtaaacaatcggatggtcgtcacagcgcaagccttgctacctggtaaagcctcgaagtattacacagaagtccttcaacagttgaagcgtgccgttgaacccatccttcccataaaggcaaaaaaaaacagcagattatcttcattaataattattttaagtgatgagcgacttcgagattggaatgctgaaagcgatgcgtcatgtcttcccgtcatgcgaacgctcgggctgcagcttccacatggcgcaagcggtgttccgaaaagccagaagcatgggcatttttaatttgttgaacgaagatgacaacgaagcaccggttcaaaggaaatccgttcacaaaacattcaggtgtctttcattagcttatgtgtatttatttgttttttcaaaatcagatctgttctctctttggcactcattccgccactttacgttcggcgcgctttttcaactattgtcagcgcggcaccgcttggagttcaaggatggctggcgtattttgccaaaacctacattggcaccactcaattcgagattgatcgcggggcggaggcatttgaaccgcatgctgatgtcggacactttcttctgcgtcgcactcgaagcacaactcgtaaatgcacctattctgtcatgaaatttatgaaatttttcaattttagcgttcagtatttcccaggcatccataatgacaggcagtggaccaatacaattcggactgcattcgccacaaccttcaactccaaccattccattgtcagaagaaagcagcttgcagcttattccacgctgggaacaagacatcgtctgtcctccacgcttcccaatctcgttttggaatgtgtacaccagagctcaaatggcaattgagcgaacgaacaacggcatggaagccgcgcatggacaatttgcagtaaaaatttgtccgttggaagacacttattttttgttaatttagcgtgaactcaatcatcatccgtcactgagtgatttcatagcagcattcatcaaggacatcgacaaacaactggacatcggacgcgcagaacagctccagaaaagtagaaaacgaccgcaacggtacattatcaaagaacaaaatgtggtgcgaatccttgacgaggccgactttgaatcggaagaaggattgacaaattctttgcacctgctcgggctcgtgatgcaaggctttgcggagggacttcacgtccgtggaaattcagagagtggtgaagaaactgaggccgatgaaaattga

SEQ ID NO: 64112 - DNA, 771 bp, Heterodera glycines
  Genomic contig location: Contig_ID=SeqID_34284; Location=37..807; Strand=-
  SCN-specific regions: Sequence locations=1-249,271-771
  Gene Ontology: Biological process=induction of apoptosis by intracellular signals
atgttaattgcgttgggtttggacaatcgcgcctattacgagcaccaatttgaggaccttttcctccgagaaactgccgatttctatcgtcgtgcaagtcaaaagtttttggcggagaacagcgcgtgcgtttacgttcacaaagtcaacgaatctttgattgaggaggtccaacgatcggagcgctatttggacaaaataacggagacgaaaatcattcacgttaattctgtgaagagaataacgaaattggatttgctttttaggttctgaacgaagaacttataacaaaaaacatgacgacaattgtggagatggacaactcgggactcgtttacatgttgctcaatgaccgaattgatggttttacatttcaatataaatctgtctactttttgctattagatttgcgctgtctgtacgaattgctcaaaagagttgaaagcgggcctaagacgatgacaaatacaatgagcagatttttgcgtgccaaagggaccgcagttgtcaacgacaacacccaacagcagccgcagggagaaaccgtagagccaatcggcggagtttcaaatccaatcattttcatccaggtgaacttttctgtctcggtatttggactttatttttttagagtttaattggactcaaagaacaattcgaccgttttctgctcgaagcgttcaataacgacagggaattcaagcagtgcattcagtcggactttgaacactttctcaatatcagtccaaaagcacccgaatacctttctct

SEQ ID NO: 64113 - DNA, 93 bp, Heterodera glycines
  Genomic contig location: Contig_ID=SeqID_34285; Location=790..882; Strand=-
  SCN-specific regions: Sequence locations=1-93
atggggagcaaaaatccaccgcagaattatagtacaggctatagggaagctattcccgaaggattcggtctctccataaatctgggcgcatcg

SEQ ID NO: 64114 - DNA, 893 bp, Heterodera glycines
  misc_feature (886)..(886): n is a, c, g, or t
  Genomic contig location: Contig_ID=SeqID_34288; Location=1..893; Strand=-
  SCN-specific regions: Sequence locations=1-124,147-355,377-598,620-893
ggagcgtactgtgcgactttcggctggacgccgcatgtgccaatgtggtgtggcaaaggtgggcacaaagcagcgaacgtcagagctgatcggccaagtcaaaccgatcaccccaagtcaatgccatctcccctcccccctttttctgctctctccgcagaattttctatggccgcgatgtccgcgagaaggaaatgatcgccgtggcaaaggcaagcgcgaatttgcaagttgtggaggctgcggccattaaccgcgcgcaaacttcgttcagtccgcgtccgccgggcgctggtccgtcgaatttttgatcataaaataaataacatttcagcgctgataactcttgacgaaggctttcttaacacttcctacattaaagccattgaattggtcgattcctacgacttggacattgaagctatttaccgacggcacagcgtggaggaaatgagcgtaagtaacgatgggtccttgaaaagaaggacaaacggagcaaaatggcaatgttgggtcagttggttgagccttttatcatcggttaggtgccggtggaatgttggaccatcaatttcggctgctcaatcaatgacaacgaatttctctactttttggcaccgcaacaaattgctcattattggatgggattggacaaagtgaacactaattgttcggcttttgccgtttcaaaatgttttttccaaggtcattaagcggcttcaagatcagatgcgcaatcccgaccgacgtgtgttgtggctgaaaaggctctatttgcacttgtggactgagcaggagcaccaacggggcgaagtcagcagcagttcgggcggaagcagcgccgggggaattgccggtagaaattgggaggggggggggtggccanaattggg

SEQ ID NO: 64115 - DNA, 382 bp, Heterodera glycines
  Genomic contig location: Contig_ID=SeqID_7198; Location=806..1187; Strand=+
  SCN-specific regions: Sequence locations=1-306,328-382
atgcgtaagagatctgtgcattgaataatttcttaatcattttcatttttgaaatgttcaaaaaataaaaatttaccaaattaaaaaaatttgaaaatttccaaaatccattaaaaacgaatataatataattggattattgtaagtttatgaccattcacaatcagcttaaatttaaagtcagcaataatccattttccgtccgttttactcaactattcacagcatacaaccatcaaaacaatttaattctttgaaagttttatccccttttcttttgcagcagaaatattctacctgctcagaaattatctttggattcatcccttcggtttccaaggagtacaagaagttcttgtcgtcatcaaacgacgctaattta

SEQ ID NO: 64116 - DNA, 1749 bp, Heterodera glycines
  Genomic contig location: Contig_ID=SeqID_7198; Location=2207..3955; Strand=-
  SCN-specific regions: Sequence locations=1-46,80-202,224-737,759 -1383,1405-1516,1539-1749
gaaattccaggaaaaacaggaaaaaaaattcttagaccaaaaccccggaaatatatataaatatattggaaaagattttcagcgttgggaaataccacccatctctcataaccaacaaatcataactgatgacaaaactaaagctgacatttttgcaaaccatttttctgaatccttccaaaatttatcagaataccccaaacctcctccaataatttctgttaatcaaccttcaatttctgacgttcatttcaatgttttagatgttctcgaaattttaacccaccttccaaacaaaaataatacatctcctgacgatttaagttttaattttctgaaacgttttcatctaattttaaccagacctctaacagatttattcaaactgtctctaaaatccggtaaactaccaaaaatttggaaaacctcaattattctaccactatttaaaaacggagataagaatctagcatcaaacttccgtcccatttccattacctgttcttgctgtagaattttcgaaagaatattagccaaaagaataacagaatttttactggaaaataacttaatttctgatcaacaattcggtttcctcagaaagcgctctaccaccctccaattaatttcgactcttgaggattggtataatgccatacttctcaataaaaaaatcgactgtatttatttggacataattaaagcctttgacaaagtccctcatgaattgctaatttataaaatagagaaaattggaattaagggcaaccttctaaattggcttaaagattttctaactaacaggacattcaaggtcagaattaatcagcagttttccaaagaatttcccatcaaatcaggtgttccccagggatctgtcttggggccaattctatttttaatttttataaatgatctatccccagtaatccctgacggaatttcgctaaaactttttgccgacgatactaaaatttatttttgctatgacaccgaatctcaacgtaaaaaactagacgaagccttacattgcgtcagccaatgggccaaaatttggggtctacaattttcaccagaaaaatcagcttctctatacctcggcaaagataatttcaaaattccatacaaatttaatggaaagactattaaagagacccaaacaattcgagatcttggaatcttaattgacaacaaactgacctttaaatcccatatttctgctattcttcaaaaagcctaccttagaagcagaacgctttttcaaaaaatgaaatcaaaatcatctaagacatggattaaaatctataaaagctatattagacccttacttgaatattcatccgaaaattggaacccccacattaaaaaagaaattattcgccttgaaaaatttcaaaaatttttcaccagaaaagtgttcttaaagtgccatttaccggttttaccatattcagaccgattaaaatacctttatatttccagtcttgaaaataggagaaaatatttagatctgatcacagccttcaaaattattaaacaagaaactcacctaaaccctctaaaattatataacatatctcaaagaagaaattcaccttttcccagattaatcactaaatctaaaattactaaaactgaacattcttttaccaatcgtaccacaaaaaatttacaagaattaagcaaaacaatcgacctttcatcaataaactcaattcaaagttacaggaccaaacttaaaaaactgtt

SEQ ID NO: 64117 - DNA, 336 bp, Heterodera glycines
  Genomic contig location: Contig_ID=SeqID_7198; Location=4197..4532; Strand=+
  SCN-specific regions: Sequence locations=1-129,159-336
atgatgttcatttggctgttgttgctgccttcctttttgtttctcctccgcttaagtcatgccaatttgcttatccctggcattatgacggaacgcgtcgaattggcaccaaaatcggtaatttactcctttttaatattttttttatacatattaatccttaattttttttcaattaagcaagaatacatcggctttcttcagtcggctttgaatggcactgaggtggaaattcgggtcaaatgtgaggaggacgttgaaatcgaattcgatgtcgaatttgccattcgaagttcgccttgcgccaaggaatttattgtggacaaaatgcgctaa

SEQ ID NO: 64118 - DNA, 693 bp, Heterodera glycines
  Genomic contig location: Contig_ID=SeqID_7199; Location=802..1494; Strand=-
  SCN-specific regions: Sequence locations=1-206,230-693
atgaaacgaccaatggactcaacagcaactccaccttccaccaaaaccacacgtatttccgcggacgctttggctggccaaatcgactcactttctgctgcagtcaacgctcttcttgttcaagacgacatttcccaggccgtcaaacttcagttcggcgttctgctgactaccctccacacatgccaacacgtcatcgatggtctgaacaacaacgcaaacaacaacagtgccgaggaacaggaacggcgccgttccttggtcatcattggaatgccggagaacccttcagcccgtccttcggagcgtgttcgagaggatcaaaaggttgtctcggggattttggacgaattgggtgttgaggcggtgccaacgacgacctaccgaatgggccgtcctgatgttcaccgtgcctcgccacgcttggtcaaagtggtgctgccggcctccgtccatcagcacattgcactcggcggttggaaaaaggagcgcactcgcctccgttctctgccaaactggggccgtttgctgattcgcccgtctctcagccgtgaacaactccaggcggaatacgaacaaagacaggccaaacgcaacggaatggccaaccatccgccacgtgccaacaatgctagcgccatttcaaaccaactgcacgaacttggacaaaaaatgcagcaaaattttcgatga

SEQ ID NO: 64119 - DNA, 704 bp, Heterodera glycines
  misc_feature (23)..(23): n is a, c, g, or t
  Genomic contig location: Contig_ID=SeqID_34293; Location=236..939; Strand=-
  SCN-specific regions: Sequence locations=1-87,109-704
aatttggtgcgctttagagcacntttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagtaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 64120 - DNA, 477 bp, Heterodera glycines
  Genomic contig location: Contig_ID=SeqID_34298; Location=188..664; Strand=-
  SCN-specific regions: Sequence locations=1-114,264-415,438-477
atgcatttgaaattgtgcctattattctgtttaattttatttttgatcaccctaactgatcagatcggatctgaaaataaaaaattggaacaaaaaacatttgatgaaatatttggagaaaaatgggaagaaaaaagaaacgaagaacagaaaaaaagagaaataattggaaaattcaataagataaaagagaaaattaagcaaaaaggaagaaaatacccaagaaaagaatggagtaaaattgaaggaaaaatagcaaaaaaattgggcacaaatcgccaatatatttataaatggatcaaagaattgggattaaatcaaaaaacaaacaaatgctacaaatcaaaaactgatgagcaaaaatttgaaattgtgcagaaatttgctgaaataacaaatgaatttaagcaaaaaggaagaaaatattcaagaaaagaatggcaacaaaattatgccgaaatttgtaagaaaatcaga

SEQ ID NO: 64121 - DNA, 674 bp, Heterodera glycines
  Genomic contig location: Contig_ID=SeqID_34301; Location=489..1162; Strand=-
  SCN-specific regions: Sequence locations=1-141,211-328,385-622,644-674
atgccgcaacaacaacagcaactgtaccatcagcagcagcaacatcatgttttgtcgttgccatcttcagcgacagcgggtggccgagctgttcagcaacatcatcaccgacgttctgccgcttctcctgcggtggtctatcaacaaccgcaacagcagcagcagcatcagcaacactaccaccacaatcagcagcgatcaacagcagcaaatatgatgatgagcagtggtccggctaacatgaacatttcagtccgtgaattcttgagcaacaacaacgcggccagcagagggggagaccgttgatgatctgatttttttgattgaattgctttctttctttcttttttgcttgtttctcctttttgctcttcttctggctttgatatgagacgcgcgcattgattgattattgatcatttaatcattatcatcttattatttgtgttcccactttgatcgtttgaaaatgtccgttttgttattttacctatttatttttcattaacgcaccgactgaagacacaaattttttcagtggcaattttcaactcactttattgccctttgctcacatcacacacacacacattttattttacaaacatacagacggacattcatttcataaccaatggcatggcattggttagtctctgattggattcaataaa

SEQ ID NO: 64122 - DNA, 1040 bp, Heterodera glycines
  Genomic contig location: Contig_ID=SeqID_7200; Location=342..1381; Strand=-
  SCN-specific regions: Sequence locations=1-146,178-383,406-754,796 -939,975-1040
atggaaagattgcgaagttttttggcagaattaaaggcaaaggaattggacagtcgcacagtttacgaggcgatcgttccattaaaaggtgaaaatgggctaattaaaatttaagcggagcaaagccaattttttttaattatgccaattataatatttaatcattaattaattattcattagcattctgtgacgacacttttctgtacgaaaagttcaaaggaaccggcgaaaaaagttcaacagaaaaacaaatggtgcttttgataggaacacttgtgcatgaaattgagcagcggattaaaacggttcagcaattgtttcgattggacccccaaaaatattttttcgatggaaaaaaagccaaaaattcggcccaattgtggacagtgatcaaagaagtggcattcaccctaaacattgacagcattgaaaatctgtgggcatttctcaacaaacttttctacactttgttgaaccttttggctcatttggagggattcgatttttttgacggaatgtccaaaagtgacactttcgaaattgaaaaattgcaattaatgcagcaaattgtcgtcagaaaatacgcatttttaattatcgaagatgagaaatatcggacgaaatgggacgaattgggaaacgaacagaaggcgaaaaaactgtttaaaattatcggcacaaaattcgacccaattcattttgagcacttaaaaagggagtgggcaaaaatggagcaacaaataaaaattggtaaaaataattaattatttatttaatttgaaaataaatttagacagcgaattatacgcacaaaatttggtcacgaaagattggcacaacagacaaattatgccaatgttcgcaaaattgtcacaacaaataacaacggaggcctataaaatgaacgaattaacagcgacaaaaaaagtttcattgaaaataaaataaaaattaattaattatttaattaagttggaaaaatatttacgcaattttggaaacgcaaatgaccgagaagaaaatgaggagcaaataaa

SEQ ID NO: 64123 - DNA, 1597 bp, Heterodera glycines
  Genomic contig location: Contig_ID=SeqID_7201; Location=46..1642; Strand=-
  SCN-specific regions: Sequence locations=1-585,634-878,901-1079,1104 -1216,1238-1319,1341-1597
atgcgagatgagctgttggagcagcacacgctcagaatgatcagactgaaccgatcggaaaatgcattttccgaatttctgaaaaattcagtggccgaagagaaggcggctgtgtacagactgaacagattttacatggacaaggacagaaacactggacaggaattgtccttaaatatattccacaaatacgcggaacttcaaaggatgtgccgaaacggtaatattaacgcattaattaaccaatcgggcattttggacaatgttttagaattgtcagttggccaaatcacaaaaatagaagtgcgaaattacattcgctttttggattaccaaaatgaagagattgtctggctgaaggccgaactgttgcttaacatgcttgcctattataaatggcatgtgtttaagggtttgattctgtttaagattaggctcaagagtctcgaaaagaaaatttcgcggtttttagtccggaaatcggaatggacttttcaatgattccaaaacaaattttttttcgtatttactcaaaggaaacgagaacattgatcgttgtgtgccaccattttgcgcttaattttattttttgatttctttaaatttgaaagtaaaaaataaacaaattttcttaggtttacaattcataaagcaaaaattttgccaaaaagtgacgaacaagaaattttggacgaagcatttacaataaccgaaaatgggatggattctgtgcccgacttgaacagtgtccatgccattaatacttcaatgcaacatctgttcacattgggagcaattaagggcaaattaggcggaattggacaaccagatgattggtggcacgccgtaatcccatttttggcttcgactcacaacgaaactctgaaagagcttcttgttcaaaatgacgaatttcgggcaaaactgaaaagtatgaacaaattggggcgaaaaagcagtaaaattagcggaaaatttaattttgccaatttttagcaatttacattgatagagaacggttggagagaatgattccaaaagattcgcaaatgtttgaacaactcattattgaaagcatggcgaaaaaagggacaaaaaacttgacggattacggtgagttttacaaaatgccaacaattgacaatttaaaaattgaaaaacgaatttagaaaatgccgaatcattcaacataatgcaattatatgagaagctaatactgggggatgaggacaatggcgaaaccaaagacaatttgacactttctgttttctgtttttacttcgaaattttactggaaaatcttttggcgaaactccgcccattaaaagcgaaggaaaatgcgaaattaaagcgaatggcaattgaagttgaggtcgaaaatgccaaattgaagcaaattctttcaaaattgagcggaaaagacggaaaattggccaaagtgtgctatttggaaagctttaccttatgggctgcgcagaacgaagcgttggcaaatgaaaacgaaacgaagcaattgacaagcagcgaaatggtggataatttgtgggaattggaaaaagtgaaacgaattaaaaaaatgaattcgataaataattaa

SEQ ID NO: 64124 - DNA, 476 bp, Heterodera glycines
  Genomic contig location: Contig_ID=SeqID_7202; Location=228..703; Strand=-
  SCN-specific regions: Sequence locations=1-156,178-189,237-268,290-476
atgggaaaacaattggaaaatggtgacaaaatggacaaaacatcaaaaaagcatatcgaaaaattcgttgatgaccgaaaaatgttgcattacagcgcaatttcatttttattattgaccaattcaaaggaagaaaaaggcgaaataaaaattgggagaaataatgcaaaaggcacagcctataaatggtaatttaaaatctatattttaattaaaataatttaaaaaataatttaggaaaatgtctgagtattttgatgagagcaaatttaatgttgaaacagaatttgcttataaaatgcgaacattgcgctctaaaaatttgatgaaaaataacgaaaaaattctttcaattaaaaatgaaattgcaaaattaattggagaaaatttggtagaagagcttgaattccaacatccaataataatgtcaattggtaataaaagcttaagcgaaaattaattatcaaaggaataaa

SEQ ID NO: 64125 - DNA, 501 bp, Heterodera glycines
  Genomic contig location: Contig_ID=SeqID_7202; Location=2011..2511; Strand=-
  SCN-specific regions: Sequence locations=1-22,44-91,128-204,226 -286,308-410,433-445,490-501
atgatggtacttttggagaattcattttgtttattatttttgacaatttttttatccgtctgttctttaaaaggcgctaaaaaaagtaatgaaatttttaattttaaaatattttaaaactttttaagcatttggcattgatcaaattgactgtttttatgcaaatttttttgggctatcatttgaaactgaaaaaaaatgtgacaaaaattttgaagaaatttcgctaacaaaaattgaagagattatttattttaatgaaatgaatgaattattaaaagcggtaaaaacaaaagaaaatttggacgcggaacacaaaaaattgtcggaaaaaacattggaacaatttttgaacattgagaatttgtatcaaaattcaacgcaaatcgtgaaaagctgtgaatattggaaatttttcctcaatattcgcagtgtttttggcatgttttaaatataatttaattttaaatcattaaaatatgtttttttcgaattaataaa

SEQ ID NO: 64126 - DNA, 410 bp, Heterodera glycines
  Genomic contig location: Contig_ID=SeqID_7203; Location=167..576; Strand=-
  SCN-specific regions: Sequence locations=1-109,157-178,200-410
atgtttgagcaaggtatagcactggaagtaattgaacgaacagtaaatgttccaactgttgaattgaaatgccgttttgcacgactttgtaagaaaatagcaataggcgttataaattaaaaaaataaatttaacattttttaaatataattattagggatggaaattttatgtaacacatatttttcctggattccccaaatgctctgaatagtagaaaaaaaacacattcttttttgtgtttgcgaacaaaaatcgggacttttatttatatatttttacatatttcgagctttttagcatatttacacatttcgggctttttgtacatattttggactttttagcaatttctccataaatttttgagaatttttaaaattaatcaaaatttcttgtgaaaaattaaa

SEQ ID NO: 64127 - DNA, 697 bp, Heterodera glycines
  Genomic contig location: Contig_ID=SeqID_34303; Location=1..697; Strand=+
  SCN-specific regions: Sequence locations=1-80,102-697
gacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 64128 - DNA, 589 bp, Heterodera glycines
  Genomic contig location: Contig_ID=SeqID_34305; Location=675..1263; Strand=+
  SCN-specific regions: Sequence locations=1-179,201-283,318-589
atggccattcaaatgttcagcagctgcagcttaatcacttttgccattcttcttttttctatgttgattgaggcaagattcttggacaaacgaagtgagaagccgctaaaatttgcataattaggcccaatttggtattggtggttttatttttttgacagattttaagaggtatcttaacagctgattttgtttgacacttaattagcgcattaattaattgcttgggtgggaaggaatttccggttttttagcctctaatttccccatttttttggtttacattttaaaacaaaaataaattaaattttattttagtccaagtaaatcaaatgcattaattacctcctgtattaatttttaaatattctctgaggtgccaacattcgcttcgtcgttttggcattatttccctcttcttcagccgataattgcttttacggcatgcgccatcgcaacatcccttcgggtggccttgtcgcgaaaatgaccaagtggaacacgttcaacatgaagaagggcgaccggatgaatgagcacgactgtcgcgggtcgtttgccggctgtcagacgtattcatgcatcgatg

SEQ ID NO: 64129 - DNA, 753 bp, Heterodera glycines
  Genomic contig location: Contig_ID=SeqID_34307; Location=44..796; Strand=-
  SCN-specific regions: Sequence locations=1-4,26-247,270-398,420-753
atggaaataataataattttattaaggattacaaatgcggataaattttgtttgttttatgcattggtggcgtcaaagctttatttggaagagcatcgaaacatttttaatcgatttatgaaaaatattgtgagacagagggattcagctattgaacttttacataattgtggaattgatattaacgaatatagctatggtgtggagcaattgccgaatgttcagaaatattgggtgggtttaaatgaaaaaatgcaaaattaataaatttttcaggatgagatttaccccggaaagtaccgggttgtggcgtttgaaaaatctgcggatccgaggaaatcgatacgtgttttgtggaaaggtcctatggggcgtgaaaatgtcgtgccgttattcttggagaatggccattgggatggtctgaagaatttcgtctgcttttttaatcgagggaggaaattctgcattgattgcgaatgtttttacgacaaggatgttaagcatgctttcgattgccgggcgagatgttattattgcaatagagtgggaggaatgccatgtgaaaaggagagtggagtgaagattgaatgcacgaagtgtcgacgttacttttacaattgggaatgctataattatcatcagggacatcagacttgcaacttatggaagcgctgtgtaatttgtgacaagacatatttatttaacccgaagaaggaacatgaatgcggagagacctattgccaactttgtagt

SEQ ID NO: 64130 - DNA, 664 bp, Heterodera glycines
  Genomic contig location: Contig_ID=SeqID_34308; Location=216..879; Strand=-
  SCN-specific regions: Sequence locations=1-209,231-664
aaacaaaaaaatcgattttttcaagtgtccgtttgagggtactcaaacaattatgtgggagcaaaaatccaacgcagaattaaagtacaggttatagggaagctattcccgaaggattcggtctccccataaatctgggcgcatcggttcggggggactgcccctaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 64131 - DNA, 189 bp, Heterodera glycines
  Genomic contig location: Contig_ID=SeqID_34309; Location=677..865; Strand=-
  SCN-specific regions: Sequence locations=1-189
tgcgtcgacgtcggttccatcgttttgtgcgcctcctatttggacattccgccggagccgatcagcagcagcagtgacgagaaaagcaacgggaaaagaaagaagcaaaagggacagacgaaaaaagaagggcccaaaattgtgacggatgtccacgaatttgggtgcattccatggagaatgttttga

SEQ ID NO: 64132 - DNA, 392 bp, Heterodera glycines
  Genomic contig location: Contig_ID=SeqID_34310; Location=287..678; Strand=+
  SCN-specific regions: Sequence locations=1-392
  Gene Ontology: Mol. function=DNA-directed RNA polymerase activity; Cellular component=DNA-directed RNA polymerase II, holoenzyme; Biological process=transcription from Pol II promoter
cggttacgtcggcatcaaattttgccccgaatggtattggttttgcttaaattccattaaccattcccaccaaaagcaataacatgctttacccgcgtgaagacaaacaaaatcggcagcttatgtacgtttgtcggaattgtgagcacagcgaaccggcggacaatccgtgcatttatgtgaacaaactgactcacgaagtcgagtgcgttttgtagtcaaattgcaatgaattattttaattgatcacccttaatgagttaagtgagctgacacaaattgtggcagatgttattcacgacccgactctgcccaagacggaggagcacccgtgccccaaatgcaaaaacgccgagtcggtgttcttccaggcgcagtcgcggcgagcggag

SEQ ID NO: 64133 - DNA, 389 bp, Heterodera glycines
  Genomic contig location: Contig_ID=SeqID_34311; Location=16..404; Strand=-
  SCN-specific regions: Sequence locations=1-20,42-275,297-389
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagtttataagtcttggatttgtcaaataaa

SEQ ID NO: 64134 - DNA, 388 bp, Heterodera glycines; identical to SEQ ID NO: 59796
  Genomic contig location: Contig_ID=SeqID_34311; Location=549..936; Strand=-
  SCN-specific regions: Sequence locations=1-20,42-275,297-388

SEQ ID NO: 64135 - DNA, 860 bp, Heterodera glycines
  Genomic contig location: Contig_ID=SeqID_7204; Location=1128..1987; Strand=+
  SCN-specific regions: Sequence locations=1-34,56-281,303-363,403 -606,628-860
atgaacaggtctttggtaaaatgccaaatttggcataattttcaaaaatcctttaaggtttggccctgctttgagccggcaaaatggcaggaaaagcgttgcgggggatgcaccgctttgggcaactgcgattttgaccagggccaaccgggcgaaacgtcggatgatgccgagaaacaacagccgcagaaggccatcaacaacaacacttccgccgacagcaacagaaacggggcatcggcttggtggccatgcctttgtgcacccgcaatacggtaagttggacagacactgtatgtacaatatttcaatcgactgctgtttggtgagtatgactaatcacttggaattgtttgggcgatcatattttacataaaatttaattttaacttttttttaattctcagaatttgcgttcgtgttgatgacaatttgccagaaactgttggctctccgccgttggcagccgacaactcatccgacccttctccttcttctgctgatccgccattgcttgaacgcgtgcccaaaatttgggagttgaaaaaggcggaagtgaagcgaatggaaacgccggaacagaaggaggcgagggaagaagcatatggactgagggtaatgagaaaacgaacggacaattaaagcgtttaattttaaattaattacctaaatggcattttcatttccttttattatttaaatttgggttactccccgaccctcggcggagattaaagtcggatatcatggagaaaattcctcaacaagatttttccgggatacctggacaaatttagaagattacggagagaacaccttctttggtgaggaaattgaaaaaaaaatagaattttttttta

SEQ ID NO: 64136 - DNA, 2879 bp, Heterodera glycines
  Genomic contig location: Contig_ID=SeqID_7205; Location=519..3397; Strand=+
  SCN-specific regions: Sequence locations=1-181,203-226,279-672,701 -802,837-956,978-1109,1197-1315,1337-2008,2037-2223,2247-2632,2655 -2879
  Gene Ontology: Mol. function=amiloride-sensitive sodium channel activity; Cellular component=integral to membrane; Biological process=sodium ion transport
ttttaaagggtgtgtatgatccgatcgcaattcgttcaaaagctgtcgagaatctcgtgtttgctgtctcacaaatgagtgaatacgaacagagtcagatgggctacagtaagcgcgagttcatcaccaagtaaacaatgcacgaacaatcaaatggttatttgtgattatatgacggaaatttaacactaataataatcactgaccctttatgtacttttgatagttaatttttattaaatataattaaaatatttttatttaatatttatttttaagatgcagtttcaatgggagggaatgttcggtggaggaagacttctcattgtatgtggacccgacttatggcaactgtttcacattcaatgcccacccggacaaaaatgtgttgagtgaacgagccgggccaaattatggtaaaaatgcgtttcaattaaaaaacaaaatgaaaaatgccatttaagaaatttgaaatctttgcaaatatttaggcctccgtttccaagtttttgtcaatgtcagcgactatttgcccacgacagaagctgccggtgttcgcattactgtgcataagtcaatgcgtggcgtactgtactttttgatttcaattcttgtttttagtcctgaagaacagccctttccggacacacatggccataggaatgaatttgcttattttcaaaaaaatttaaaataaattctttttagtgctccaactggcttcgttagctcatttggcatccgtttgaagtgagaataaaaaaacatttaattattttgaaaagaaaacattagcttaatgatttaaaaattaaataaaaatatataataattttgaagatgtgttaatcggttgccaagtccatacggcgaatgtgttgagcaaggcaaaactgatgaatatatttatcgggacaaggaatattccactgaggtaaaatcttgcaaaatcctgtaataatcaaaagttatccaaatgtgacaaatccataacctaaattagcgaatttaattattgaaaatccccttctgctgaaggggtgccaacgctcgtgcatccaacggatgctggtcagaaagtgcgggtaagaagaacagttgggaaacagattataataaatgaaatataataattaataaatattaattactaggaataaaatttataataataaattaataataataaggataattaatctgcaaatattctatttttggcaaatcaacagatgtggcgacccgcgttttcctcgctatttgaacttcagcaattgtcccgtgggcgacccgcggctgagttagtgttaatcttcaagaaattatttaaatgataacacaaaaatggaattcatacgcaaattgtaaatgagaattgcttgaaataatgaaaaatcagctgaaaaagattccgttttaaagaaacaattatcaattataggaccagcaataaagtttttttagcaaaaataattaattagttactaacaatgcatttaaattcaaatttgcaggagagtgtctccgacgtgaaatgcacagcgctgcgcggtctgccactcagcccgactgcgtgtgccgacagccgtgtcggtgcgatcaaataaaacaattaattttgattgcatttaattagaaaattaatccataataaaaaaagttctaacttttcttcagtgagcaggtgttcagcattacgtacagttgtgccaggtaaatattgtaaaattcgaaatgtttagctttcaaattccgggagggggtgggggggggtaccgttttgttaaagtatttctggtcgtttcccctctgtcataatgagaggccatttttatgaaaaaatattctgggaatgcgataccgacaattcatctgatcattttttcttctcggtctcaagtctatctcagtccatttgagctgttaaatccctttctcatttacttaatttaatattgaatttgctattatttttataatttggcgttttttcattattttctcatgctttattaaatttattcaataaattaattcaacagatggccctccagcgatttggcattgcacggcgaatgcgacccgtcgctgagcggtgcgcaatgtctgcagttccatcgagaacagtccgccattgtcgaggtgtactttgaacaattgaactacgagagtttgcaggagagcgaagcatacggagtaaaaacgaaaatttatttaaaattaaagaagggagggggaggaggggctaatgcttaatggggaaatatgtccagcggaaggcaaagcggaccaactgcgtttaggaaaagttagaaaccatcaacaaagttggtatcattaaaatgctctaaaaagctttacagctaaccaaaactcataatgatttgcaaagaagtaaacaattaaaattaagaatatacaaaaattctgacttttctgcagtttcaggtcttaatttttatctggttgttaatctcatagaaataccttacaaatacagtctaaatatagatgaacaaagaacaaatgttagctacaaaaagccattaaataccacaaatttggctttctgtctcttaaagtcacaatcaaaaatctcgagtaattgttgcgagaagttgttactttttttcttgtaacaatatcaaaaatattttgctgttttcccatagatgccaaatttgctgtctgactttggcggacagcttggcctatggatgggtgtttcagtgatcacaatcatggaagttggcattctaatcagtgagctgctggttttgttttttgtgccaaaaatggtcacttggctgagtcgattgttgaacattgtcgttggcactgatcgggtgccgtcgggcgatggcccaatgttgccttct

SEQ ID NO: 64137 - DNA, 791 bp, Heterodera glycines
  Genomic contig location: Contig_ID=SeqID_7206; Location=410..1200; Strand=+
  SCN-specific regions: Sequence locations=1-406,440-791
atggaccgcgtggtgcccgtgtccgccttcggaaatccggcacttggcgaattttacaaagtgatgccgtcgagcggacttcgagttcggttttttctttattttgtcattttctcccatttttgggtgcaaaaatgtcatagaattacaaattccatacatttgaattgccatggattatttaaattttttctagcgaggcttgtatcacatctttttaatatttttttctgggaaaaatcacaatttgaccaattctgaaaccggactcgaattggaacaaaagttcacatttttcaacaagttcacatttacgcaacaaaatccattcaatgcaaagaagtggacagaatgagttttcgactttttgttcgagttcgaatcatgtattcaaacatgttttcagaaaaattttcttttaaaattctcaaaattttcccagcgtttgcatcgccaggtcacaaatttgaaagcccccgcccctaattgacaaactacgaattattggctctaatttcctcctttttttacagttggaaatccgtcacgaggactacaagcagcagttgggggacatcaaacaaacttattggattgctgaagtgaaagaggcaaaccctatatttgattacttttatgacagtttttatgtccaaccttcgaattttgctgggcaacaaaataagggacgatcgaaggaacaacaaaaaaaaaactgtgccaaattggcatttcgttgtcttcaattagcatcgaataatcttgataatgctgtgtccctttctctttag

SEQ ID NO: 64138 - DNA, 120 bp, Heterodera glycines
  Genomic contig location: Contig_ID=SeqID_34312; Location=579..698; Strand=-
  SCN-specific regions: Sequence locations=1-22,44-55,82-120
ggttcgatgaaacttttaaaatatacgcctaaactttttggcctgtttaaaaaggaattaaaaatttttaaaaattttattcatctcccttttgatagaaaaagcatcagagtgccttca

SEQ ID NO: 64139 - DNA, 70 bp, Heterodera glycines
  Genomic contig location: Contig_ID=SeqID_34312; Location=818..887; Strand=-
  SCN-specific regions: Sequence locations=1-16,63-70
gtttcagagcacgttctaaaaaatatttatgaattaattttgcaaaataataaataattaatgaaaaagt

SEQ ID NO: 64140 - DNA, 1317 bp, Heterodera glycines
  Genomic contig location: Contig_ID=SeqID_34313; Location=54..1370; Strand=-
  SCN-specific regions: Sequence locations=1-304,329-431,454-590,612 -653,692-715,755-924,959-1084,1106-1196,1220-1273,1295-1317
atgatcgatgacattttcacggataaaaatggtcaatttgaggctccagtaggcaaggaaacttttaattcgataaaaaattgcaaacgagctgtttatattggattttacactgacaaagcatgggtaagcagcgccaaaaccttaccgaatgccaaaaaatgaaaagtgccgacagaaaatgtttaattttcctatttatttaatggcatttttttttggttgtttttttagcttattattagtcaagcatttttcaaaaaaattttttggtcaaaaaatgacagtcctatttattcaagacttaatttaattttaaaaaaatttagttaactcaaaagttgtattcgcttgcccaaaatacacttgatgccaaaaattcgagtattaagaaaatttatgccaaagttgaaacaaatgattgcctgagatttagcaaaaagttaaaaaccaaggaggaattcatgaacgaattcaaggtaaaataaataaaatacccaaaaataaataaattgaatgtcagtgcttttaaggttagctttgatcaaaaaactatctacatcaacaatgcagaagaaaaagctgaaattaagagcaataaatattttaatgaagaaacatatcgcatttcaagagaatattttgctggtcagttttatttattttttaaataaaaaaaataaaataatttcgctaatcccaaaattataagtccaattaattgattaatttaatttaatttttttttttttttgctattttttatacttccaagctctcgtctagccgaattttttttttacccaccatatcttccacacagatattaagaagtggacaaaaaaattgaaaatatagaaggaaaaaaattatgaatttgaatttttcactgaaaattgcataaagaatttagtattattggtgtataataaaaaataaataaataataataatttaacataaaacaaaatgaattttggttgagaaaaatttttataatttcaaaaaatgaacaataaaatcgaaagtgttatttaagaaaaaagttcaagcgaagaagcaagctcatctgcagcatcatcaaccaagcaaaaatggaagcaattaggaaagatggtcaaatcacttccattgttgggcggaaaggacaacgacaaaaagaaatttgaacagtataaaaagaagccacacgtttttgatatatataaaaaggacagtaggggatgtgaagatacagtaggatgttgtaacgtaaggatgggatttggatggaacacaaagggagttgaacggatttttttcttccgattttcttga

SEQ ID NO: 64141 - DNA, 508 bp, Heterodera glycines
  Genomic contig location: Contig_ID=SeqID_34314; Location=355..862; Strand=-
  SCN-specific regions: Sequence locations=1-60,82-213,235-247,281 -456,496-508
atgaaaatacgccctaaaatcagaacatttcttagaaataagaacataaagaaaccctgcattaatcagataaaaataaattcaaatgaaaacgtcaaccggtatcgaactcctaacaagaaatacggttagtgttgaagcactaaccactaaaccacaaatatattggaagttaacagcaaaatttactttatttcataaaaaatttgtcaaagatggttaaaaattcattgcgggggtcagagtcgcgggggcggggacgggggtgacgggggcggggtccgaactctacttctaattgaaataaaatgcgaaaaaaatgacctcaaaaaattaactgttgcagttgcaaattgagtacatttcaagccttttgagataaagctcatacgattttcggcaaggaaatttttgtaaaagggtcggtgttaggtcgagcctaaaaaagtatcaatgataataataattaaattaattaatattttaattttatttgctgaataataaa

SEQ ID NO: 64142 - DNA, 160 bp, Heterodera glycines
  Genomic contig location: Contig_ID=SeqID_34319; Location=560..719; Strand=+
  SCN-specific regions: Sequence locations=1-160
atggtgcaatatgtcaagggaaatgctcaactgaatgccgacattgtgaacagtgattcgtcaaaaaattgtccacttggagaaccgactttttgggaaaagaattttctgggcaagaaaaaatcatttaaaggatgccataattttcggtgtttggatg

SEQ ID NO: 64143 - DNA, 452 bp, Heterodera glycines
  Genomic contig location: Contig_ID=SeqID_923; Location=1677..2128; Strand=+
  SCN-specific regions: Sequence locations=1-426,449-452
atggcttcggtcgggcaattcgttgttctccgtgcagcaggcgcggtacgctttgatcagtccgaccccgtcgaggaaaatgggccgcaggaaagggtaactgagcaacgcacggccgtccgaatgggccgggggcagaaaggtgcgtttgtgctcaaccactccgatgggttgcgtggtgtagtcgtaaatgatggcctgcctgggcaatttgtcggcacggaaggtgctcggaactgtgaactacggcgtatttgaagggaaactccagttcctccgatgaagaatgccataaatttccagaattcgctggcattggccatgccccgaagcaaaaatgctgggctaatcccccggatgatggaccgactccggaacagatcgtccgcccacccaccatttcccaccaggaataccaaaaaattcaaacttttgaaaccccaaaaaattaa

SEQ ID NO: 64144 - DNA, 412 bp, Heterodera glycines
  Genomic contig location: Contig_ID=SeqID_923; Location=836..1247; Strand=-
  SCN-specific regions: Sequence locations=1-166,190-412
atgcacggatgtttcgtcaccacggtgccccattatttgatgggaatgccgcacgatttgcgctattttctgtcggacaacgaccaccgaccgtgggaccatgtgagtgaataagggcaagggaattgaatgagtgtgtaaaaagcgtcgccggattttgcccttttggctaattaattaacgtcaattagtgatggctttttcttccatattcttttcattctcccatcgcttttttcagtgcgctgagcgtcttcttcagcccttttacgaccacaaagggaacactgtgtttttctcgttgtacaacagcaaaaaccaatgcgtggacagtgtggtgctaatggacgaagtcaactcgagggaccaatttgaggaggtcgaacggcaccagctgagcttcatggaacag

SEQ ID NO: 64145 - DNA, 2560 bp, Heterodera glycines
  Genomic contig location: Contig_ID=SeqID_923; Location=3815..6374; Strand=-
  SCN-specific regions: Sequence locations=1-883,905-1915,1937-2560
atgttgattcattcattggtttcgtgtcccttttctcccggcagatgccgcgtcaacaatttcactgatacggattattcctccgtcccgctgggcttctccatcccgcgagtcaactgcgaaggggtcctcaacaagtcggaatgtcagttcgaaaagtgttcattgggagtggatggcccccgctgcacagagacgggcaatggcttcgtttttgaccgttccatcgtcacttattccgccattgaaagggtttgacatttgcctaactctctctgactgttcatgtttatttttctcgtttttcagtgggaattcgtgtgcgatcggcaatatctcaaggcgatgattcagtcatcgtattacattggtcagatgatgggttcgctcatcttcggctttcttggcgacaggtttcattcattttgtattttgttggccatgtcattttcctttttaccgcttcgctgtcctaggattggacgcaaaaaggtgtttttcatcgccattgtcctccaaattatcggcagttccggcatggcagttgcccctttttggcaaatgtatgccgtttaccgcgcctgtgtcggctttgcccatcctggtcatttaccattattttaaattaatatgtcgaaaataatttatgtatttaggtatttttgtcatcgcagtcatcatcggttgttaatttttttttttcgtttcttttaaccccaatttacggttatcaaaggaatggaattggttggcccaagcaaaaggaaaatcgcttcgctgttcaccggcgttttctttgctgttggccaagttttactcggccttttggctttttttattcggaattatcaataccttcatgcttcaattgctgcttttgccaccattttcctcttttattggtggtgcgtcttttaatccatctctattaagcattgtttattccccaaatcttccttttcttttaagggttgtgcctgaaagtccccgttggctcgtctctcaaaagcgttacgtcgaagctgaccaaattttgcgaaatgcggcacgcattaacaaaagggaacttccggacaaatggtgggacgacattgaggaagaagcaaatggcggaggggaaaaaagggcggatgaatgcacagcacagaagcggacgacgcgcaagcataattacacggaccttttgagaacgccgaaaatacggcgcatttccttcacggcattcttttgttggtcggcttttaacttttctaattggtccccttttttatttgtatttggttttactttatttctcctcgcttttttaggccggtcgtttcgatgctttactacggcatgtcaatgaaggtatgttcgtttacattgtttggttctgtttttctgtttctcgcttatttcaatttttagactgattttctaggcggtgacatgtacatgacattcatttttggcggattggttgaaattccggctctttttttgatgtattttctgattgatcgcatcggtcggaagccaatcattgccggagggttcacaatcgctgcactttgcatgatctcaaatttgttacttggtgaaaaaggtaaagcagttcatttaaattttattcgaataattcttccatccatatttgtgagaaaaagtgtaaaacgtgggaattagatttttttgaaattttctgattgtgagtatgcaaaattttttaaagaatttctgcagcaaggttttgtcccgttcccataacggttttccactaatttatgttttccaccatttcccatgtctttccttaacatcctctaccatttttcagtgaacacaatggtggcagttgcccaatttctcaccggaaaagcttcgagtaccgtcacttacgccactctgtacaccatcacaccggtgttcagtatttcttggcatttcttactgtcttcgttttcttacctaggaactgttcccgaccgtaattcgcaacatggccaccagcgcctgttctgtgatggctcggtttggcgccattttggcctctttgcttatgttttggctggtcgatgaattcggcaaaaatgtggtcagattttcttccacttctttggaatcgtcgcaataaatacacttgaaatggttgaatttttcagataatttatcctttcgccattttgggcatttgtgccgccgccgtcgtcatcatttttttgcccgaaacgactggcatgaagtttcttgaaacgatagacgaagtcgaaggatggacgaagaatcatgaggaaatgcagccgctgtcctctcaatcgctgcagggcacaaaaagtgccagtggcgaaatcaaaacggagtgagtgaacattatttgcaatttttgatcaaattagatttctaacaaaagccggaacttgtgtggtttacctgacagatttcacatacattttcaaatgcctataaatgtattaattttacagtttttttaagcatggaattattaaaagacttcaatattcgagaaattgatagacttcctgtatcaagagtaccctcatgggcaagatgcccatga

SEQ ID NO: 64146 - DNA, 634 bp, Heterodera glycines
  Genomic contig location: Contig_ID=SeqID_923; Location=4449..5082; Strand=+
  SCN-specific regions: Sequence locations=1-634
atgccaagaaatactgaacaccggtgtgatggtgtacagagtggcgtaagtgacggtactcgaagcttttccggtgagaaattgggcaactgccaccattgtgttcactgaaaaatggtagaggatgttaaggaaagacatgggaaatggtggaaaacataaattagtggaaaaccgttatgggaacgggacaaaaccttgctgcagaaattctttaaaaaattttgcatactcacaatcagaaaatttcaaaaaaatctaattcccacgttttacactttttctcacaaatatggatggaagaattattcgaataaaatttaaatgaactgctttacctttttcaccaagtaacaaatttgagatcatgcaaagtgcagcgattgtgaaccctccggcaatgattggcttccgaccgatgcgatcaatcagaaaatacatcaaaaaaagagccggaatttcaaccaatccgccaaaaatgaatgtcatgtacatgtcaccgcctagaaaatcagtctaaaaattgaaataagcgagaaacagaaaaacagaaccaaacaatgtaaacgaacataccttcattgacatgccgtagtaaagcatcgaaacgaccggcctaaaaaagcgaggagaa

SEQ ID NO: 64147 - DNA, 1827 bp, Heterodera glycines
  Genomic contig location: Contig_ID=SeqID_924; Location=881..2707; Strand=-
  SCN-specific regions: Sequence locations=1-1155,1177-1186,1210-1827
  Gene Ontology: Mol. function=transcription co-activator activity; Cellular component=transcription factor complex; Biological process =regulation of transcription
atggtatgtgaaccgaatggcatcgagtttaaggaggagggcagtgagtccgagagttgttgctcttcgattgtccaggtgtacaacagtgggagttgtggaagcaaaaaatggactgtggaagcgctgtacgaaagctgtcggatgaaagtgcgaatgacgggatcgggtttaatgagtgagtgcacacttatgataccgctggaaaatgggctaatactgacaataagtttagtggatgccgaaattatatcgaagcggaaggagccggatggaacatacaggttttatgtgcattacgtggattgtaatcggcgcttggacgagtgggtagcggaggaccggatcgatctcatgtctgttcgtattccccaacgcgtgaagaagtcagcatcacagcaggcaattgctcagtcgttggaccaatcattcgaccaaaattttgcgataagtgacgcacaaaggtaccagaagtacttataaatgtttttcttaaacaattccttcagctcacgtagctcaactcccgaaaaagtgattgaaatgtttcgaacaccgactcgatcactgaccggaagtcgaaagaggaagcacttaggacacaccatcgaatacgtcgatgccaattcaacctcttccgaatgctgtccttccgtcaccacaaatggtctacctaattccacagcaccaagcggtatcactgaacaattgccttctgtgtttcacttcccactatttaagttcccagtttgcgtggttccatgtcaaaggccagtttgcttttcccttaaaataataaattctgacgactaaaactattatttgaatttccaggtcggtcatagtgaagatgcgctcactcggattcgcaatgtggagaaagttcagctgggccgaaacatcattcagccatggtacttttcgccctaccccaaggaaatgacccatttgccctgcatttacctctgcgagttttgtttgacctatctcaagagtcagtcggcactcgccagacacgttgtgagactaattgcccatcctctttaatgtccaaaatttgtgaagaaaaaatgcaacttatattacccgcctggaaacgaaatttaccggaaagattcaatttcattttatgagattgacggtcggaaaaataaggtggaattgaagatctttttgttattctctctaatttattttagatttatgcccaaaatttgtgtctgctggcaaagctttttttggaccacaaaacactttattacgacacggaccctttcctgttttacgtgttgaccgaatacgaccagaagggctttcatatcgtaggatacttctccaaggtacattcttctaaatgtcaaaaatatctatattttgttaggaaaaagagtctgccgaggagtataacgtcgcctgcattttggtgttgccaccctatcaaaaacgcgggtacggccgtttgttgattgaattcagttacgaactttcgaagattgagggcaggacaggatctccaggtagggcattttaaatccgcggcatttcagtaacaatgtgttccagaaaagcctctttctgacctcggattggtactcatttcacattattatttttcaaataacatgaccaattaagctttcttaccgctcttattggttccaaacaatccttgagacaatgctaaaaattgtgagccaacaaggacggcccattccgtcgcagggcgaggacggcgaggaggaggaggacacgcaagtgtcactgtccatcatggacctttgcgagttgaccagcattcgcaaggaggacgttttgtctacacttcag

SEQ ID NO: 64148 - DNA, 1117 bp, Heterodera glycines
  Genomic contig location: Contig_ID=SeqID_924; Location=2909..4025; Strand=-
  SCN-specific regions: Sequence locations=1-1117
atgccatcgtccagcgggtcggaaaagggtaatggacgcaatggcgttcgtggcgaggaagaagtgaagggaggaaaagaaattgctagcaagacacttaagtgagattttggcctttctccttttgtgtattattttacttctttaagtattcaatcgaagcgtttttatttggacgtcaagcaaaatgatcgtggacgtttcgtcaaattggctgaggtcttattataattaatagaaaaaattacaagtaatttacgcacttcgcttgtataccaaccagtatttgactgattgtttcaggttgctatgaatggtcgaaagaatcgtttgttcatgtcaatgcgaatttgcaagaatattaaggaattgttggggaagtttgaggggcacgtgccagcgtcgggtaacatttttttttattgaacactacttgcaagccgaacaaacaattaagaggaagtgaatgggaaagcggagaatgtgaccattcaatctgaatctatcgtgaccgagagacgtcgatatttcatcgaccttcgcgaaaatcggcgtggttcctttttgcggattactcagctcgagacgcattccgggattcgcaactcagtggcattgccatttgaggggatcggccaattgcacgatgcactggactcaattctggaggaatatggcgaagggttcattggttaggcaactcacttctacgattacaaaaactttttccttaagaggaggaagccgaacttccccattctcagatgattcgtactgatgggaaaagctttttttttgatcctggccacaattctcgcggggactttctgaaaatcaccgaggtatgtttgtttgtagctaataatattttgagtaataatttgaacgactaatttagttgaagtcattcatgggagtgcgcaattccgtcgtcctttcaatcagagcaattccgcaattcactcaagtcctctccaagctctacgatgactttcaggagctcagagccgtagaggaagtgaacgtgaacaatgtgcttaagaaggagccgccgaaggaagcgatcaccgattccaacgaagagtcacccaaaaaagagaccaagtccactgattga

SEQ ID NO: 64149 - DNA, 1101 bp, Heterodera glycines
  Genomic contig location: Contig_ID=SeqID_924; Location=4636..5736; Strand=-
  SCN-specific regions: Sequence locations=1-316,338-1101
atggtgaaatgccatccggataaattggcaaagaaagttcagtcattggatgcaccaaagggcgcatataaaacacttattttggaggtgagtgagcactggcgagaatatgcaggaaaaaagtttaatcggtttcatttttgagtaaaaatggcaaaccaatggtttcgtaaaaaataattaagggttacgtgttcattgaccaaagttcagtgcttcataaagaacagcccgattatgtcctgtaccaagaaatcgtacaaatggcacataaaaaatgtgtaagaaatgtcgcttctgttgaacccgagtggatttctgattttgttactttttcatcataattttatttctgtgtgtaattttacaacaaacatttgttctctgtgcaaatattcttttatttttgctttactttttattttttattaattgttttaagagttcaaaatgaataatgtgaccgctaagttgccgtttctttaccgctttctgggtcatcatttaagaaattcaaaacgacaaatagcggtctctccagtagatcttgtacgacaaaaaaatgttttcatgaggcgtgaaatggattttttgcaaccgaccagcaaaatttcttccccatcggctgtttgtatactgaaaaattactttgttacttttgggtttgtcgaacaatctgatgtcggaaaggcggttcaaatagctgaggcaagtcttcaaaaggatatcgtgaattaggtaatcacaattcagtatcatttggatggttctataaatgctcgtctcatcttgacggtgccggagttacgtgaattatatgagtcggtgaagtcacagcaaagtgttctgattgagggacagaaaaccatccagccacttgaaaagtctatcgatcaaactacgatgcgaatttgggaggacatggagtgtggtcggaatcaatttttaggcttgcttgacaaattagttaaggtcttcgtgtgctcagagtaggccattcgactccattttacaacaatctcagagaattagttatacccattttcaatttggaagaatttttggaccgtatggactatgtattgatgagcgagaaataaa

SEQ ID NO: 64150 - DNA, 1592 bp, Heterodera glycines
  Genomic contig location: Contig_ID=SeqID_925; Location=88..1679; Strand=-
  SCN-specific regions: Sequence locations=1-386,408-1592
  Gene Ontology: Mol. function=RNA helicase activity; Cellular component=small nucleolar ribonucleoprotein complex; Biological process=processing of 20S pre-rRNA
atgttgcaacaatatcagcttgacgaagggaacatgaatttactaacttccattgcaagtagccaaaaagaagcaggcaatcaaaagtagttccatgtgttttgtcaaatatctcatatgtgtttcagacacaaaattgaagttgtgaaaaagctgagatgcgtttccggtgaaaaattgaaaaatatcagagcaacatcgaaacaactcaatcacattgaaacggacagcagttcttgtgaagaggactttagtgggaatggtgaacagcaacaacctgggaaaagcatagaacgaatgccaaagttgacgcatcaaattgaaacttgtttgctggcaggaaataacgcgcggactgcacagaatctcccaattgacaaaaacggtattttattttgattaattttctattaattgatcattcaattagcgcattttgagcaaaccattaattcttccctgttttaaatttcagaacaaagatatgaggctgcgtcaaaacaaaataaacagcatgccaaaggacaattgcaatgctccaacgccctttctcgcatcaaaggacgccaaattattgttccacgggacgaaaacattgaaaagaagagacgacaattaccaattaatgctgaggaacagccaattgttgaggcaatcaacgaatatcccgtggtcataatttgcggcgagactggttccgggaaaactacgcaaataccccaatttttgtatgaggctggctacacctccaatggacacttaattggagtgaccgaaccaaggcgtattgctgcgataagtatggcatcgcgagttggccacgagttggacaacgaaaaattggcatcataccaggtgaattacgaatcactaattaattacaatactaattggttatagatcagacatgaagggaatcgaagtgaagagacaaaaatactatttatgacggacggagtactcttgaaagagttgcagacggactttacactttcgcgttactcagtcgttgtcattgatgaggcgcacgaacgttccatttatagtgacgttttaattgggcttttgtcaaggatttgtgcgctcagaatgaaacgcggttatcctttaaaactgattatcatgtcggcaacactgaaacttcaggattttcttcgacaaaggtcaattcactttttttacagtgccaatttctttcttttagacttttttccatcagtcaaccaaaagttgtcagtgtccaagctcgtcagtttccagttacaatttattttgaacggcgcactccaacaaattatttggaagcaacattcaaaaaagtgtgtaaaatccacgaggaatacccagcgggtggcatccttgcgttcgtcacaggtcaacgtgaagtcacacatttggtcaaattgctagaaaacaaatacacaaaaatatctgcatcaaaattactgagaaaagagaaaatgaaaaagtgtcggaagaaagagacaaaagaggaggaggaagagggactactgcttgacaacgacgagttcggaacttcggatatggaccttgaagatgaggcgtggcaaaatacctttttttgggtctga

SEQ ID NO: 64151 - DNA, 1431 bp, Heterodera glycines
  Genomic contig location: Contig_ID=SeqID_7207; Location=865..2295; Strand=-
  SCN-specific regions: Sequence locations=1-376,398-556,579-1384,1406 -1431
agcatttgccgccttctgaagcgggcgcgcaactcgtggagcgtgcactggtcgaagcatcgcgcatttctgaagaaattaaaaggcggccattcggcggattcatcgcttatgaggaagtgaaaagggcggtgacaaatggagacgcaaaagcggagggacggccggcaattcaaagctataaagtttacttacaattagtcagaaaaacgaaacataaattacttaattcaggaatactatccgtacgactttgtccaatttcggagcactgacaatgagcagcaattgaaagtgctcgagtttgatacattcagcgaagcagtggacaaattttactcgtcgatcgaaacacaaaaagcggaacaacgcattttgggagcagaaaaagaggcagaaaaaaaagtgcaggtaatggcaaaataagcgtaacgataaatgctgtgagctgtttgaagaatgtgcgacgcgaccacgaaaatcgtatccaagcattgagcgaagtgcaacaagtccaggaacgccgagcggagttggttttgctaaacaaagaattggtggagaaggcattgtaccttatgaggcaagcgatttttgccttttttgtcgtggacctcgtgacgaattgcattcgtattgttcagaattgccattgccaatatgagttgggcagacattgagccgtggctcaaaacgatagcggaacaacaccccgtcgtacgcagcatttccaagttgcaattgaactcgaaccggttatcttttagcattggtttgtttgcagcccaatctttaaagctttacgatgcgtctcagcgacccggaagaaactgatggatctacttttaatattgacatcgacattgggcttaatgcagaccaaaacgcacgacgcttttactctgaacggaaaatggcaagcgcaaaagaacaaaaaaccttcgcagcttcgaagacagcgctgaaatcggctcaaagccaggccaaaaataaacttaaccaggcaaaattaaacagacgagtcttgttatgatgaacaattggcactttcagatgaagacgaagaaaatgagtacgatccgagcacgcaaaagctattggttcgagaaattccactgggtgagctttgccaatttgtatttcttttggcgttacttaggtcctttcccttccattctcagtttattagttcggaccgttttttggtgctcgccgggagagatgcccaccagaatgagcttttggttaagcgttacatgcgttcttgtgacatttacgtacacgcagagattcagtcagttcggacttcgaactgtattttaattctattcttatttaagaggagctgcttcggttgtaattcgaaaccgcgaccgttccggcgctgaacctccgccacggacgctgaacgaagcagtaattcacagctaa

SEQ ID NO: 64152 - DNA, 368 bp, Heterodera glycines
  Genomic contig location: Contig_ID=SeqID_7208; Location=3074..3441; Strand=+
  SCN-specific regions: Sequence locations=1-368
atgcatcagcgtaaccctctgtcctatgcgcagcaactttccatgtcaacaaatgaccatccagcaatttccggcgtggacttcccacgagtggtattttataattgaattcataatttttttttttgattttcaggcattcagttcttcatggggtggaaggacgggaaattcggctttaattctcgcggtcgatggagatttgctcgttcatgagcttttgctatgagatggcggctatgtctaacaaaaaacgtttatttatttaagcatccagcaaaatttttatgtatttcaacttttattttctaatgcctttattgattgcatttttacatgtaaaataatctcatttgataaatgattga

SEQ ID NO: 64153 - DNA, 1488 bp, Heterodera glycines
  Genomic contig location: Contig_ID=SeqID_7208; Location=719..2206; Strand=+
  SCN-specific regions: Sequence locations=1-746,770-980,1006-1288,1310- 1488
atgtcgtcagctaattcctcttctgcgacagcctcaacatcgggaccaaccaacaaacgtcaaagaatgcggtcggaatgcaatgtttccaatgcatcggttcaaaaacagaatttaggcaataatcggtattcaatgactttccaacttattatggtaactcatcgattttctttaggcattttgccaatcatcgaccacgttatcgccaaccaaaaagggataatcggcggcttttagtcccgggtttggtttccaattgtcctgtcagaattcgttctgctgaactcagtgatttacccgggtttgttttttcttttgccattttctgagccctttttagtttctcatatgacccaattacgaagaaatactaccgaattttggagaatggtcccggacgtgtaagtcaaaattcgaactacacacatttatgttatgttcttaagcccccagggtcaactctccaacatttacgcaatttagccgtacgagccggaaacacagagacatcatcgaattctgcaacttcctgctttaagccaaacaggaaccagtcagcggatatttccaatttgccaaattatctacaacaactccaactcggtcctggcggtagttcgaccacgagaagaaccgggcgtttcgtggaggaaaggcggcttcgtcatgttaagcaacagcccagctatagctttgaggtgagttctgttattttattggatcgggtgggttactcccgttgtatcttttttatgctttatttttaagtaatcgcttttaaacaggtttccggcacttggggtcagcgcttctcgagttgccaatttctggacgtgtcggaggatggacgaactttgattggatgctggtgatactttttcagaaatcactagcacctttttttttgtaggacttcagagcaaaacaatcttttcgaggggcactgttctcgtgtgctatccttcggcgtcactgttgacccaaacacagccaaaaaagacactcagcgaatggcactcgccgaagatgttggggacatggcatcactgttggactccaatgggaaataccgctgcaacacctatgggtttttggatgcgaatgcttatccattttttatgctattctctttcagattgtgctttgagccaatagacaatgagatttgcttgggctcttccaaccgaattctcattgacatggtcacttttttttaaaattaattcaaaatttcatttcgttttcggtggtgtaatagcacttagaagtctctaaaattaattcaaaatcacaaaattcttttttgaggtgcttgccccggctgaccgtgacgtcacttgccttctctttgccactgctcgttctttttaccaggaacaacaacattccgtcggatcttgtccaaaaattgtaaccaaatgcacggttaacttgcgtcccattgaattcaatctttcggaggaggtaaatgttctatcagactaa

SEQ ID NO: 64154 - DNA, 374 bp, Heterodera glycines
  Genomic contig location: Contig_ID=SeqID_7208; Location=1..374; Strand=-
  SCN-specific regions: Sequence locations=1-374
atgaaaactaaattcgcgacatttgatctttgtgcagctttgcacgatttgcgcgcttttgttgggatgagagttgttaatgtctacgacataaactcgaagacatatttgataaaattacaaaggttggtctactttaattcttatctttttttgaaatttgtcaggcccaacgaaaaagcgttcattctttttgagtccggcataagaatccacagcaccacttatgattggccgaagtcgaccattccttccgggttcagcatgaaattccgaaaacacattaatacgcggcgtctcacccgctgtttctcaggttggatttgggactgacaatcagtcccgttttacggtgcttcaggttggtgttgatc

SEQ ID NO: 64155 - DNA, 379 bp, Heterodera glycines
  Genomic contig location: Contig_ID=SeqID_7208; Location=3555..3933; Strand=-
  SCN-specific regions: Sequence locations=1-124,147-379
atggtgttttgtgtgcctaaaactgtggaacgacaattgccaatgggaccactggttcgaataacgaagcgattcagctcaaatggaatttcgtagcacaggtccctggccattacaagcccttgggttttcccgggcctgggtttttgtccagatccaacttagaatccaagtccagggcttttcaaattgccgaactcacaaccaacatttaataatttccagaatacctctgcaactggcgaccgaaaatacaaggaacaagattctatgacttatcatttattcctgaactctccttaggctaaattttacaacaaaaaaacggtgcttttttctggtcttatttgaatctattttgggggaattccttaataaa

SEQ ID NO: 64156 - DNA, 307 bp, Heterodera glycines
  Genomic contig location: Contig_ID=SeqID_7208; Location=4411..4717; Strand=-
  SCN-specific regions: Sequence locations=1-203,238-307
ctccgaatgtgtcatttgcggctccaattcgtttcccttgggcgttcgattgcgcgactgcacccatctcagctgcgttcaatgtttcgtcgcatatgctgaagaacttttgtcccggatgagtctaaaatggcacccccaagtcggttacaccgtcggatgccccttttacgggtgcaccggtaaaagcgcttaatttttcgctttttaaattggcatttttccattgccctttttgtttcacaattccaacgcacttcagctgtcgtcaccgatgttcacactttgtatttgctgggcaagcctt

SEQ ID NO: 64157 - DNA, 1529 bp, Heterodera glycines
  misc_feature (891)..(891): n is a, c, g, or t
  Genomic contig location: Contig_ID=SeqID_34322; Location=78..1606; Strand=+
  SCN-specific regions: Sequence locations=1-322,344-495,517-869,891 -946,1052-1238,1262-1529
ttaaatctttgccattgcgctgctccgaagaaatgaacggatcgcccacaaatttctcgaaaaatgagaaaggctttgagccgatggcggaagtgcagctgctgaaggacgacgatcaattggtggtggaggagcgatgttctgcgttgtggaatgagatcaaggacgccggggtgttggacggggccgaattatcggcgagttttgacgaatcgatcggttgattgattgatttattaatgtggggatgttgcgcgagagaaagacgcggagagagagggcgatgaatctgatcagcaaatctgaaaagggcgagggaagggagtaaatatttatcggatcagcgggggaccggacgggcagcaaaaagtgcggaagcaagaaggaaccgatcaatgcaaaaggggattaagcggctaacggcggataaattatctgtcgataaatgagaaatgacattgctaaaacacattcctaaaatatttgctgattttctaattcctttcagaatgcttttttggctcagctccaatcggaaagtgaccaattggacgaacaggttcagaagctcgcgcaaaagtcggagacattggcagcgaatgcacagctcagactttgttcggtttggacagcgttggaggagctgaagcggaagaagcagcgaattgcgggggaaatggggggttagtggggggggggtgatcagcaggaacaggcgggctgataagaaatgggaggaaagggaacaaatgattagtggaagagataatgataatgatcaaagagaaaggggcaatgagaaagtgatcggataaagtcaaatcatcagagagaatgggagagagagagaagagagaaataatattcaatggtcagagaggaaagggcaangagagagtgatcagaaaaagtcaaatgatcaaggagagtgagggaataattaaacagggaaggataaagaaagagagagagataaaggtaatgatcagagaggaagaggcgatgatagagtaatcagatgagcagaaagaatgggagagagagagagagaatctcatggaggaaaggacaataagagagataatgataatgatcagagaggaaagtgcaactagagagtggttagaaaaagtcaaataatcaaggagagtgagagaataatcgtagagaaacggataataacatagataaagacgatgatcagaatgtacaatgagatcgataatgataatgatcagagagaaagaaggaagagaaaataatcaaaaaaatttaaattagagagaatgggggagtgattcgtcttccgttcaatttggcactgatttgttttcccatcgccacagattttcaccaccaccgaccacagattggcgctctccgcctcatcaacagtttccggaaatggctgaaacagaaggaggcgcaacagagtcaggtcaagcagcgcattgcccactcccacgacagtgagtcgtcattgcgcgagttggagcaggaacaacaagagcggaacatcattcagcgga

SEQ ID NO: 64158 - DNA, 245 bp, Heterodera glycines
  Genomic contig location: Contig_ID=SeqID_34323; Location=129..373; Strand=+
  SCN-specific regions: Sequence locations=1-245
cttcgtttactccattcgttaccttttcccaatgctttcgtcccatcatcgcgaatcacttctcctccaatacggtcattcgcaagtgctttactcggacgaattctgcaaattgaccgacgaaattctgatcatcaaaaagttcttttttggcactctccggccaaaggttgtgctgctgaaggacattcgcgtggtgtacttcgacgagcaaaagaatcagcagaagaaatacgcacatcgcc

SEQ ID NO: 64159 - DNA, 49 bp, Heterodera glycines; identical to SEQ ID NO: 57477
  Genomic contig location: Contig_ID=SeqID_34327; Location=593..641; Strand=-
  SCN-specific regions: Sequence locations=1-49

SEQ ID NO: 64160 - DNA, 1469 bp, Heterodera glycines
  misc_feature (7)..(7): n is a, c, g, or t
  misc_feature (22)..(22): n is a, c, g, or t
  misc_feature (39)..(39): n is a, c, g, or t
  Genomic contig location: Contig_ID=SeqID_34328; Location=80..1548; Strand=+
  SCN-specific regions: Sequence locations=1-158,182-392,414-711,736 -862,884-924,954-1027,1049-1469
atgacanaaacatggatgcatncagacgaaacgaaggcncaacgtttcaaaggcaacggacgactttttgtgacacctgaaaaaatggagaaaatatttttcgaaatgtgtgaacgcttttggtccagcgaaaattatcatgagcaaaaagcaaattgcttggattttgttttcaattttgtgaacacattgtgcgagggaaacgcaccaaaaaagacggtaaatttgcgcaaagggacggacatttggacaacgggaacggacatttcatcaacagggacagcatgtcaatgcaaataaccgagaaaagattagacttggctaatgacgagttgtacggggaaaactttgaaaatttggagataaattctaaggagaaacaaaaaatatttgagaaaaattcaaaaatttctgagatatttgagatatgagtggcccacataattttcaaaatttgagtccaaatttttcattacaacattttgttcttttaagttatggcctgataattttattgaatttgataaatttatgtccagaaaatatgaaagaagcagctttaatttatttgatcccacatttcctcaatcggcgctcgataggaaacccattaaattgccaggtaatttttttcttttttggttaaatatttgaattttaaataaaacgatatatttacgactagtgatggacaatacgccgccgtggaagttttttaaattttatttaaaatttggacagatttttcattacaacttgggcttagggtcggtttttggctaattattaaaaaaaagaaattgtaatacgtggggcccggcggtgccgcctcagaaattttaatcttttatgtgcgatttcaaaccacaaactgaaaaattgatcaggctacgagccttatatattacatcatttattattgtcatttattatttaaaattaaagttataattgatacaaattgtcttttaaaataccacaaattggaaattttaatcaaaaatacgaattgcaattcaaacaaaaatgaagataataaagaagaaaacgaagttgctaactgttcaaattttgttttgctgcacacaactggccattttgataagccaataaaagaggaagaggattttgaaaatccaattttaattcacactttgccagaaaaaacggtgcaaaacggcaaaaacattgccatacaattcattctaaaggcatacacatgcaaaatgaaaagcagcaaaaacggtcaaacaagaacattggtcactgagttaaggctgatggacgaaacggtcagtcgaatacagtacattctttagttactgtaagaatcacaaatatcgaaaactgatctatttaagcttagaaatagaaaaatagtggcgatggcatggcaaaaacttacagtaggaaaagaccaaaatttttttatcgctgggcactcacaacctcaagaaaacaaacagaaa

SEQ ID NO: 64161 - DNA, 950 bp, Heterodera glycines
  Genomic contig location: Contig_ID=SeqID_7209; Location=149..1098; Strand=-
  SCN-specific regions: Sequence locations=1-241,263-363,433-554,577 -695,718-950
atgaagttggatggaatcggatctcagaatgaatggctgtcaatgttcagtggggggggggactaacattttaaacgacagccaacggaaaagcaaatgaaagcgacggaatggcgggggggggggggggggtaatgcaaaaagggaacagagaataagttggaagtatcgaataattgagtgatgaaagcataacaataagaattttaaaatcgccccgggtggcgatcactgatcggtgttcttttttccattccaaaatcgattgatcacagattatatggccaaacgtttgctgcccaaaataagatcaatacgataaatgcgcgtgaacggaggggggggggggggagacgttcttcgttcatctcacatttcaaaaacattttaaaatgtaaatttaatattttagatattaaaaaaacatattaacagctgacagttaattaatttattaatatacaatacaaatctctttcgttttgcatatgacaactttcattaggcaaattatgtggagtgcttatacacgattttttcaggtcagaaagtaaattaaaaatgtcttttttcataatgttcctacgcaattctcgaacctaaatggatgactgtttaataacgaatattgaaaagcgattaactagaagtgaaaagtgctggtaaaaacaaccacttattaagtttactcaagcttatttttatattaaatctttaattttcacaaaagctttgtcaagtaattagtcttaaagcaggaaattctgaacaaattctgaaagaaatttctttcatggcaattgatgtgccaaaaaacgaataacaatatttaaatgatctacattttatctttttaatgaaaagcactctttttgatattgcatatgacaacactcatccgaagaattataagcaaattttcacgcaatattttcagttaagcgaataaa

SEQ ID NO: 64162 - DNA, 1884 bp, Heterodera glycines
  misc_feature (4)..(4): n is a, c, g, or t
  Genomic contig location: Contig_ID=SeqID_7210; Location=1668..3551; Strand=+
  SCN-specific regions: Sequence locations=1-125,147-431,546-801,825 -1582,1604-1615,1641-1707,1735-1832,1855-1884
atgngagcaaacgtttacattggcagtgccgaattcagagaattgccaacggatgagcgaatgaaataccaattaaaggtggggaaatgccgattctgatcatgggaagcaaaaacagcaaacaaaaggtggtgccggaggagcagtcaaatggcatttgcatatgcgaaatgaatcggaagtgcggctgtgttcaggcaaacgatcggctcaaaggggctcttagtctgatcaaacaatttcccggggcattccgccgtttaggtcgaaagtctcggccttaattagtgtcccattaaaggcttattggtggactcattaaaaggttgctctttgctttaggtccattcagaaccgttttccctgctgctgccaaattcgtcgtcctccgatcagtccgatttcgtctcccttttgcgtccctccgtgccctttttctctgtgccctccccctcctcccactctttcgccctccccccgcttcttctcgcctgtctctttctctctctcactctcattctgctggccatcattcttctccttttggtccttcgccgttctgctgatcaatcggcggaacgcaaacggcgcattttattcattttcaccgggtaaataaaagcaaaaataataaattgggcaaaatttgtcgattgcacttcagaaaacaaaaaaatgtggaagaatttggactgatgagaagaaaagaattcggcgtgaacatttcgttgcacggatcgcaaaagaaattggagtcaattttattggtaattacctaattaacaaagcaaatgccgtcgaaggaagggaaggaaggctcgtcgcttcaccttctcttcccaaggtgaacgcccagccaaaccgccgcaatgaattggaacgcgtcgcgagggttttggtgaagaatggcatccgcgtgttctacgaccgatgggacagggaaagcattgagcgaaatttgcttggatgggttcaaaacgcggtgacaaaggcgactaaggtcggtcgacggacaaaggcaaaggcggggaattcgtaggaaattcgaaagattcgaccaataaatctaatttatccgtccttttgcagattgttttgttctacgacagtcgtgctgaacaactgctgctggttccctgcgcaggacaaaacggggatttgttcgatcgcgtgttctgtgcacttcaccaacatttggacctcaaaaaaacggttcgaatttcgaacaaagcgcaatatgaccaattcgtcagattttcatcaaatgggacgagtccaaattggcggatggacggccgttgtctgcttttctgttggcggagaatgtttttctgtttcggcgcgatttgaaacaaatttttgccgctcttaacgtgacgatcagtgacactgaacagagagacattgaggtgaagtgataaaacaattttttttggtgattaattgttcagcgtgaatatgaaaaaatgaaagtgattggaaatccgaaggaaatgagagaggaaaagcccaatgaacggacccatttgctgagcgaatttgaagacgaacacatggcgaagaacaacggcggggggcaatttggcacaaaagaaacagtgacggcaccgacagcggaagggggaaaaggggaagagggaacggaggcgagcagtaactgcaacacaacaacaacacaatgggggacgacagggatgagcagtgactgcaacacaacaacagcagcagcagcgcaattggagtggcataatgaagcggaggaacaaaggacaaagaatcagctggcaaaaggaaaagaagaaggtgattctggagtgattgtgccatgaaattcaaaacaacaatttattttttatgttggttaaaaaatacaatcaaaaagaa

SEQ ID NO: 64163 - DNA, 237 bp, Heterodera glycines
  Genomic contig location: Contig_ID=SeqID_7210; Location=4034..4270; Strand=+
  SCN-specific regions: Sequence locations=1-237
gttcgagtgcggcgatatattcgcttggcatgtcacaacgaatgtgccaaagaatgtgcgagacatcccggcttcgaaagtacgtcaattgttgaaaatggctttcattgggtttgtgtgcgaagtgtcgccctccccccccccctccatttccccgcttctgtcctaaatcgaatgttgggcaggtcaatgctggccccactgcacgaagtactgcttggactacgcggcaacaca

SEQ ID NO: 64164 - DNA, 49 bp, Heterodera glycines; identical to SEQ ID NO: 51181
  Genomic contig location: Contig_ID=SeqID_34334; Location=356..404; Strand=-
  SCN-specific regions: Sequence locations=1-49

SEQ ID NO: 64165 - DNA, 73 bp, Heterodera glycines
  Genomic contig location: Contig_ID=SeqID_34336; Location=525..597; Strand=+
  SCN-specific regions: Sequence locations=1-73
tccaagtggggaattgaacccaggcgaaaaattatgaaggtagaaagtttaaccactacaccacatgttcatg

SEQ ID NO: 64166 - DNA, 56 bp, Heterodera glycines; identical to SEQ ID NO: 52733
  Genomic contig location: Contig_ID=SeqID_34337; Location=232..287; Strand=+
  SCN-specific regions: Sequence locations=1-56

SEQ ID NO: 64167 - DNA, 149 bp, Heterodera glycines
  Genomic contig location: Contig_ID=SeqID_34339; Location=565..713; Strand=+
  SCN-specific regions: Sequence locations=1-149
ggaaagccggcacattgttatccctcagaaggcatttctctcaaaaccatccattacgatatttgctgcgactaattctcttattcgataaattctctaaaccattcgtagtttttccctggtttcttaatgatgaactttgttttcca

SEQ ID NO: 64168 - DNA, 726 bp, Heterodera glycines
  Genomic contig location: Contig_ID=SeqID_7212; Location=629..1354; Strand=-
  SCN-specific regions: Sequence locations=1-90,112-198,220-236,260 -266,326-518,548-621,669-726
ctaccgtatttgctctaattatcccccatgggggattatttttcaaccccctcgtatactgggggataattggagactgggggattatgatagagggattatttttcaaacgcctcctagactgggggattaatggagattgggggattaatggagattgggggataattagagcaaatacggtatttaaacacaaataaacattttactcatcaattatatggaagtatttaaatttttaccactacaatgaacaaaagtgttggtaaattattataatatttaaaattactactattttattaagtttttaaatcaaaaatttgaagggttttccattttttttttaatagattaagccattttgctcctagaatttcaagccattccatttttggtttttgtttttttaattttagtatttcatgccgttcatttttgtttaccttttttttgttgcatttccgcccatagatgacaaaagatatttgtgcaaaaaaattagaacaaaaatggcgaatttttatattattctttttaatttaatcattgagttttttgtggatcgacctagcaccaattagcttaagtagactaattcataccggatattttctcaagaatattaatttaaaaaatctattttttttaaaattagtaaattatttcaaaaacacgcaaaaaataatttattttcattttttggtatttttcaaatttaataaa

SEQ ID NO: 64169 - DNA, 479 bp, Heterodera glycines
  Genomic contig location: Contig_ID=SeqID_7213; Location=700..1178; Strand=-
  SCN-specific regions: Sequence locations=1-27,52-452,476-479
atggaccgtgcccgacaggtcgcgagcgatgcctgggcggtgccagctgccaacagggtcagtgcaagtgcccgcttggcaccgtgccggacggtgtccggtgcgcggtggtcacccaagttggggccggccagccatgctcggccacgaatgtgtgcaccaattttgccgtctgtgtccaaggcgtgtgcacgtgtccgtccccatttgtggcacaaaatgggcaatgcattgtgagtttttttaacgaaaaaatgaaaatcaaactcaaaaaatgccgaaaatgggggggggaaatgaaaacgacagaagtttggcacacccctgttgtatggcattatgccaaacattttttggtttcattttattatttttttttctctcttaatctaaacataaaatattatattttagcggcctgaaactgttttggcaggcgcttcttgcggtaaaataatgaaaatcctttaaaaaataaa

SEQ ID NO: 64170 - DNA, 1058 bp, Heterodera glycines
  Genomic contig location: Contig_ID=SeqID_7213; Location=1783..2840; Strand=+
  SCN-specific regions: Sequence locations=1-146,168-209,246-283,305 -388,411-615,637-856,879-887,909-1058
atgcacatgccctgctcgcatttggagcctccaccgcattcaacggccggggaacaggccgagtttggtggtactgtaacaacaatacaagggaatacagtatcacgaacagtgagtgacggtgtcagcaaaataatgcttgccattttttaaattaacaaatgattttttcgccgtgtttgttggtaaaaatcttagaaatttataggaaaaaatttttttgaaaaaatatttgaaaaatttatcagagatttttttgaaaacacttacgaattcatcagaaaattttgaaaaattgaaaattttttcttaagcttacttataaaaatttttttttaggtgcttcttgaaaaatttctgtttgaagccaaaaatgaaaaatggcaccatataaatatggaaatttcttcggtagccttcctctccccatttccacaaattggaagtgattggactgatcacctttcctgatcacccccaagcaatcgattctaattataataatcctcatgccgtgccgtgcccacctgtcattttggtgacacaaacatcgttgagcgcactggtcccggtcgggcacacgcacgtgccgtccatgcaggtggagccgccaacacagcgctcaccgcgcacgcacgagccaagcggcgcggcacgcactacagtagaacaaatgattaattacagtaaattagagtcgttatggtacagtaaccgcgacggttttagcgagcgtcaaaacttaaaaatcatatataccaattacattaatgttataaagttaattttaaggatatgggagctattacataactgattttaaagttaaaggttgtattgcataaattacagaaaatttgttacagtattttgtttaccatatgagtgactacaaaattatagtaacccgaattataaaaaattattatgattaaatgatgctttttcccttctcggaacacagaagagacgccactgtttccattacagtaaattagactagagtatgttacagtaatcggtcagattacaaattacagtagaaaccaatcttttta

SEQ ID NO: 64171 - DNA, 1510 bp, Heterodera glycines
  Genomic contig location: Contig_ID=SeqID_7214; Location=340..1849; Strand=-
  SCN-specific regions: Sequence locations=1-86,129-183,217-427,460 -460,483-535,560-633,711-783,821-916,1088-1252,1274-1291,1313 -1332,1374-1510
atgccaatactcacagcaatgttctgccgaggagcccggggtatgaaaacatgttttttttttgttgaaagattgcgttaatttcgaaaaaatatttttcgtttaattactttttaaattaaataattctgaaaaaatcggaacgaaattggcacatttatcgtcctcaagagtctcgtgccgaaaatataatatatatatattaatctaaaaattgcggccttgaaggcattttgccggcaactgacgtgccaatgtgtgtacggcatgcgcgtgtcgcaggacgggcacagttgcattttctccgaccgtaactgtaccaggcgtggcgaaatttgggtggccgaaattggccaatgtcgccagggtcggtagtttttcgtttcagggcaaaagtaaccattctttcctgttcacctgcccctagtaaaaatttaaaaataattgaatttaaaatttgctttttcaaaaattttgaacaagaaaaccgaaaaaaataggagattttctcttgttggattttttaattttctggattaaaaaaaaattttaaatttttgcatttttcaagaaattttccaaagaaaattttttagatttaaaaaaattacaattttgcaaaaatgtttgtggttttaataatttttgattgatttttttttaattttaaaattatgccaatatcattttttttttttttgaaatttttagcaattttgcccggggctggcccatgttcacattcaatgcaatgttcggctgttgtccaagtaattaatgttgtaaattttcaattttattttacataattattatttatgccttttgagggcgcccaatgtttgctggaacagtgcgtgtgcccaaaggatttgcctatggccactgacgggacgtggtaatgaatcaatgactcttaattgggcaattaataattaatcaatgactcttaattgggtaaataattaattaattattgcccatggccactgacgggacgtggtaattaatcaaggactcttaattggagcaattaattaattagttattaatcaatgagccttaattgggcaaataattaattaatctttgcctgtggccagtgacgggttgttgtatttcattagtgtgataaatgacttaattcgataattaattaattgcctttctctcccattaagtggcacgcaatgccctcaaggacaaatgttctctggcgtgaccggaagctgcttaccaggtagagtgtgcttttaaatatttaaatttgaatacgaaaattgatgttttaattcatttttattctgctatattgggttccatcgtttagggttattttgaattttttaatttaaattaaatatttaaattttcagctgttcagcccggcggcgaatgcctttactcaagccaatgccatgccgtttacccgggaatgctgtgcagtctgagccgttgccggtgcccgaataatcaggcacccttttttgcaacaattaattgcctttaa

SEQ ID NO: 64172 - DNA, 1262 bp, Heterodera glycines
  misc_feature (1245)..(1245): n is a, c, g, or t
  Genomic contig location: Contig_ID=SeqID_34345; Location=135..1396; Strand=-
  SCN-specific regions: Sequence locations=1-228,250-378,400-508,530 -821,870-954,993-1169,1196-1262
atgttttgttctttttcgaaaactccttttcatattatcattcatttttttctaattcacatttcgaatgcaatttcatcagtgagttaattaacagttaattaattggtcgaatcattttttaattagggagacgacaaaatgctaattgcatttgtgagaaatgatcagaaaatacaaatcagtgaatattcaatggaaaaatatgagatacactttggcattttgtattatatgagaaagaattggaaatgtgtaaaaatagcaaaagaatttgatgaaaatgaacggacggaatgccaaaaatatcgcaaatatttggacattttgtacgaatatttgtgcagagaatacgccggaattcccacagtgaagccaaaatttgtatttaaaaatgaaattgaatttgatggcctaattgaaattgaaggcccaataatttatgcggtgaattgtctggccaaaatttcgcaattttattttcataaatacagtgcggtgatgatgtataaaagaaaattaaacaagctcttcacttatcattttgaaccaaaattgttaaatgagcatagattgaattataatgtaaaattggtcaacgaaaaaccaaaagtgccaattaacgaaatgattttacaattggcaattgacacagcttatgggtgccaaacaaatgaaagtgtcgacggaatattccggcagaattttaacgaaattttaggggaaatgtttaaaaaagcggaacaacgggcaaaaagggaagataattatggaattttcgttacgtatgacataattgtccgatcgatttttgatgattattttgtatgggtgagtcttttaaaaacaaattgttttaattaatgccaaaattaagactgatgatgcaatttttactgaatttgtgaaaggtcaagagacaaattttgagaaattttataggatgcttaaagaatattattcaaactctgtgaaatcaaaggaattttatttacaacaatatggggccttttttggtcttatgtatttaatgagaaaaaattggcaatgtgccaaagttggagaggatttaaaagaaaagtgccaaaaatacaaaaaatatttgcatattttgtatgaatatttcttcagaatatctgccgaaggtttttgctttccatttaatgatcatttaattaattaataaaataattaagcaaaaaacccaaatatgacaaatcaattgccagcggtaaagcctgtttnttgaatgcagtaataaa

SEQ ID NO: 64173 - DNA, 578 bp, Heterodera glycines
  Genomic contig location: Contig_ID=SeqID_34350; Location=206..783; Strand=+
  SCN-specific regions: Sequence locations=1-578
atggtgcgttttgctgggcttcgtggcaccacatttattttactcgatggaacggaacttcctctagtcgggcttggcacatatggattgttgacccaaaatgacgtcgatgttgcagttgatacggcactattgagtggttatcgtttgtttgacactgcaaattattaccagaacgaattggagttaggaaacgcttttaaagttaatgagcattttttgtttcaatggtttatgtatgactttattttcagaaattattgcctaagcataatttgaaacgtgaagatgtttttattgtgacgaaggcaaacattcgctcacccaaggttgaggaaaatgcaattgcaatggttgaacattcacttcaatctttgcagacagagtataattatatattagagttcgacctggacttggatctagccctgcaggctcacatctccaggctattttgcagcaacaccaatttttgtcagaaaaaaatccaagcctggtttttttttctgaacctgagttatcctgaattttgcgcagtaaatccagactcaacctgggatccagtccaggctttttag

SEQ ID NO: 64174 - DNA, 2714 bp, Heterodera glycines
  misc_feature (17)..(17): n is a, c, g, or t
  misc_feature (59)..(59): n is a, c, g, or t
  Genomic contig location: Contig_ID=SeqID_7215; Location=1..2714; Strand=+
  SCN-specific regions: Sequence locations=1-750,775-906,928-1160,1182 -1707,1729-1872,1894-2106,2128-2714
  Gene Ontology: Mol. function=cholinesterase activity; Cellular component=synaptic junction; Biological process=synaptic transmission, cholinergic
ccgtccttttttggatntacggaggcggtaaaaccttaaaccaaaaaatcataattatntaaatgcaatattaaatttgttaggcttttggtccggcaccgcctctttggatgtttacgatggcaaaattttgtcgaggtacataacaaatccgctggtgtttttggccgtacgtacttaaatccccttttgtccagtgaagaggatgtccattgtggttacggtaaattaccgggttacggtgttcggctttttgtatctcggccagagaggtcgttcgagattttttgtgtttaaccattcgagaattaaagctcattttggccaggaggcgccggggaatatgggcttatgggaccaattgcttgcgctcaaatgggtgcaccaaaacatcgaatgtttgcctttgatttccataattgagacaatttatgcctttgttcagctttcggcggtgaaccggcacttgtcactctcttcggcgaaagtgccggcgccgcttccattaacatgcacatgtctgttccgttgttcaattttagtaaagtctccatcaattcacttttaaaggctttcgccccgttcgcagccctttttcgcgcgtgccattatccaaagcggaagtgccacggcaccctgggcagtggaaaacaaacaggtggggggggggggggaagtcaatcggaagtccaaaacgagtgatcactactgctgatcagcaaagtgctttatgaatctgggccaatttgatttattattttacttatttattcaaagtgcaattgtttcttaaggtggcattgcatcgggcggtcattttatacggtaattctaattaatgataatttgctattaaatattttaatcaccaaaatggcacagattatatgaaatgcggcggtgccaaagagaaaatgtcccaattggcgcccgaggcgtggaatttggatgccgttttggagtgtttgctgaaggcatcctcagaaaggcttcgtgacgcggaatggagccccgttatggaatttgccgactttccatgggtacaaataatatttttaattattgcctaaattgtttggtggttttcctgccccttttcgcccatttaggtgccggtcatcgacggcgatttactcgagcaaagtgtgagtagttcactcaaacagggcaattttaaggtaaaatttaaaggatggaccatttttaccattttgggctaattataataattaatggatgtattattattttctgcaattaaatgcttttcgaatattcgttctgttcagcgcactcaacttctcgtcggcagcaacaaagacgaggccatttatttcattgtttaccaattggccgacatttttcccccgtcggaatttttcagcaaaaagttgggagacaattaacaaaaaaaactattaaatttgtttaatttctccagggaattcatcacaacacgtgagctgtggctgaagagcatttccaaccttttgccccgccaaattctcaaatcgtcgctgagtcttcaggccatcgtgcagcaatacgagccggacggggaattgccagtcgaatggtggcaatgggtggacaggtgggaaagggggataaaggggtaattaagagcatttgacgatggggaaatctttaattaatcagaccaattaagggcattaggggggggggatgttccttcaaaatgaccattcctttttcagtttggacaaaatgctcggcgatttgctgttcacttgcaatgtcaacgaatttgcgcttgcccacgctgagcatggcgcgcccactttttattatgtgttttcccaccgcgcttctcaacagacgtggcccgaatggatgggcaagcgaacttcgaaattcaaatttggatttgaagtcattgggatttgtccacaggtgttttacatgggtacgagatcaacttcatttttggcgagccgtacaatcgcaagcagttcaattacacgcgggaggagagggagctcagctcgcgctttatgcggtcagaaattcaaataaattcttaacaaaattacatttaatacatttttctcgaactatttgattttctactcctaattggaattatttccttttttgaaggtcggccctaaaagtgttatccaatagatatctccgcttttggactaaatcactttttaaagatattgggccaactttgcccgaactggcgacccgaatcgcaacgcggacggctcatacactggtgggcatttggcaattagggctaattaggaagaatgactgtggttaaaaagcccttaaatctggaaaaataattcagctgacacttggcccacttacaacacgaaaggcatggaatatatgaacctaacagtcgagtcggactactcactgcgaggggcacgacggattggcacgggcccacggaggaaacagtgcaaattttggaagcagttgatgccgaaactgttgctcctctccggtatttcaactgttacattatcccatggattaatttaacaatttggcacttaatttgttctcatttgtcagccgatcttggtgagtcgttcatccgatggaagcagcacatggagcgttgggagcaggagtacatggcggactgggaagcggccatgaaccgatggtcgcgtttccaatcgtaccgcgacagagacatcgccgaaagcatcgatcagcaggggacatgc

SEQ ID NO: 64175 - DNA, 132 bp, Heterodera glycines
  Genomic contig location: Contig_ID=SeqID_7217; Location=13..144; Strand=-
  SCN-specific regions: Sequence locations=1-132
atgggcacaatggaggtgaagaaattggcaaaaaaaagttaccgttatttggcaaacggacaaagagccgaggagaaagcgcaaattattgtgcaagtcgtggcggatgtacagcaaatgcaggaagtacag

SEQ ID NO: 64176 - DNA, 420 bp, Heterodera glycines
  Genomic contig location: Contig_ID=SeqID_7217; Location=889..1308; Strand=-
  SCN-specific regions: Sequence locations=1-420
atggattgggtaattaaaaaggcccttttgcaattaccaaacgaaaacgatggtgccaatggccaacagttggcgactcgaacggacattttcggcgaattggtagcgctggacgagcgaatgtttgttgggcagccgcgtaaaagcgtagcagcgttggttgtacaacagcaaagtgacgaaaacctttggcaaattggaaaacggaaaaatgaaagaattaaaattaaaaaaagataccgtaaaacaaacgacccaaatgaacaggcgtactgtaacatcgatgatatggtacaggccgtagaagtcgcctcggaaagtgatcacgccgttgttgatcagcgagttgttcagctcactgccaatgtacagcccgatcagtgtggacatcaccagctgatcagtgataatttttcataa

SEQ ID NO: 64177 - DNA, 105 bp, Heterodera glycines
  Genomic contig location: Contig_ID=SeqID_34358; Location=156..260; Strand=+
  SCN-specific regions: Sequence locations=1-105
atgatgagacaaatgtctattcgccgtggaccgttcgtgtttggccgggttccgctcacctttaccttccagtccgaagttgccaggcgtgtagtcggcgaaccg

SEQ ID NO: 64178 - DNA, 360 bp, Heterodera glycines
  Genomic contig location: Contig_ID=SeqID_34361; Location=540..899; Strand=+
  SCN-specific regions: Sequence locations=1-360
atggcacttttcgtaaatggacattcgaaattggagcaaaacgactcgcgagcactcgcacttggcactctcctcgttttggtggaacggtggtcagtcagagattggcgcttctttttcgactgtaatcaatgggcttaatccagcgaccatttgcacgaaagcataagggaaagactaagtgtcgagtctttgatcagacatttggacaattcggacgaacgcatcgccctcagttcactttcgctgatcaatgccatttacgaattggcagaccgaggcgaaagacttacgattatcaaagtgattggacggaaaccgcggggattccgacggaaaacgggaaaaagggcaacgaaa

SEQ ID NO: 64179 - DNA, 1335 bp, Heterodera glycines
  Genomic contig location: Contig_ID=SeqID_7220; Location=1997..3331; Strand=+
  SCN-specific regions: Sequence locations=1-21,112-138,162-366,389 -771,793-829,851-1230,1255-1269,1294-1335
atggcgaaacgtcatagaaccgaaaagaaagagggagaagaaacagaagaaagggaagagaaagagaacaaagaaaaggggaaagagaaagagacagaaaatgaacaggaaatgagggaacttggccaaatggaggtcataaattaattaataaagaaaagtcaggaatttgaaaattcaggatcagatttcgggtgggagccagaccgggtcggattttactaataaaaccttgtttttcaagatcctgatccaggtcccaaacttttgaccctgaccacgatcagtttctaaaaatgcctaaaaaatttaattcgaaaaaacaaaattattgaggcgtcattattagtgctcgactttttgaaaaaagactgggcctgggtttgttgggcctgagcctggcttgcgtggacaaaatttcggaaaaacaaggtccaggagaaacccaggttgccgaaaaaggcccggaccttgcttgacctggatctaggaaaatccagacttggacccaattccaggtcgagctctatcaactttattatagttaaactaagtgtacttgtcaaaaatatcttgagactcccggtaaaattatcaaatagcctcagcactttagcttaattattttctttagcatccgttgccgaattatttgttgccagaagacaaaatcccggagtataagctgcacaaatgcacacagtgtttatgttcattttattgggccaaatcacttcaaaaacactcatgcaaaggccaacagacggagaaagggacagaagaagaaaaggaagcggtgatcagtgattgattgaaaatgaatttataataatttaaatggattaattaaatccgaaatttcagaaacaaactgttactgatgctaataacccgggagagcagaaggaggcaagtcaatccgatgcaaaagcattgggtgaaaaacagcagaactgttatgatgaggtaaatgggttttccagatctgggattttccttatctgctaaaagtctgtaagaatttgcataaaattagggtttgctgatttttttgctttttgaaaaactttacctgacgctgtctttttttatgaccaactgaaacatgatcagcgtcagacacatggacaagctataaaatatgtaaatagaaggggaaaaatcgaaacccgacccggacttctttcttcgacccaacccgatttttttctccacccgctacaatccaggaagacattatttttaataaaacgttaaattaattgttactttttatttcaaatttaacagaaaaccaaagccaatgctgagaagcaatatgaggtgggtatttaa

SEQ ID NO: 64180 - DNA, 1465 bp, Heterodera glycines
  Genomic contig location: Contig_ID=SeqID_7221; Location=1066..2530; Strand=+
  SCN-specific regions: Sequence locations=1-88,117-138,160-350,372 -463,508-664,686-1118,1147-1216,1238-1286,1343-1465
atgtctgcaatttccaattccaactttgcgcaatgtttttctggcttacgccctgaccagtcttcttcaattggaggtgggaaaggcgtaaaataacaattttaattaatttaattggaaagattgtcccgacttcagcttttaataaaattacagtatcttttgaacaatttccctaaattttggatatttatgtccaccttttttgtaatatttcagaatttttggtccactctttcccaaattcgatttcaacctacataaaatttgtatattctctgaactgtttgttcagttaattatttttaggacttcgcccgccgctgcttggcttacatcgataaaaatgcggactctttgatcagatctgatgattttttgcaagttgaccaaaaaacattgtgcgaaattttggagcgtgatcaattgcaaatctgtggagaaatttcaatttggaaagcggtaaatttatacaaatatttatttaaaaaagcaattaaaatatttccattgttttaattaggctctccgttgggctgattgtcagtgcttgcaaaatggccatgaatgttcagcggagaatcgtcgtgccgcccttggccctgcgctcttccaaattcgttttccactctttcagccaacaaaattttccgaacttattggtaaaagttaaattgttaattactcttttgttttgtattggcatttttgttgatttttactgaattattacccaattaatgccaatttgaattttgagcagcacaattaattgccccatattactatttattcattgaattccaccttttttacagttccttccggcattttgacaacggaagaatttgtcggcgtctaccaattctattgccatccgaattttcagtggttacacccgttgaaatttccgcgccatggccgaatttctgatcggcaccacgcgacccttgtgttggacattgagaaattttcggaatttgcacaagaaattgtcgggagtgaacggagcagtgaagcggcgtttgtcagcggaatgccgtggaaaattcgtgcaacgataaaaatggcgaaacaaagcactggaaaatgtttggacatttacctttggtgctgtgccgcttcagtagaagaagaaggaggaggtgagtataatcatcaagggtgtggtccatgtggcccaaaacaatttggaatgtgggatttatctttacctaattttttaaaatccagagggataggcgccgccgagaatttttccagatttatgtgtaatttgtcaatagattttatttttaaaaagaataatgtacatttgtatataatatttatataaaaaaatctttgttatgttttatgtaaatttttgtttccagcggaatcgatctcaaaaattatcgggccgggaattcctcattttttaggtaccggtatatttctcagtcccatatcgtcgggaccaggg

SEQ ID NO: 64181 - DNA, 138 bp, Heterodera glycines; identical to SEQ ID NO: 50950
  Genomic contig location: Contig_ID=SeqID_34362; Location=186..323; Strand=+
  SCN-specific regions: Sequence locations=1-138

SEQ ID NO: 64182 - DNA, 250 bp, Heterodera glycines
  Genomic contig location: Contig_ID=SeqID_34364; Location=37..286; Strand=-
  SCN-specific regions: Sequence locations=1-250
atggccaaagcattggcactgagcaaaacacacttttggcgtcatatgatgccgggatgggaatgcttcagtgaccgaatcaatagccgtgatcaactcggatttcaatcgaccggagaaatggatcacttttgtctcaaatggaaggacatggcatgggctgcctatgtgaatgtgctgagttgggagtgccaaaatggaatcggtggattaacttccagcattgcactgaaaccaattaatgaaagat

SEQ ID NO: 64183 - DNA, 354 bp, Heterodera glycines
  Genomic contig location: Contig_ID=SeqID_34364; Location=348..701; Strand=+
  SCN-specific regions: Sequence locations=1-88,123-156,232-354
atggcaccaaaagtgatcagcaggagagtgatcattgaaggaacagtgatagtgatcagtgaattggcaaatttttacgcattctgtgcaaattttaaatttgaaaaagttagttgtattaattttttttgatcaacgggaatgtttgttctgttcaatttaattaaatttttgactattttttatttaattttacatttaattattgaaattatagaataaaataatttagagagattttatctaataatattacgattcaattgccatattaatgaatatatttttttacagaaaaagatgatagctattgtacaacaatacattaaggaaattcatacattttacatgtaa

SEQ ID NO: 64184 - DNA, 896 bp, Heterodera glycines
  Genomic contig location: Contig_ID=SeqID_34365; Location=135..1030; Strand=+
  SCN-specific regions: Sequence locations=1-292,320-345,383-410,433 -470,492-569,705-896
atggattttcgaatcccaaatcctggcctgtgggcaagaaaaaacttcaaacaagatgaaggagagcaaaggataaagcccgttggaggaagacttggcaaaaaagtcgatggagggatgtgccgggctttaaaaagattgtgcacatcgtggaggatggaggttatcggtgatgaactgctcagtgtcatggaccagtgatttgaaagaggccgatttctcagtcgatgaagcgcccaaagcacccaatttttttttaattaggagtacggtacggtagttaattagtaaattgctaattattttttaaaataaacatgttcctcgaataaatggcaatttgcacaaaaaagtttcgaaaaattttgttataaatttaaaaagggacaaaaatagatttcaaaagatttataattaattaattacttcaaatttacgcataaaaactaaaaaccaaattctaagtaatcaatttttaatttaaaaaaaatgtaaaaagaaaagaaaaattcatacaaaaaaatgatcgtaattcatgtatgtttgtacatagattgtgatactttatgattaatttagttaataattaaattatcagtaaaagaacaaaataaaaagaataaagaataaaaattttgtagtatcataattaattaatttaattactgaataaaagtaattagattaaaatttatataaattatggatgagcaaagagtacaatttttttttgagaattttttgcctgtaatttgcaaaatttcattgactgtacattagcattaaaaaagttggtttacagtgaaaataaagcattttcactcacaccaaagcggagagcgaaggatgtcgccacaaaagcaaagaacactggggcagagaagcaaagaggatga

SEQ ID NO: 64185 - DNA, 725 bp, Heterodera glycines
  Genomic contig location: Contig_ID=SeqID_7222; Location=878..1602; Strand=+
  SCN-specific regions: Sequence locations=1-291,313-450,533-541,674 -691,713-725
atgctaaacatatccgcttacttctattgcagttctctctgtttccaactattcatccacagaataatgatcaatttgccaagtgttcagttgaaaagttattgatctagaaatatcgcaaacaggccttatactagtcatacattcctttagtacatcaatgggtactaaaagacgctgccttccttaataatgccttagttcctttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttaatttaattttttaatttagttttatttatttttatttttatttaacatttattttcttttaattttaatcttatttttatttttattttactttttatttgaattaatttgaattttattttactttatttattattcagttaatttaaaggagttgttcagaacctctatcca

SEQ ID NO: 64186 - DNA, 762 bp, Heterodera glycines
  Genomic contig location: Contig_ID=SeqID_7224; Location=442..1203; Strand=-
  SCN-specific regions: Sequence locations=1-418,440-762
atggcttttcactccacttcaaagcaatgtgccaaagatgctcgaatgctggatgaacacggatggtgagaattggatgtcgcggattgaagccatcaaagcggtgcttactattgatttatttggcactttaccctgtttgggtttcgcttattaaccaatttttcctcattttaggcatttgccgatgcttcatctcccgtcaatttcattgtcgttatttttatttggaacactttttttgctgattccgtcgtgctcttcaatctgaccaacgaattgacccgtgaacaattggcattgaaaagaagtgatgaccacaacgaacattttttgctgatccgttgtccaattgtgcgaaatgcgagcaaatggacaaaatgggaagaagaagcgattggattgcgaatttttcggcccttgaatcaatggaatcaaatttttatccaaattgacaacgaggacgaaatcggtgacaggtcagtgaatgcttaagcaaacagttaaaagtcattgcgtttgtgtttttaggcttctcgacgtaaatcccggcccaagtgatcagcagcagaagtgaatgaatcaattgtttagaagtgatcaaccaaattgaaagatggaattattgacgtgctcataattgtcttttttatcatagaatggtcattgatcacaacatatgtatatttgtgttatgtatgtcttgaggatacatttagtgaattcttgaaaccggatttatccatagaattttagaataaa

SEQ ID NO: 64187 - DNA, 638 bp, Heterodera glycines
  Genomic contig location: Contig_ID=SeqID_34377; Location=736..1373; Strand=-
  SCN-specific regions: Sequence locations=1-231,253-347,369-589,614-638
  Gene Ontology: Mol. function=muscarinic acetylcholine receptor activity; Cellular component=integral to membrane; Biological process=acetyl choline receptor signaling, muscarinic pathway
taattattttgccccatttaatggtcgtattatcaatcaatttaatccctccattttaccaccatatctctcccattaatttctcattttctgcagttttttcctcagggctcccagtcgcgttctgagaaccgcgcgcgcaaagccttgcgcaccatcacagtcattctcggcactttcatccttttctggacaccgttttatgtgcttgccacggtgtacggcttctgcgagcgctgttccagctcggcaggctttcaagcgttgtacacaatcaggcacggagaatgggggatggcattttgttaacacttttttatacactactccatcgtcggattgatcaggaaacttttctgatcagttgcttttcattttcaaatctatgatcactgtttcataggacattcatctgactattggtcattcatttgaatcgatatttgaatcagtccccaactttttatccaaagattgaatggcactttttggcccgtaatgccataatcctctgccctgttcagttacctcctttgctacatgaactcgccgatcaaccccttctgttatgccatggccaaccaacaagtaattaattaataattcttattttgttcaatgataatatccgtggtggg

SEQ ID NO: 64188 - DNA, 376 bp, Heterodera glycines
  Genomic contig location: Contig_ID=SeqID_34378; Location=56..431; Strand=-
  SCN-specific regions: Sequence locations=1-11,33-376
atgtcacaagaggtaaaaaattggaaaattttcaactgaattactatcttatttatgcataatccattactgtattctgcaatcattacagataaatgaattcattgaaccgtattcaattaagcaaagcaaaagggctgaaattggcgatttcaacggacaaatccaaaagttaattgaggaatgggttcagaatattccaatcgcgaacacagatgacagtaatttttctaaaaaattatttttcaaaagttcctttattagaaaaagtgccaaaagcaaaaatcctaaggaacggctcctttttgatgaactccgaattggacgggtccgacttggatttgatctgtgtggtgccagaccaaataaacattag

SEQ ID NO: 64189 - DNA, 402 bp, Heterodera glycines
  Genomic contig location: Contig_ID=SeqID_34379; Location=58..459; Strand=+
  SCN-specific regions: Sequence locations=1-402
ggcacaaattatacgaacatgggctaacaaattcggacaatcacgagcgcatccacctgatcatccatgtgctgcttgtggacgcggtttttgatcgcttggcgcgcgacctttgccgcaagacggcatttgaagtccaattccgcaactgggccgcgttggccaaacaaatggagttccagaaggaggagatccgcagcttcgtgtgcaacccgttgaacaatgtgaactgcttgctgactggtggtggtggtcttgtttggcccaggatttatggccaaattttagggctaattatcaggcccaaatccgcgaccgaccaatgggttgactaaatttgccaataaaggggggcgattttcggcacaaaaaattgtcataatttcagggatgtcccggcgg

SEQ ID NO: 64190 - DNA, 795 bp, Heterodera glycines
  Genomic contig location: Contig_ID=SeqID_34381; Location=76..870; Strand=+
  SCN-specific regions: Sequence locations=1-278,300-795
atgaaaagtgatcgggcaaagtcaaacaatggcatgaaaagtgatcgggcaaagtcaaactatggcacgaaaagtgatcggacaaagccaaacaatggcatgaaaagtgatcgggcaaagtcaaacaatggcatgaaaagtgatcgggcaaagtcaaactatggcgtgaaaagtgatcggacaaagccaaacaatggcatgaaaagtgatcggacaaagccaaacaatggcatgaaaagtgatcgggcaaagtcaaacaatggcatgaaaagtgatcgggcaaagccaaacaatggcataaaaagtgatcggacaaagccaaacaatggcatgaaaagtgatcggacaaagccaaacaatggcatgaaaagtgatcgggcaaagtcaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaagtgatcggacaaagccaaacaatggcatgaaaagtgatcgggcaaagtcaaacaatggcatgaaaagtgatcggacaaagtcaaacaatggcatgaaaagtgatcgggcaaagtcaaacaatggcatgaaaagtgatcgggcaaagtcaaactatggcatgaaaagtgatcggacaaagccaaacaatggcatgaaaagtgatcgggcaaagtcaaacaatggcatgaaaagtgatcggacaaagccaaccaatggatga

SEQ ID NO: 64191 - DNA, 792 bp, Heterodera glycines
  Genomic contig location: Contig_ID=SeqID_7225; Location=33..824; Strand=-
  SCN-specific regions: Sequence locations=1-68,90-198,248-431,468 -685,709-792
atggatcttctactttttgttcgaatcggagttcggggttcgattgggccaaaatagatgacagaatcggtttttcaaaggtttttcttattagttgagaatttgtttagacttatttatcagcaaaacatttaaaaaagagagcaaaaatttattgagctgatccgttccgctgcatttccttttatggactgaaagtaaaatttattatttgtttttattaattttatttatttatgtaaaattactaatcaaaaaaggtgaattgctgctacttgagctgcttgaatacgtctcaactcttcttcctgatacggcagaagaatgggaaaaaaattttttgaggagcgtgcaggcggagaaaattttgaaatttcgttgggatttatgaaagattttgcccaaaagcacgtttccgattctgattcgtattttttgggaatttgattccaaaatattaaaaaatagtaattttcagcgaaggttacattatgcaaaggatgatgcgcacggcaaatgagaaggttaattgcataatttgatgcaccacacttttgccaatttttctttccggcaaaaaaattcgtttttgaaattttcgtttattttatggccaagcgattggtcaaaatgcgaaaagccaacaaatttggtcccaggatcaacattgaaatccacataagcatcttttgattttgttttttgttgatcactcggaaatgggcaatttctgccgcacatttcacaaatgttaaaaattgaacactgtccgcttttgcttctccgaataaa

SEQ ID NO: 64192 - DNA, 864 bp, Heterodera glycines
  Genomic contig location: Contig_ID=SeqID_7227; Location=496..1359; Strand=-
  SCN-specific regions: Sequence locations=1-72,106-340,365-864
atgggcaacatcaaattagtgcttcttatgcttttaaatagctttttgtttgctcagtctgaagatcgtatgttttataattaaatgtttaaaataaattttaatcttattccatttaaaagctctccgctttgttggcaaagttgtgataatcactggtaattgtctcattaaatccgaacctaatttctcaataaaccaggggtattttaaacaaagtcattatgaatcagtttccgtaatccattaaaaattcatttgacattcatgtgggaaaaacaaatttcattaaaaatagtcaactttggggaggagtttttgacaaaatattttaacgaataataatttttgatttaacaaaaaatgcactcaacactagaatccctttcctggcaccgatttctcaaccaaatgcccctctccctgcccttcccccaattaattaggctcatcttcgggcattggccgagatgcggcaattgaatttgcaaaagaaggagcgaatgttgtgatccacgggagggacaaagaacgattgaaagtgtgtaaaatttgactgaaaataatgtttaatacatttttaaaggaaactgaggcactgatcattaaagaggccaatgtgtccaacgaaaaagtgctaaaagtttacggagacatcgaaaaggttgaaacgacaacggcaattttcgataaaacgattaaaaagttcaaacaaattgatattttggtgagcttcaaaatttttgtttttgaatattgtccttatgtttaggtaaacaatgccgggactgtaatgctaaaaggcactaaagaacaatttgatttgaacaatttggattacctttacaatgtcggattgagaag

SEQ ID NO: 64193 - DNA, 624 bp, Heterodera glycines
  Genomic contig location: Contig_ID=SeqID_34382; Location=86..709; Strand=-
  SCN-specific regions: Sequence locations=1-88,110-129,152-428,459 -477,499-512,536-554,587-595,617-624
atgaaatattttgcagaaatttttgattatttgaaaaaaaagtttttagaatttttgctgaattacgttaaaatttgacaattattaattcttcttcttaaaaatataatttttatgatggaaaaagctcaaaatattgataaaattggaagaagacaaaaaaaaattattacatacaaaaaatggacaaaatttcatcaaatttttaggttcaaatttcttaattgttcaatttttagatgtatattttcggtttcatctccatcccgtcacatttgaactgctttcactgctcaatttttcttggcgcaaattttcgtccaaaatttcttcgccgatggacgacgaaaaattgaagtaatccgccgctgatgttgtgctttgtttggtcaggccaaactttttggagtagcgtttttttgaacttctaaaaatgttttttttttaaatttattttacagaaaaattaaacatggatttaaatttgattgaaaatttccagaaaaaaaagataagaaaaaatttaatggttaaattaaaatgagaaaattctcaaataataattattattttttaattaattaaagaaattcacattttgtgaaagtataagtaattaataaa

SEQ ID NO: 64194 - DNA, 291 bp, Heterodera glycines
  Genomic contig location: Contig_ID=SeqID_34385; Location=584..874; Strand=+
  SCN-specific regions: Sequence locations=1-291
atgcatatgcatataattctatgccctagtgatcgtattttggagttcatttttcgcaacatttggccaatgatcgcgacaaacattcatggcttgcaattgtccaaacgaagtttccgccgtttgcgtcagttggccccgtcatttctcaacgactgtccatcgcttcactttgtgtcctattatgacgatcttttcaccgaatttccggccaatgacaatgccacggcatcggatagacaagcggtggccaaatggcttttcactccacttcaaaacgatgtgccaaag

SEQ ID NO: 64195 - DNA, 601 bp, Heterodera glycines
  Genomic contig location: Contig_ID=SeqID_34389; Location=236..836; Strand=-
  SCN-specific regions: Sequence locations=1-149,182-372,394-398,443-601
atgtctttttttctgcgcactaatttcaatatattaagcataaaaaacgcgttttccgcttggtttgaggagtcgtctacgttgacttttataatgcctatttttcagaaaataaacccctaagaattgaaaattcaaaaattgatcccaaaatttaataattttttcttaataaaaatttctggtttaaaaatttgttcttgtcgaaaaaactttaaacaatttcataattttatttacaattgaattatttaactttgacgtgttttgctacctaaaaagcgttcacaaaaaagtatttgcctattttagtgcctatttaatgcttattttgcgattttttgtgccttttaagagcttatttcgcgatttttgtgcctaaaaaaggaagctttaagaataattatttgaaaataattaaacaatattgttttttattttagtacggaatatcgccaggcatttcaaacggggtttccatttgtgtttaaacgattttcaaatgctaatcaagcaattccaatgcacaatgggcttccattaggcactacacaatgttgaatgatgaagatatttcgggataattcagtccaacattaaa

SEQ ID NO: 64196 - DNA, 621 bp, Heterodera glycines
  Genomic contig location: Contig_ID=SeqID_34390; Location=45..665; Strand=-
  SCN-specific regions: Sequence locations=1-429,461-621
atggcatttcgtgccggtgcaggcaccggtcgggaattggcacaacgaccggaccaatacttggacatcttggtaaggttttggagttacatacctgttttacaatggcattttttaagcggtaaaatttcagacaaattttgactgttgttggtcaacgcctgacgaagtgcacgcaattgctgaacaattagacgaatttgtgcaccacgaaattcggttagttttcattttctgaatttttcaaaaatattattttcggcaccgtttaaattagcggaatgccgttaacggacatggcttattgttggaaacccattccatccgactgttcaagtcggtccgctaaaatgccgtgccgaaatttcgtaaatccgccgccaaataaaacggagcaaaacttgggttttcattcgttagctttgagtctaaaatttatattaaaaattcaattttttttcattttcttaccccgtttttccatcccttcccaatttcagtgggccttacgccgggcccggctcagagccgtccgactgtcttcggcactgtttgctcgtgtttcgtgtgctcgactggcacatcggcgcactgtgcacttttggccaagcaaaaatgtga

SEQ ID NO: 64197 - DNA, 3376 bp, Heterodera glycines
  misc_feature (1576)..(1576): n is a, c, g, or t
  misc_feature (1622)..(1622): n is a, c, g, or t
  Genomic contig location: Contig_ID=SeqID_7228; Location=1792..5167; Strand=+
  SCN-specific regions: Sequence locations=1-220,242-279,301-694,716 -871,898-898,920-1203,1227-1631,1656-2095,2117-2120,2142-2159,2181 -2359,2381-2535,2557-2576,2598-3209,3231-3376
  Gene Ontology: Mol. function=ATP-dependent peptidase activity; Cellular component=mitochondrion; Biological process=proteolysis and peptidolysis
atggtgtgcgatctcaaaaatccttacgttggaattttcgtgaaaagggacgatgcgtaagtcccatttaaaaatatggagtttgagtttgttttagcaatacatcggatgcagtcaattcgatcgacgagctttaccctgtcggcacattcggcaatgtcgttgaactaaaccgagtccatccgaagaggttggaaatgttcgtcagcgcccatcggcgcattcgactgttggaaaagttggacacactcgacaatgaacaagtcggcagaacacagcggagaaaaaagagggtacaaccgcaacagctgactccaaacagagaagagggcgctaacgggaccgaagaaccgcaaggcgagaagccgcttctctatgcgcgtattgagaatgttgttgagccggtattcaagccggacgattggatgaaagtaaatgcatttatttaagtgacaaaatcatttctcccgtctaggcgaccattgacaccatcataatgaccattcgtgaaattgccagttatagtccgctctttcaacaacaaataatcaatttgctcattccaaaacaaaatgtgacggaagatcccatcgccttatgtgacttagtcggcactattgttgaaacatcgaccgcaacaacccaagacttacaggatttgatggagaaaacggatgtgagagtttcgatatattttagtttaaaacaattttatgttaggtaatggaacgactacggaaagctttggaattgctggagaaggagaagaccattttaagaatgcggaaccaaataaaggaggacgtagagcgaaaagtgaacgaacagcacagaaaagcaatgctttacgaacatgtgaaaatgcgaaatcttttaattaattaaaattaaaatttagctgaaagcaataaaacgggaacttggtatcgaaaaagaggacaaacaagctgttcttgagaagatggaagaacgattagccaacctcaaagttcccgagtacgcaatgaaagtaatcaaagaggagcaagccaaactgtcatttctggaccctcacagcagtgagttcagcatttcaaggtagaaacggttctttcccattaatataattaacattttaaaggaattacttggattggctgaccagtgtgccctgggggaaaacttctgaggaaaacatggacgttcacaaagcacgtcaaattttggaggaagaccattatgggatgaaagatgttaaagagcgcattcttgagtttattgcagtcgggatactcaaacagcagacaaacgggaaaattctctgcttccacgggcctcccggagtgggaaagacgagtattgcaaaatcaatcgcacgtgcacttaacagagaggtgagtcacaattaaaacggaaatggtaaccgttattttatcaatctctgttaatcttctatttaatcatctctatgttgtcttgtcccgacattataatgcgaaaaaggcgtcccgtgtttatcgcaggaaccagggtttcgactggggaggggtaccgcctcaggcaacgactttttttgttgttgcttttcataccattntgaggtaaaccttgaaaaaggtgcaccaaaaaggaaatttttaatntcatcaaacaaatattaatttttaaaaaaaattcgtgtatggggggtcttggaagatacataccccgtgtaccctcctcccctttgggccgtttctggtttatcggaacacaaatatacgggttagctgatgcctcaaaagtttggacacaatttatcctattttctgctaaatccgcagtttacaaaaataccacagattctttcagtactaccgcttttcggttggaggcatgacagacgtcgctgagataaaaggccatcgacgcacttatgttggagcaatgccgggcaaattgattcaatgcctaaagaaagttcaaactgagaatccactggttctcattgatgaagtggacaaaattggcagagaaggtgcaattgttattcaatttttgaacaacttcgtttttagggtaccatggcgatccctcttcagcgttgctcgaagttttggaccccgaacaaaacgcaaattttttggatgtgagttgaaattaatttaacaaatataattttacattcagcatttcttggatgttcctgtagacctttcaaaggttctgtttatatgcaccgctaatgtaactgacacaataccgggtccattaaaagaccgaatggagatgattgaagttgcgggttatgtggctgaagaaaagctggagattgctcgcaaatatttggtcccaaaatgccgtgagaaatggtaagagcttacaccaatatttattttaatctatttcccatttaaattcattttaaagtgctttgcccgacgaaaaattggttataaaagacgatgcaatcgattcgttgataaaatcttattgccgtgaatcgggagtacgaaatttggaaaagcacattgaaaaagtaatttaatatggcgaacatagaagccctttaaaaattgttttagattttcagaaagagcgcttatcaattagtaagcggagaaggcgcccaaacacaaatactgccaattgtggtggagaacagcaacctcaagaaatatgttgggcgagaaaagttcacttctgaccggttgtacccgacaacgccggtcggtgtagtaatgggattggcgtggacagcgatgggtatgtcgaattgatttctgaataagtaatattgcaagctctttctcgtttataggaggctcggcgctttatgtcgaggcgactcttgcaagacgtttgggcacaccttcaacagatgttcagcaagtcactgatgagaaatcccatcagaaaacagtgaccggcaatttggaagtgaccggacacctcggcgatgtgatgaaggtacttggaacatttaggaacccccggtctattattttaaaggaatcaatgcgtactgcttacactgttgcgaaaaatgtactactgagaaaggacccgcaaaacgaatttcttgaaaaagcgtatatccatcttcacctgcccgaggttgacctgtcgtctcctttcgttgacccattcaaatgttttcccttagggcgctgtgccgaaggatggcccttctgccggctgcactgttgtcagtgcccttatgtcgctggcacttgaccgtcccgtggcccagcagacagcgatgaccggggaagtttcgctgacggggaagattttgccggttggcggcataaaagagaaaataatcgcagcaaaacgggcaggagtgggacggattatactgcccagcgaaaacaggaaggacttcgaagatttggctgactttatcaagaaagat

SEQ ID NO: 64198 - DNA, 858 bp, Heterodera glycines
  Genomic contig location: Contig_ID=SeqID_34392; Location=238..1095; Strand=-
  SCN-specific regions: Sequence locations=1-47,119-184,364-499,521 -568,590-826
atgaaaatgaaatgcgcaaaaaacgcaaatacaacggaagaaattctaaggaaaaattcaaaaaataaagaaaaagaaaaaataagagaaaaaaagggacaggacgaagaagagcaaatttataaggaaataaccgaaatttacagacaaaattcggaaacggacgaactgatggaattatacgaagaaaacgaaaaatggataagacaaagccaaaacaaaaaggcaaaaaagaaagaaaaagcaacgaaaaaaggagcaaaaaatgggaaggaaaaggaaaaaagtaataacaaaaaagggaaaaaagaaatgacggaaaaaagaagcaacgaattgggggaggaaaaagaggacaaaaaagagggcaaaacgccaaaaaaggggacaaaaaaggcgaatttaattgaaaatgggcaaaacggcggggaaaatggcacaaaaacattggcagaaattggaatcggaaaattaggaggcaaattttaatttaaaaaggaattaaataagaaagaaatttagatttattagacgatttggtggtgaaagaaacttttgaaaatgtattactaaagaaattggacggcaaaaacattgaaataacgaaaaatattattttatttgtgcgagcgatcgaaacgaaattaaaattcataaaaagggaagaaaaaaggacggaaaatgatcaaattttggacaaatttgacgaaaaatgggatagtttcatgcaaagtgcgagcatcagaagtgaagaattgcaatttgtacatgacaaattatattttattcacgaggacattgaccaaattgcatttgagtgagaaacaaaaatttaaataattaatttaatgtaataaa

SEQ ID NO: 64199 - DNA, 404 bp, Heterodera glycines
  Genomic contig location: Contig_ID=SeqID_34393; Location=216..619; Strand=+
  SCN-specific regions: Sequence locations=1-142,167-301,325-332,354-404
atgcttgtaatttttccgatcgatatttcctttgccattatatatccaatccacaatgtgcttgtgatcttaattcgcgcctaccgatcagctttcacaaaagcggattttgtctcatattgctactgggccaatacggtaatcattaattgaataatttgaatttaataattcaaaatttagccgctttttcttcattcgctcgtcactgttttgttgtacatccgctttatcaacagaagctcgaaaattacgaaaagaagaaattttgtgaaaaggaatttaaatgaagtagggaaaacccatttcaaatttttggaggaacagtggaacagaaaaagtgcattttcaaccgattaaattaggatgcacttaattttttatgcattaaccattttttccaa

SEQ ID NO: 64200 - DNA, 219 bp, Heterodera glycines
  Genomic contig location: Contig_ID=SeqID_34394; Location=9..227; Strand=+
  SCN-specific regions: Sequence locations=1-83
cagattgtgaacgttgataatcaactcaatgagctgaccttccgcgaggcagagatctcccagctgtataagaaagatcacccaacttatcgtgcgctgctggaaaaacgccagacgctggagcaagaacgcaaacgcctgaataagcgggtatcggcaatgccttccacccaacaggaagtgttgcgtttaagtcgtgacgtagaagcgggccgtgcg

SEQ ID NO: 64201 - DNA, 409 bp, Heterodera glycines
  Genomic contig location: Contig_ID=SeqID_34400; Location=113..521; Strand=-
  SCN-specific regions: Sequence locations=1-71,96-343,365-409
gggggaaaaaaaatggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaacgccaaaaaatgcgaataatgcgaaaggcgaaatgcgaaaagcgaaacctcggcccatccctgctgctcacccatcagtgaccgttttcacttcatttggccaatttttcggattcgtcgttttgtcacttggcagtgacgcaaatgccctgttggactggcattccgttagccaatgagagaaagccaagtgcagcagcagcagcggatttgttcattttttgttccttttcctttcaaatttttcattggca

SEQ ID NO: 64202 - DNA, 576 bp, Heterodera glycines
  Genomic contig location: Contig_ID=SeqID_34401; Location=130..705; Strand=+
  SCN-specific regions: Sequence locations=1-174,200-242,265-267,290 -340,384-526,566-576
caggccgtgccaatctttccggcgtcgcctcctccgccaatagcgctcttttcggcattggcactgctgcggtacgtccgtcctcctcctcaaccgcgtccagcacttcgacgcccacccaatctaccactgcccagcggcgtccgattgttctgtcggcaaaagcatcgccgtctccgccgccgccaccgccgcttttgaacataaaaagtggcggaagaacggcacaaagggtggcggtgacaacaaaagaaaaacagaaaacgaagcagagagaagagagggagcacaacgaaacggaagacgaaatattcttgggaggggaaggtaaatgggcgaggggagaaagagagagagagtgtgtgttagagagagcgagagagttggaaaacgatggatggcggagtgacccattttatgccaaatttagtctcattgaatggtccaacaaaatttgtggagaatgccattgtgaagccgaaagtgccgccaaagcctgacaaaaacgcactgatcggagtcggacaacagcagcagaagaagcgaaaggaagaggtgggaggggacagagaatga

SEQ ID NO: 64203 - DNA, 1128 bp, Heterodera glycines
  Genomic contig location: Contig_ID=SeqID_7229; Location=1151..2278; Strand=+
  SCN-specific regions: Sequence locations=1-15,39-62,84-147,169 -366,389-416,438-521,544-551,576-753,779-848,872-1128
  Gene Ontology: Mol. function=isocitrate dehydrogenase (NADP+) activity; Cellular component=mitochondrion; Biological process =carbohydrate metabolism
atgtggttgagtccgaacggaacaatccgaaacattctcggggggacaggtgaggaaaagctttggaaatataataaagcattttaaatgctaattggaaacaacgaataaaaaatacgctcaaatgtttcagtgttccgtgagccgatcatttgcaagaacattccccgagttgtgcccgggtggaagaaggaaattgtgatcggacgccacgcatttggtgaccaatacaaagcgacggatattgtggtgccgaaggggtccaaatttgaaataaacatcattaaaagtgacggacaagttgagaggcactcggtgttcaactttgccgatacgggcggtattataatgggcatgtgagtggggggaaaatggagaaaatttattttagcgattaggggcagaagcttgcgtttattttctttaaaaatttacaaattaaggtataacacggacgactccatccgtggctttgcccattcctgcttccaatacgccctcaaaaagcaatttcctcttttcttgagcaccaaaaacacaattttgaagcgctacgatggccgcttcaaagacattttccaggaaattttcgacaggtattcctatcaactgtaaaatgcttctttaatttgtagtagcattaaaaaatttccagggaatacaaatccaaattcgaagcgctgggaatttactacgaacaccgactcatcgacgatatggtcgcgcaaatgttgaaaagtgagggtggctttgtttgggcctgcaaaaactacgacggtgacgtccaaagtgacgtggtggcccaggggtacgggtcattgggccttatgacatgtgagcgaattggcaaaaaataaattacattgttttactaagcaaaattttttagctgttttaatgtgtccggacggaaaaactatcgaagccgaggctgcacatggaactgttacgcgtcacttccgcgaacaccaaaaggtgaggaaaatgcttttctggcaacaaattgtattttcaatattcacatttttagggtaatccaacgtccacaaatccagtggcttcaattttcgcttggacccgcgggttggagcatcgcggtgttttggacggaaacgacgcccttgtgaa

SEQ ID NO: 64204 - DNA, 1155 bp, Heterodera glycines
  Genomic contig location: Contig_ID=SeqID_7231; Location=212..1366; Strand=+
  SCN-specific regions: Sequence locations=1-339,361-823,847-926,949 -1155
atgcctggacaaacgcctgccggaccggcaagcgttggtgtgtttgttgagacggcgtttctcagcttccacgctttttaggcggatgcgattttcgtttttttggattatttccctctccaaaatgcgtctccaccatttgtcaacttcaccattcatttgtacgccgtttttcggccccaaaaactgctcgtccatctgcaaaagtgcgccggcgagtcttcttcccaaccaccgtccgctttgactgcgagacgcactcacaatcattgtcatttcgatgttgcccaagcacttcgtatttgcacagaaaatggcaggcatatggcgtttccatcctattttaccattttgggcattacagcattgcacgagtgttctgtgtttttgctttgcctcgagcgtctttacgaggaagcgacgcgtttggcgttgcgtcacgttggcctcgcgtgtgccaaagagtgcgcgcgacgtttggacgccgactcagccgcagcagacgcattcgccccaatcgggcatttggcgtcctttcatgggccggtggatgaggaggattttggagaaagtggcgatgctggtgtacaaaaaatggaacaacagcagcagcaagtgcaggagatgcgcaagcgagtttggatggaaattggtgagcaaatgtcggaaaaaatatattgaccaatatgctttgcaattccattcaaatttgagttccttttttttgttagcaaagagtgtaattgcgagcggtgcgcctgtcgagcaatgtttggcactgctgaaagagtcgcggggtgccgtgcgcgtgcaagacgttttggcacattttccagaatttcacaccatcgaacacttacgggagcccatctgcgaatgcctcaagcaatacaccaaccaaattgaggttgtgttttactggaccgaatgctgctggataaattggatttataacaaaattccagcaccttcaaagtgaaattagggatgtcactgcgatggcggaggaattgcgcaccgaaactgcgaaagcgcatgccaagtgaaaactcgcttatatgaaaattcctaaatgacaatatatttattgtttttttagctttatggtcgtcagaaccagcgattgttgtgcgatgtgccgtggcattctgttga

SEQ ID NO: 64205 - DNA, 504 bp, Heterodera glycines; identical to SEQ ID NO: 60631
  Genomic contig location: Contig_ID=SeqID_34404; Location=68..571; Strand=-
  SCN-specific regions: Sequence locations=1-107,134-263,292-504

SEQ ID NO: 64206 - DNA, 459 bp, Heterodera glycines
  Genomic contig location: Contig_ID=SeqID_34406; Location=134..592; Strand=+
  SCN-specific regions: Sequence locations=1-459
atgagaccgtttttgggggttcgtcgaattatctctgtttaccgcacaatttccggtttacgacccttcgattgcgttcaacggacattgacagttcccatcgaagggaaagcgccgaaacgatgcaccgccgaggaagcagttcgggacatcgaatcaggttggttttgctgaaaaatacatttttggttaaggcggaataatttaagggtgatttatcggaaaatataacaaaactattatttgcctccatttcgtgattaaaccctcagatgaacacatttacttgcatcatgccatgtcgtgtcccaccgatttactgagggctttcggcaaacacatcgaaaagaacgatttgagaggaatccgtgcaagccatgccttaacttgcggcgaagtgagtgccgctaaaaccaaaaaccaataaaatacacaaattttgaaggtcccatggactga

SEQ ID NO: 64207 - DNA, 147 bp, Heterodera glycines
  Genomic contig location: Contig_ID=SeqID_34409; Location=200..346; Strand=-
  SCN-specific regions: Sequence locations=1-147
atgacctactaccttgatgaagatacgccaaaacgctcaaataatgacttatattcatgcattcggcttgatatgaacttcacaaaatgtgatcagaatgatcctggtgcaacaatcaaaatcagcgatgccaacacaaatgaatgg

SEQ ID NO: 64208 - DNA, 3180 bp, Heterodera glycines
  Genomic contig location: Contig_ID=SeqID_7232; Location=190..3369; Strand=+
  SCN-specific regions: Sequence locations=1-139,203-481,517-653,675 -714,737-748,799-1145,1173-1224,1248-1485,1509-1601,1647-1653,1688 -2047,2073-2480,2517-2568,2590-2611,2633-3005,3064-3083,3105-3180
  Gene Ontology: Mol. function=internalization receptor activity; Cellular component=lysosome; Biological process=receptor mediated endocytosis
gtgtgatggggacaacgattgtggcgacaattcggatgagaccaatgatcagtgcaaagttgcggtttgtgagccaccgttgcgcttccgatgtgcacactcccgtctctgtctgaacattttgcagctctgcaacgggtaaaaaacaaattaatttaattgcaatttaaattgttaaatgttacttaattattatattaatgtatggactacttaattaatgtgtgtttaaccattattaagtgattggttaatgttaattaccattgacaagtggctaattaacagacaatatttccctactaccactctgttaagtaccctaattaacaataactactatgcttaattacctttgattagtactaaattggtgataaatttcagctttaatgactgtggtgaacacgacttctccgatgaacatctatgtaagtttccaaaatttaatcgacttttcaagaaaaaagaatttcatttgtatatttaaaaaaaattaatttaaattaattttttccctaatttagcaatgtgttcatccttttctgagtatggcgattgctctacggacgaattcaaatgctccaatggcaaatgcatcaatgccacacttgcttgtgatcggaaagatggtgagatgagcggtgatcagaatttttgatttttgaaatttcggagaaaattttgtccatcaaaaccaattctttctaaattcactcatactctcccctcttccgtgccaaaaagcaatttttttttaaatttccgtttaaatgaaatttttttttttttttttttgatttcctcattcaaactcgtgagtcaaattttctgatcacagattgcggcgatgccaccgatgagattggctgcgcgaaaaacaacggcaaaagttgccattccaagggggacaacggcgggtgcaagcacttgtgcactgatgtgcaggacggctactattgccattgtcgggacgggttcagaccagacccggccaacccgttcgactgtgtggtaaaaaaaaaattggaaaatttgattactgctcaagaccgaaatttcccgtgattcgagatcaagaaaaaaagagacttttctcggctcagggctcgagaaaatcaaaaaaaaaaacacaaaatcaattcaaaaaataattattttttattaaatttccaaaactggtctctgtttattgaaatatatgttcatttttgaatacatacgtcgtaccaaaataaaaatcaatttttgcgaaaaacggacaattattgattgagctaataatagccgattcctaaggacgtcctttgtgaacccaaggacggacgaatggaaatttggataaaaattcacaaaatatttttttcaaggacattgatgagtgccaaggcaacaacacatgcacacagcaatgcctgaacaccaagggctcatatctgtgcaaatgtgtggacgactacacatcaggtacagttgcgccttttctttgttcaataatttatttttgtcggtaaaattcaataatttatttttgtcggtaaaaataacgaaattttatcggcattttttttacccctaattttttgttaataaaatgtcgacaattttttcttttcaaaatccgaataatttttatttaaaaataacttcctagaatgaaaattcaagaaatgaatataaaattcttgaaaaacctggaacgagaaaaatgttggcattcgggtcaataggccaagaatgttcaggtcgggatccgggacgcggaccgagaaaaatgccgggattcagatcaacctggcaaagctcttgattggatgtctaaagacaaatcgctaaatctctccctgattttgattcaattctgatcaggcgtcgtgatcggtgcaatggcgggcaaagattgtcgcgcaaatggcgagccggcattggtgatggtggccgccaacaacaaggtgatgcagttgaatttggtcggcgcccggggccgcgtcaacgccgctgcggagtccgcggacgtacaggcggacattgccgctgtggagttcgacccgcgtcgggaacagatgttttgggtatggttttcttgagcattaattaatttgtttatttaacggtcattgaatgatttatttgccggtaatcagtagggaatagaattacatggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatgtccatatttcgcgatttttgccattttatgtccatattttgcgatttttggtccatattttatggccatatttcgcgattttatatccatataattacactccctagtaatcagtttaattgactattagttggttaggtcgctattaattgccagtttaattgatgttatgtttttagattgatgcctaccaaaagaaggtgttccgttcggcattgccaaagggcaatcagtcggtaagggcataacgggcaaaatttggcattttaatttgtgccaaattttaaatactcatcttttttttttgccagcacgaaggccagaaactgcaaattcatttgatgacaatgtga

SEQ ID NO: 64209 - DNA, 771 bp, Heterodera glycines
  Genomic contig location: Contig_ID=SeqID_7232; Location=2315..3085; Strand=-
  SCN-specific regions: Sequence locations=1-264,286-307,329-380,417-771
atggccataaaatatggaccaaaaatcgcaaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctcccacagtccaggaaaaaaatatggatttccatgtaattctattccctactgattaccggcaaataaa

SEQ ID NO: 64210 - DNA, 808 bp, Heterodera glycines
  Genomic contig location: Contig_ID=SeqID_7233; Location=775..1582; Strand=+
  SCN-specific regions: Sequence locations=1-338,360-594,617-670,692-808
atgttgcaggccgaaagtgcatgtgcccgcgcacaatgcacccatttgtgtgctgaattgccggccagcggtttccgttgcatgtgcccggacaatgtgacacaatttgatgacggctcatgtggcaccgttcgaattgaggagttgccggtgaaaaattggaatttttttttaggattttccaaatttttgtttgggtttgcgtccggggttcgaacctggcccgaaacggaaatccatgttctttgatttacgacccagaaaacggcacagattttgacgatttttaggggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgaagagctatcgaatgataacaaaaattttttaatttggttgatcaggaaaaaagttgttagcaacggcgccgaaaaggccggcgccagatagaacagaaaaataaccctgtcacattttgcagcaaaacgccaaaatttctctattttcaaattttatttgtgtttatgcagtcagtttatgtttaacaaaaaaatcgtaagactcaaaaaattacccaaaaatttttgtctaa

SEQ ID NO: 64211 - DNA, 123 bp, Heterodera glycines
  Genomic contig location: Contig_ID=SeqID_7233; Location=1..123; Strand=+
  SCN-specific regions: Sequence locations=1-3,25-123
ctatttttacaagttttttgccttaaaacggccaaaatttggtcatttttagtgaaaaagtaagtgcagttgttacccagcagtggaaaaaaagttattggttaaatagcaaaaaaaaaaaaa

SEQ ID NO: 64212 - DNA, 451 bp, Heterodera glycines
  Genomic contig location: Contig_ID=SeqID_7233; Location=1657..2107; Strand=+
  SCN-specific regions: Sequence locations=1-197,223-245,272-278,308 -411,434-451
atggtggcatttgcaccgccgccggcacatgcaaatgcggtgactttgagggcgaattttgccaaaaggtgattgattggttgtggttggtggcagttttaaatcatttggaatcatctcatcattcatgcaattgtttcttttttttttttctttcagcaatcgtcagtgactcgtcaacttattggacgacttggtaattaattaaaattataaaattttggtagtcttggtaaacaattttcaaaataaaaaatatttaaataaaaatcagagggaaataattaatttttaagtataaatttaacctcaaattctttacaatttaccccaaaacgactattttcaaaaacttttagcctaattcaagaaatttcgtttttgaagtcagaattccttggcgcctaaaagtttcggaagaagaaatttctgtgttcgaatttctgggcca

SEQ ID NO: 64213 - DNA, 49 bp, Heterodera glycines; identical to SEQ ID NO: 51181
  Genomic contig location: Contig_ID=SeqID_34412; Location=97..145; Strand=-
  SCN-specific regions: Sequence locations=1-49

SEQ ID NO: 64214 - DNA, 165 bp, Heterodera glycines
  misc_feature (14)..(14): n is a, c, g, or t
  Genomic contig location: Contig_ID=SeqID_34412; Location=787..951; Strand=-
  SCN-specific regions: Sequence locations=1-165
aggatcgggtctcnccataaatctgggcgcatcggttcggggggactgctccgaaaacacaaataaatcgatttttcgagtgtccgtttggggtactcaaacaattatggggagcaaaaatccaacgcagaattaaagtacaggctatagggaagctattccgga

SEQ ID NO: 64215 - DNA, 1081 bp, Heterodera glycines
  Genomic contig location: Contig_ID=SeqID_34415; Location=227..1307; Strand=-
  SCN-specific regions: Sequence locations=1-281,310-310,335-396,435 -558,764-999,1028-1028,1053-1081
ttcaatcggctagtgctttaaggttttgtctttgactttgcttttttttccatttatttcaatcggctagtgctttaaggttttgtctttgactttgcttttttttccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgacttatttcatgaaattatattaatttaattttaaataaagaggcaaatttttacagaaaataaatagacgctgactaattagctaacatttat

SEQ ID NO: 64216 - DNA, 398 bp, Heterodera glycines
  Genomic contig location: Contig_ID=SeqID_34415; Location=1168..1565; Strand=+
  SCN-specific regions: Sequence locations=1-179,218-283,333-398
aaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtacaaatttgcctctttatttaaaattaaattaatataatttcatgaaataagacactacatgtatagagaatgattaacgtggtcgattggaataaatggaaaaaaa

SEQ ID NO: 64217 - DNA, 394 bp, Heterodera glycines
  Genomic contig location: Contig_ID=SeqID_34420; Location=147..540; Strand=+
  SCN-specific regions: Sequence locations=1-16,72-133,190-244,266 -300,340-394
atggtaagaaacagggaattaaaaattttttaatttaataaataaatgattttcgatatttttaaaataaagtgtccatttttcattattacaaattcaaaattacaatattatttacaggagaataatacagattaattaaaacatttttaataaaattaatttttaaatgatttaaatttaaaatttcagggatttttgaacgaccaaacgctgtttgatttacacgtcaatttttgctgaaaacttgattgtttcacttattattcattgataaataatgatttaatgactttcatcatatttaataatttaataatcaaatttcaaaaaaaatttctcgagcggcgtcgcctggtggcaccgccagacaattcttattttgtgaaacaaa

SEQ ID NO: 64218 - DNA, 367 bp, Heterodera glycines
  Genomic contig location: Contig_ID=SeqID_34421; Location=269..635; Strand=-
  SCN-specific regions: Sequence locations=1-367
atgcactacagtgcgtcctccatttatctgatgcgtccggaggaacaccgcttcaccaacgctgattcgccctacttccggaccaacagctcatttcttggcatcggaatggacaaaagtgtccgcatagttgaaagtgggtttaaaaaaattcgaaccgtacgtcgcaattgaaattttattttttttgcagacggtttgaagcaaggcgatggcgctggagcaaaagctgcgatggttgtccaagtgcagaaagtgagcattttaatgtatttgaattttatttccttactggataattatttctaatttgtatccgacgtaaaaagacaacagaaaaaaattacgaatttttttgtttaataaa

SEQ ID NO: 64219 - DNA, 1078 bp, Heterodera glycines
  Genomic contig location: Contig_ID=SeqID_926; Location=4858..5935; Strand=+
  SCN-specific regions: Sequence locations=1-133,155-549,573-740,764 -865,888-1078
atgagcaccttttggcgtttagcattggtgcagaaacggctgtccgattatttcaatgcgatttgtgaattcaatgggaaaaagtaagttttggatgggaatgatcagtttcaaaggccgggaggaaatttcaaagcaaaatgaaagaacaaagatcactttctttgattttacttagccacattaaaccacccgccaaagacaaacattagtaaaaccttaatttatacctaaagggccttcattgtttgaataattaggaaccattaaattttggccatttcggcccggcatggctaagatgtctgctgatcacttgtgctttactctttgaagaaattccgcatttttagccctttttacgaccatttggcttttatgtgctgcgacagttgctgtgcttttttgttttggctttgaatgctttcgatttgtccattgaaaatgtccatggaagtataatctttctcttttacatctcaatactgctaatggcacttttttttcatttgaggagcaaataaattcgttcgaattgtccccttatctccgtctgcccacccttcccggccatgtgccaaattcggccaaggaattattcgccaatgaaagtgccggagctggagatgcttctatcagtggccattattgaaaagatagtgaattttaacaatggcccaactggtataaaatctgcctttattttcctggtgctgcttggtaaacttcgtgtttttgtgccccaaaaattccaaagttttagtcggattttgcattatctttttaacaaaatccacgcatttttgagtcgccggggaatttaaaaagaagtgttctaccacactttgccattattttgtaattgtttgaataattttatatattttccaaatttgagagccgacgacaacgccatcggcacaatgaggccccaacaattgtcggctgcatcagcctaaccgaggtgtacctgtagcagaacctgatcggcgaattgcccagcaccgtcggggatttgaaggcatgttttggtcaggcccgtatcaagaaaaaatttcggggaggacatccgaagtaa

SEQ ID NO: 64220 - DNA, 729 bp, Heterodera glycines
  Genomic contig location: Contig_ID=SeqID_926; Location=1331..2059; Strand=-
  SCN-specific regions: Sequence locations=1-279,304-315,337-729
gctggtggaggtgtcgctgtttgttttgctcgtctctccgtacctttccaagctgcccaattccaccgttgtccttctcgaccatgccattcactttaaccccgggggcttggctcagatggaacaccgattcggttgcatctttgaccagaatctttacgagactttcaaacgtcaaatgaatccgcgggtgcgtccgtcgctctgtccttttgaattggctgaacttgcagaacacctgcgacccgttccttctgtcctccttcgtgccgcggcctctcctcttcgtcttcgtcctcctccgacttctacccatttctgttttctctttttgttcgctgctccccaaaatgctttgagcatttcgctggccaaatgcattctatgcgttaagcccaccatcagatacaaaaagaagtgattaggaaaaaggccaaaagcaaaataataaaaataaaaagcccaaaaaatgtttagcgccaaaagcactccttcaaagagtttccatcgtaatactcgcacaattcgtcgacaaaaacaacttttggcgtcaaagagaatgtgccaatctttccccgttaccttgcggcacacaaattccaccaaagcctccgccgttgggttacatggatcacagaagaaagtgggcacaaaatgatcgaaatttgtttggctaattaacttggtaccattttataacaatgccgcctttttcgccgtctccggcgc

SEQ ID NO: 64221 - DNA, 590 bp, Heterodera glycines
  Genomic contig location: Contig_ID=SeqID_927; Location=482..1071; Strand=+
  SCN-specific regions: Sequence locations=1-8,36-190,212-225,247-590
atgaaattatgtttatttaaaattatttttgctttttatctcttaccatatgcttgcctgtctttggaatcattggaatctcttttcgattcggaaggtttgtcgaatgagatgtgttaattaattaagaaagatccatttaaattttaatttttgaccttatttcaaaagtattacgaatggaaaaataaagtgcaaaatacatattaaaatacggaaacgccctaaaacatgaaaacaagaattactgaaaaattctaaattttttgatcaacaatttttgatcaattttttttatcattagggatgtcaattttatgtaaatacatattttttcctggcttctccatgctctaaataggcggaaaacactttcttttttgtgtttgcgaacaaaaatctggacttttatttacatattcggggtttttatagttattttggactttttcatacatttttttcttacatattttgaggattttttactgttttggaaattctcaaaaaaatccaaaattttggctattgcttatttttcatttttctttaatttttgaaaatttatagaatggctcgtgaaaaaataa

SEQ ID NO: 64222 - DNA, 484 bp, Heterodera glycines
  Genomic contig location: Contig_ID=SeqID_7235; Location=282..765; Strand=-
  SCN-specific regions: Sequence locations=1-484
gccaagtccccctgcccctctccgtcctctcccaactccgacttttgtccgtccttcgcaatgcgtcgctacgctttcattcgctccttttaccccatcctccgattctttgccgatgcctattttttgctggcggacgccctcttcgccttatacaacgcttttcaaccgattgatcagatcggctgggcatcggctgatccgttgctattcattccggcgaacaaagcggccgaaatgattcgccgagggagcactgatcttggcgagctgatggacgtgttaagattcgcagcgaaaactgaccgatgtgccgttacgcggacgattggcgttggcaatggccgttttggcgaggaaaagtgtggcgggatttgccatcgaagtggattttacgtatcaattgcgccttttttacatggaggatttgaatgtgctgatcggacaacacttgcaaaacgagcagagagaagcagtgagaaaa

SEQ ID NO: 64223 - DNA, 1144 bp, Heterodera glycines
  Genomic contig location: Contig_ID=SeqID_7236; Location=680..1823; Strand=-
  SCN-specific regions: Sequence locations=1-251,275-277,305-1144
atgcgtcaagacttgattttccattactaccaggcaaaggccaattgtaattggccaaataattcagcaaaacaatattcccaggaactcccgaagtatttgcgaggctatcacaacattggcaaaagggaggcggcacaaattggggcactgattttgagggcacaaacgaaagatgggaaagagccgccgctggcgcacattcagcacattttgcagcaattaataccaaagtgagggaatgaaagaagcaaatgcgaaatgaaaatggaaatggaaaaaattataaaataaatttaaatttctctttttagggactttttgaaaatgcaaaattcggccgagtggaaaagggtaagaaaaagcgaaggcgacgatttaaactcatcaaaaaattgttaagttaatttgtgccgaatttggtgccaatttgcaaatgccaaaatgttccgacgatgccaaaatggcgtttcttcgacgactttcttctgagccgacttttggctccgcctttttcgaggcattcattcattttttccgaaaataatttttaattttttggtgaaacaatcggccgactcgaaaatgggctcaaaattattggtggcaatcaatcggtaatcaaaaaataaatatcccttggtttattggaattcatagtgacggaatatctctctacggttcggagtccaagcagcacatttgcacttacgtattcgagcagatttgtcaatggcaaccggcgaatacgtaaaattaaaaaaaaactaacaaacatcgaaggcagattcgagaatggcactttatcggggatggcactaaactttttttttgttatgaaaattgcctttggttcaaatgtttgccaaattttcagctattttcacatcacaatggaaaagggcaaccgattgctttttgagacaacacttggccacaaaatggacggttcgaatgcttaaccctctcgcattggcttaaaccgaattttttagatcttctgacttcgtacattcaggcaatgattgcgcggagggaatgtattaccacaaaatgccaaaatgaacgaaatgccaaatcgggaaatgtgttgccttatgtgccattgctggcatttggcgacgatcgtcgcgaatttgcctaa

SEQ ID NO: 64224 - DNA, 184 bp, Heterodera glycines
  Genomic contig location: Contig_ID=SeqID_7237; Location=418..601; Strand=+
  SCN-specific regions: Sequence locations=1-184
atgttgaagtgcccggcatggctggtcgatttgaagcggaatatatttacgactcgtactgtttttgtttttatccccatttcattttaatttttttcattttcagctctcacttatccgacacggtcaaactgatgggcaaggaatacaaccggaaaaagctgaagcggaaatgatcaattga

SEQ ID NO: 64225 - DNA, 941 bp, Heterodera glycines
  Genomic contig location: Contig_ID=SeqID_7237; Location=810..1750; Strand=+
  SCN-specific regions: Sequence locations=1-860,882-941
atggctaataataatcattgtccaccaaatgtttctgtagaaaatgatggcggttggacattggcagttcgtacgaagcacgggtgccgtcggcgtcgcgtgttcagtgccaaaacgacgacaaaatgcggggccaatttggacgggccaagcacaaatgcattcaacgaggacggcactgaaggaggagaagttcaagcagcagtggaagagttgacacttcagatggaacgcctcgtgtgcagaatgccacacacatttttgtgagtcataagttgtgatcagggtcgctgatcgtgaattcagcacccatattggtgtttattttattcgtgtatatttggtagagcccggcggaatcgggactcccgcgggatttccgactcccgcttttcggtgaacgggatttttacgggattcccgttcaggactcccatcccggtaaattttgaactcccgctcccagaaattttttttaccggattctaatatttggcaggttttgatgcggaattcaaaaagttgtattgtccacctttttgtttgcttccagagtcagacagtgcactatttcttcctttctctcgtggctatgcggaagaaaagaaggaaatagtgcactgtctgactgtctgcctattttcccagcgtcgctggtatgagcaaaaaaaaaaaaaaaaggtcgttcgggcgaaagtttttcaaaaatacacccctaagaatcgggcgaagaattttcaaaaatacacccctaagaattgacttttcggatcggtaccccccccccaagcccaaatcctggatacgtccctgacacatggaacaaaaactttggaaaaagattgttcaggtgcccttgccaatttttggcttgtgttcctccaatcattttcatttaaaaaattcatcagaaaatcaaagagtcacttttttatgaataa

SEQ ID NO: 64226 - DNA, 364 bp, Heterodera glycines
  Genomic contig location: Contig_ID=SeqID_34422; Location=420..783; Strand=+
  SCN-specific regions: Sequence locations=1-114,165-231,262-287,326-364
atgaaaaatattaaagtacgcaattagcagataaatctttacttttgtatatgcctaacttaaacaaataaaatttttactgcaaaacgaattgcataaaaatgttaagtcgagattaattaaattattcgtttatcttataattattatttctaatatttaaacagagaattaaaaatctttttttaaagaacccctttttttattccattaaagtattttgaagattatataacttaaaatttaaagaatttgttgaatcttaataaagttaacgcaagtagttcattattttttattgataaaaaataaaaatgaaatataactcctattagttagaaataattgtatgaattaaatggaa

SEQ ID NO: 64227 - DNA, 535 bp, Heterodera glycines
  Genomic contig location: Contig_ID=SeqID_34429; Location=36..570; Strand=-
  SCN-specific regions: Sequence locations=1-16,38-200,222-535
ggggatgagagagtcggagaaggaaaggaagagacagtacaagagggtggaagaaagggcttgtccttcaaggtggttgcggacaagaatggaaatacggtggtgtacaacgacagggacgtgccgattgggacgggttctgtgcggaaagtgggcgaacgatcatatgaggtaaaatataaaaagaatttaaacataattctgcatttttgatcactcgcaacaacaggcggtgatcagcaagaatctgttcatcactcggctgaaggatgcccggcggggcccatgctgcagagagttgacgggcgaagaatgcaccgaatccattaaggtatcggtcagcactggtcaattatcagtccgatcactttgcagttggccaacccgcagttcagtcacccgagccaaagggacgacaatggcacgacgaggctgacctggtccgacctttgctttatccctccctttggcttaagcttcgagtgattcaggcccgactgtttcgacatgtccatcgatgtcactttgccaccaa

SEQ ID NO: 64228 - DNA, 440 bp, Heterodera glycines
  Genomic contig location: Contig_ID=SeqID_7238; Location=2992..3431; Strand=-
  SCN-specific regions: Sequence locations=1-107,145-405
atgataaaatcgattcttcatgatactgggccgcttcaaaagcacaaactggttaaaaaaatattggagacctacaaactgaattcgaaaaagcatgtaataatgacaattttttatatattttatttaaatattatttaatttgtttaggtcaattcccgagttaaaaagactctgcggacctacgttgggaatggtgagctcgcagttgcagctggaagatattcggtggccgcatcgggcggtggtgataaatgatttgtttgatggttccattttgtaaaaaattgagaaatattttaagggaaagcaaaaaatgtttaatgagaaaaaggggaaaacgggagaccaaagaattgattaaatgaaagtttaattctttttacaaataacaaaaagattaagaaatttttatttttttaaaagataacaataataaa

SEQ ID NO: 64229 - DNA, 986 bp, Heterodera glycines
  Genomic contig location: Contig_ID=SeqID_7239; Location=194..1179; Strand=-
  SCN-specific regions: Sequence locations=1-3,25-398,422-478,500 -546,576-596,625-986
atgaaagagacaccacaaaacagatcaacttttatgagagatcaacagtttatggatcgattaacagttagccaaaaatcggtgctaaaatcgtccaattatttgattggcatttatgttcccggggggcgaaggttctcgtatccggggggtggaacggctgggttgaaaatcgcaactccgttttggtcatattggagacccatcggcatttgaggactcgctaaatcatgtttttagggcgatgttttgaggcggcataaaaataacactacccccgttaacgcgctcaaacaggcgagggtcattcagtaggtgggcgggccctctaaacacataaaacaccggaggtgggggagccgggttgaacagttgtctcacccatctggttcggtatatgattagtcatttgatttataattgaaaaaatgttacttactcccatataaatgtgggcgaactaaaagtttttaaatatgtgtatggtgaaggagtggagaattttctaccttggtttagtggaattggccggatgcgttcaaaatttgctaaataaaaaataataaatgaaatagagctgatttattaatgctaggaataagttaaattaaaattaaacgattttaggtggatgtttttattgcaacaaaaacggacccgcataatcgaactagatttcaaaaacgtcccacaaaacgacttagttcaattaagaaatcataaagaacgactagaaattttctgaaatttaaatccgtgaaaatttaacatatattgatagtattgatcaaaattctacagttggcaaagttgcatgatttattgaaaattttgggaaaattatagtttactctatccacctgagtatcgattgttctggcggttaaagcgaccgcgccagttcctgttattgcgcacccgtctgccacgaaaaggctcattccgatacccttggtccgcacggtttccttggataaataattaaa

SEQ ID NO: 64230 - DNA, 628 bp, Heterodera glycines
  Genomic contig location: Contig_ID=SeqID_7239; Location=1960..2587; Strand=+
  SCN-specific regions: Sequence locations=1-334,357-402,434-540,570-628
atgtctgtgaatttatattgtaaaggaattacagacccggtagtaatacctatcagaccgaaggagcaaatatctgcggatacgattcttaatgagtttattaaattacaacaatcgtattcggaaatcaatttactcgatcaagaaatatctgtaattttcaccacttattcaacacctgctggaagcggtaaaaaaatataattaattcatatgctcatcatttttaggcagaaaatcaaataaattaatggaaaaaaatgatcttagtcgtattcgtatttctaacgctgacagtttcggtaagtggttaatcaaaaagaggatttaaattggtttttcaggtttattttatgccttagagctcacccgtcattaccagctcattaacaatgggataacatataaaaaatatttatgtattataaataatccaaaaaaacaaaaaactattgtgcgagatttgatgaatgaggcggacattaatcaaaaagaaaaatcctacgggctcgatcatatcaaattaattcaaaatttttgggatcaaaaatattcaaaaatatatagaattgttgcctttgacgatgtaagaatattctcgaaaaaactttctttatttgtgttttag

SEQ ID NO: 64231 - DNA, 720 bp, Heterodera glycines
  Genomic contig location: Contig_ID=SeqID_34432; Location=48..767; Strand=-
  SCN-specific regions: Sequence locations=1-405,496-720
atgtcgtctccgccaccgctgtcggagaagtcgcaacaaccgctggcgacaggcaatgatggcacggcagcagcgacaacgacggcacagcaagcgtcgccgctcaaaagcggcggcggcggggtcaaagacagtcccaagttggggaagaagcgcaggacgagcgcgacaacgacggcaccgacagttgtgagggggaaacaaattagcgggatctaaattgataaccaattaaatttagtaaaaatttcagaattttgggtcaattatcgccaattgattggcgccattttcttttgttatcaaaaaaaattggctccaaaattctcaaatttaatatcaacggagcagattatgcctaagctaatctatgctttttgagcttaattttccaaaccgattatctaaaaaataatatttttaggtttttttcatttagatttttgtaaaaaattaattttatttatttttttgtagaaaaaagtaacagcagcaccagcaacagaaaaagtagaacaacaacaatctgccaaagacaacaaaaattatgccaaaaatagcgacggcactgcagtggtttcgaagcgaaaagcgtcgccaaaaacggcaacaacaacgcccgcgggcaccgcagcacaaccatgcgccgcaacaacggaaaagcaacaactgcaaccggcacaacaaatgccatcgatgaaacgcgtgacgggcaataaa

SEQ ID NO: 64232 - DNA, 263 bp, Heterodera glycines
  Genomic contig location: Contig_ID=SeqID_34434; Location=220..482; Strand=-
  SCN-specific regions: Sequence locations=1-68,90-113,135-185,207-263
atgaaaaacaaagttttagttccacaaaagcccagtaattggaatcataaacaagtatttcttttttcaaataattttataaaatttttcagccttctccttcatttgctaatgtcaaaattggaaataaaatacagtgcatggccaagaacatttgcgatttgtttgtttctttaatactttctttaaatgaattgcctaaaatttgctcttttttcaaggagtgtaatgtggaagcgagcaaagcttacgaaacgctttga

SEQ ID NO: 64233 - DNA, 801 bp, Heterodera glycines
  Genomic contig location: Contig_ID=SeqID_34437; Location=42..842; Strand=+
  SCN-specific regions: Sequence locations=1-159,181-397,419-801
atggtgccggtttggcgatggtaagtcggccggggcgtgggaagtcggcgatttgttatcggacactaaaatttcgaacagaaatcaaaaatacgagtgtctcgtcggtcacattaaattgcgatgaatttgtaagatattatttcccttgttccgctaggccaccatggacatcatcaaattgcacggcggcgaacccgcaaattttttggacgttggtggcggcgcaacagttgaacaggtggtggggtcgggtttttcatcaatggtaaattggatggaaagctgaaaaaattgagaaattttctgaaattttgcattagcataatacacacacacacacacacttattgttagaactatcgtggcaaacaaatgcataatttggttaacaacgaaaaagttttggcccaaaaaattattcatccggagatgtttttttggtgtgtttttcctcccgaccaattaaaaaaaacaaaaaacaatatttttgttttttctctgattctgagatttgctccaatttgcgccaccgaataaattttaattcatttgaatttggtccaaaatttccaaattttttgtctgtgaatttaatttaaatgctttatcccttccttttttttgcaggtgtacgaggcgttcaaaatcatcactgcggacgagaagaaggtcaatgccattctggtgaacattttcggtggcattatgcgctgcgatgtgatcgcccaaggcattatcaaagcggcggtcggtgaattcgcttttttctctttttttcttacaattcgccataggaaa

SEQ ID NO: 64234 - DNA, 83 bp, Heterodera glycines
  Genomic contig location: Contig_ID=SeqID_7241; Location=1293..1375; Strand=-
  SCN-specific regions: Sequence locations=1-83
tccatttaaggtacttggactttccgcagtaaaatgtggtacaaaattttggaactgtcccgcctcacggtgggacttaaaag

SEQ ID NO: 64235 - DNA, 264 bp, Heterodera glycines
  Genomic contig location: Contig_ID=SeqID_34442; Location=326..589; Strand=-
  SCN-specific regions: Sequence locations=1-188,210-264
atgccgaaatatggatgtcaaatatggaaatatggaaaaaaatctgaaatatggaaaatatgtaagtaacaaggcatcctagaagcatcaaaccaagctaaaaatactatttaggtggttttaggccgaatgagtgtgcaaaaaaatatgaaaatccatacaaatccagtccctggatcattatgtaacatttattttgatattgatttcatctaatcataaatttaacataatttctgctttgaaattaaatgaaaaaataaa

SEQ ID NO: 64236 - DNA, 699 bp, Heterodera glycines
  Genomic contig location: Contig_ID=SeqID_34444; Location=121..819; Strand=-
  SCN-specific regions: Sequence locations=1-1,23-85,130-155,177 -216,306-329,408-493,517-655,679-699
atggatccaatacaggcaagaccgtctaattatgacgacagtgagctgatttcgttgatccaattccatagcatcgacataattgtaaaaataattaaaataattaacttaaaaaaaattaattaatttgtgaggttggcgccttctcttcaatgatttgtgtcataacactttttgtcttcattagttcaaagcaaatgttatgccataatgaggtaatatatttttttaattcattaaagcaacaaatttattttttaaaataatttatctttatttattctttaataaaaaataaaatttaaggatacaagatttcagcaaacttcttaaaaatgaatttaattcaactttttatttctttagtttattataattttgttttaattaaatttttgattaaatttcttctatgagcattttgattttgatttttttattattttaatacttcgaataattgcatatttttaccattttaaaattcttttttatatgttgaagaaataattcattcaaattttctttcagttgctaacattgctcgctgccgctgacctttgcaccagcctcggcatttttgtgctcggtctaatgcgcaaggcactttatgaacaggtcatggaaacaagtccgataccaatgaggaatggtgaacaaaaataaggaaaaagatgttactaatttgaaaataataaa

SEQ ID NO: 64237 - DNA, 70 bp, Heterodera glycines
  Genomic contig location: Contig_ID=SeqID_34446; Location=872..941; Strand=+
  SCN-specific regions: Sequence locations=1-16,38-70
aattactggaagtagcatcatagcagtgcttttcttgtcttttgatgcctcgcaaatctggtcgctctga

SEQ ID NO: 64238 - DNA, 516 bp, Heterodera glycines
  Genomic contig location: Contig_ID=SeqID_34451; Location=296..811; Strand=+
  SCN-specific regions: Sequence locations=1-293,317-516
atggatttagacgccctgcggcgtcgaattgtgactctcgagcaagagatgcgtgaaaatggtggaactcgctctgggctcccaatgccgaccacatttgacgggacgactgatttgcaggattatttgaagtcctttaatttaatcgcgaccgcccacaattggacacccgcacgatttgtgcaagttctcccgctgttcctcagaggatcggcaagggcaacttacgagaacatcgaaccggatattaaagataattggcgaagtctaattgatgccatggcggataagttgaaacaaatgtctccaagtctgacagcaagacagaaattggcacaacggaaacaactgactggagaatcgctggaagaattcgcgcaagcgattcggaacctcgtcttacgtgcttatcccgacaattctctcgagatggactttggaaatttggtgctcggtgctttggaaaatgatgtgaaacaagcaaacgaagtccgacttcgacaattccgttcgtaa

SEQ ID NO: 64239 - DNA, 1280 bp, Heterodera glycines
  misc_feature (474)..(474): n is a, c, g, or t
  misc_feature (739)..(739): n is a, c, g, or t
  misc_feature (757)..(757): n is a, c, g, or t
  misc_feature (765)..(765): n is a, c, g, or t
  misc_feature (775)..(777): n is a, c, g, or t
  misc_feature (822)..(823): n is a, c, g, or t
  misc_feature (841)..(842): n is a, c, g, or t
  misc_feature (908)..(909): n is a, c, g, or t
  misc_feature (930)..(930): n is a, c, g, or t
  Genomic contig location: Contig_ID=SeqID_7242; Location=223..1502; Strand=+
  SCN-specific regions: Sequence locations=1-867,941-1023,1045 -1102,1126-1280
gctgaggaagactcagccgacgcatcggccgaagacgaagacacaacgacgccgcaacttttcatagccgaaatactgcaaatccatctgtacaagccgtccgaattcctcaagaatctgatccaggaaacgcttctttcgttggctcagaatggctcactgctcggactcaccaatttgcttgtgcttgttttggtggtcatcaatcggtcggtcgattggtcaaaaacagtcaagtgatcaatccgatcaccgcccaatcgcagttcgatgagtggcaaaggcattcgcatttcacgtgccaaagtgattgctgtgttcgccggcgtttggctgttcctcgtcgtcagtcacgtgcttttctccgcacttcagtacttcgctgtctcgcagctgcacgaactgttggagttgaccagcagcaaccccagccaatttgcatgtcgacggtactctcagccaataagaaatggnggggggggggtcgaacccacggcccacctatttcatgggactgatttcttgatcactgggcctgatttgccgataattcactcctcccactccccccccccccccgctcttttagaagtgccactttcatggtgtacaatgaaatcggagagcgctgcgatcggttggccgtttaccaagagttgggccactttctgctcagaggtcacactctgttcaccgttgtgctgctgtccatttctttggtcattttcgtaatcactgntgtattagccatcgccgncgtccaanagagcaacannncattttctagaatagaaaatagcgacaaatcaggcaaaaatagcnncggcggaagagaagcganncggggggaaacggacagtagagagcgggcggaagcactagtgaggagaagagcggtagagtaggcnngggcgggggcagggagggggnggggggggggtctcgaactgatgaatgcttttcgtttttcagtgactcgagcccattccgccggcgtgaaacgctcttccaaactctcgtcctttcgctgttcgtttgtccttccgtttgttttgctttcattccgtcccttcttttccagcattgctttcttcctgtcgctgttctcccaaagcttcatcgaaatgtatgtgatggtggtcaacgatcgtcgcgagatcgcctggtgggcctccgtctatcagctgagtcgcattgcggcgttcatcgacccgttgtttaaccccgtgctggtggccgtccgcactccgatcattcgcagacgcgtaaattatcactga

SEQ ID NO: 64240 - DNA, 566 bp, Heterodera glycines
  Genomic contig location: Contig_ID=SeqID_7244; Location=53..618; Strand=-
  SCN-specific regions: Sequence locations=1-192,214-282,308-365,401-566
atgctttccccgacattcacagtcagaggttcaatccatgtcgataatttcggtgtactgcttgaccctgatggaaaactcggcaatcatttgtcacttgtgcgggttggtcagcttatcattgcccaggctcggctctgtttggtccctgaacgacaatcgccactttggtttattgtcaatgtgatttgcgaagagaaagaagaggaatatgtaaaagaagaagaagcggatgttggtgacgaacaaagtcatgcttacgacttaatgagcgaagacaaccaaaacaaagaaaacgaaactgaaattggaggcgaacctgacgatgagttcgacgtaatcgacggaggatttgggggaggatggaaaaagacggagaagaagcgggtggaagcagaactgaaaagggaggagaagagttgcgtcgaagagagtttggacgcgagcattggcgagtcgtcgatcagcagcagcgagtcaattcgcagtgccacggaaaatctgccgatgagtgacggaattgcgttgttcattcagatcagaagttatgagtggatattggcgct

SEQ ID NO: 64241 - DNA, 696 bp, Heterodera glycines; identical to SEQ ID NO: 34456
  Genomic contig location: Contig_ID=SeqID_34456; Location=1..696; Strand=+
  SCN-specific regions: Sequence locations=1-696

SEQ ID NO: 64242 - DNA, 132 bp, Heterodera glycines
  Genomic contig location: Contig_ID=SeqID_34458; Location=28..159; Strand=-
  SCN-specific regions: Sequence locations=1-132
gaccgtgcccaaattgagctggcgcgtaaggccaagctgcgggtggacgcactgttcaaggacgtccttgacaagcggtacgacgcggttgtgttgccgggcggtcagccgggctccgacaatttggccgct

SEQ ID NO: 64243 - DNA, 92 bp, Heterodera glycines
  Genomic contig location: Contig_ID=SeqID_34460; Location=152..243; Strand=-
  SCN-specific regions: Sequence locations=1-92
ggattatttttcaaaacacctcgtagactggggtataattggagactgcgggattaatagagactgggctataattagagcgatatacggta

SEQ ID NO: 64244 - DNA, 359 bp, Heterodera glycines
  Genomic contig location: Contig_ID=SeqID_34461; Location=44..402; Strand=-
  SCN-specific regions: Sequence locations=1-181,208-359
atggcattgactcttccgctatattttttcgatggcatccgtcgtcttcttccgccccgtgtttcctcgagtccgtccaccagcgatcaatatcgtcttgcttctcatatcattgctcattgctccatctttgaccaggttatttttatcggataggcaaaagtttttaggaaatatcaacataatataaatatattattttaatttgcttttttcaggtccgttggagacgcgtctcaaaggcttttaagcaggcaattgatgcccgcataaacaaatacacacgaattgatgtgcgttgctatcctggactttcacaactcagcgaagagggcacgaggggaagaggttttggataa

SEQ ID NO: 64245 - DNA, 477 bp, Heterodera glycines
  Genomic contig location: Contig_ID=SeqID_7245; Location=71..547; Strand=-
  SCN-specific regions: Sequence locations=1-336,361-477
atgttaacagttagttatttatgaattaaacattattttttataaattgtcaatttcgatacaaaattaactttttgaattctgcaaacaattattctcaatatatgtaaatttccgcttttttgccggcacaaatggcagcagtgaaattataaatattctttcaatttaagtaaaaccaaaagaatcaaaagatactattttaaaaaaaatcttaaaatgaataaaagataaagctatttttaattcaatttattacatttttaccaatatttttggtttttttagaaaaggcctacgacaagctatatggaggctacaagggataaaattgactataataattaaaaattattttttcagagaaatttttttgaaagtgaacctttaaaattaaaaatctgtttttaaatctgatatattaaaaaaacttaaacaaaaaagaagacactcaaatttcaaaaaaaatttaataaa

SEQ ID NO: 64246 - DNA, 928 bp, Heterodera glycines
  Genomic contig location: Contig_ID=SeqID_7247; Location=1124..2051; Strand=+
  SCN-specific regions: Sequence locations=1-32,69-74,257-411,437 -523,545-642,665-765,787-848,870-928
atgcatattgcaaatgcgaaagtgcaatttgcaatatgcatgcgagtgcatgcacatgtttgtgcatgtgtgaatgagcgagtgagtgtgagtgatagtgagagtgagagtgagtgatagtgtgaatgaaagtgagagtgagagtgagtgagcgtgaatgagagtgagagtgagtgagagtgtgagtgagagtgagagtgagtgagtgagagcgagagtgagtgagtgtgagtgtgaatgagagtgagagtgagtgtgtgaacgagcgtttgatcgagcgtgcgttaagcgtatgagtgcgcgcgttatgcatgtgcgcgtgtgcattaaacgcatgcgcctgtatggccgtgtatccgcgtttgaacttgtatgtgcgaaaatgagctgtccaaataaatcccccgccgcaataaaataattttttataatttttctgccaatcaatattcttcgtgacagccgaaaaaatccgtgccagcctaaaaaatcggtgccacccaaaaaaatcaacaccaacagttaagaaaattaagagactcccatctctctaaattccaacacctaataccctcaaaaactgttgtaaacagcgaaccatttttattttatcgatcaatatgtaaatagtaatagaaaatgagacacatttgttttttaatattgtgatttgtgatcattatattatagatatgtacttagacatctcttctgtttaatgtccctattcttccctagaaatccccttttttttgttttcaacacatttttacacatattttcatattaaacggtaataccaacaaattatatggtcgaaatgtcaacattaaatccgcgtccaaaattaccaatttttaaattttcttatcctcctggcattcttttacccgctgtcaccccttcccctgcttcccttagtacatca

SEQ ID NO: 64247 - DNA, 1365 bp, Heterodera glycines
  Genomic contig location: Contig_ID=SeqID_7247; Location=2164..3528; Strand=-
  SCN-specific regions: Sequence locations=1-294,316-574,674-896,918 -1186,1208-1365
  Gene Ontology: Mol. function=specific transcriptional repressor activity; Cellular component=nucleus; Biological process=DNA repair
atgcaaaagggtgacaaagactggcagccatctttgggctccatcttagaactacagtttttatcgacaaataatggtggtcttggtgttccaattgagggaattacgtcgccctatttttatttacgaaaagccggctcatattttaccgcccacactgagaattctgacctttatagtgtgaatttattgtgcccttcaagcggaactgacaatgttggcataactatatggtacttttagtggggggggggtctttttatgacaatgtattttcaggtattcgattccggcggcagattttttgaaatttaaaaatctgctctcaaccttttttgttaaagaattcacaaatgatccggaatatttgcggaataagtcaattttggtgaaccctaatatcatccgtgaaaataggatccgatgtatccgaactgtgagttatcaataaagataagattttaagaaaaatatattttcacatagtgtttagtaatttttggtatctaaaacatttttttttgaatattttttcgaagcttgtgactagcaaaaacattatcatagtgattggaaattatttttttaaaagaaattttataaccatatcagtttaatatataaaatattatccctaattttattataataaaaaacgtttatattttattatgttcagcgtgctggtgagggtataataactctcccgggttctgtgcattttgggttttcaacggtgagaaaaaaaactttgagccaaaattttttgatatatattagggattaaattgtgctgttgcgtacaatgttggtccaccgtcttggattccatatggaattgattctaaaccatgctctggcgtctataaatatgcatttatagaggcatttgagctagcaaaactttatgtgcttaaatgtgaagatggtgacaccgctcgagcagcagaattatggaacaccaagtataaaaacatattgaactatgggcatgggttcgatcctatctacccaaactgtcgcccgactatcacctaatctgatgacatcataccgagaaagtatgtactactgtccgggatttggtttagaagtgaaggattaatcgagaaagaaacgggaattcggcgtggcattagatatcgatgtattaattataattgtagggcctcttcaacttatgatctttccactttattgtttacaaatactaatcccacccatcagccggttgagcataattttgaacctaatcgatccttgattaatttaccatattatgtactattttaaattttttttgtttgatttttcttgcaatttagttgccgatgttctgtttattcttttctattaaataataaa

SEQ ID NO: 64248 - DNA, 322 bp, Heterodera glycines
  Genomic contig location: Contig_ID=SeqID_7248; Location=939..1260; Strand=-
  SCN-specific regions: Sequence locations=1-322
atggagttgcctcaacaggccaaatttgtaacaatggaaaggaatcctgaatatgtagcaccattttcaaagggagataaaataggagttttccacaacaaaagagagaattgcctttcatattttttgaacggtgatttgctaggtgcgtgttagataattttttttgtgattgtaatatttattttaaggccaaaataaacaattcatcgcggattcaagtgggctgtggcctgccgtaacactacggcacccaggcgatcgtgtggaattccgggtcgattctgaattgggtcaaatgccgggaggactttggaaatga

SEQ ID NO: 64249 - DNA, 49 bp, Heterodera glycines
  Genomic contig location: Contig_ID=SeqID_34462; Location=70..118; Strand=-
  SCN-specific regions: Sequence locations=1-49
ggaagctattcccgaaggattcggtctccccataaatctgggagcatcg

SEQ ID NO: 64250 - DNA, 661 bp, Heterodera glycines
  Genomic contig location: Contig_ID=SeqID_34464; Location=50..710; Strand=+
  SCN-specific regions: Sequence locations=1-605,631-661
atggatttggtggagagtggactgctagctgattcgttgcgtgaagaaggcgtgcagagggctgagctaaagcggaaggcgaaagtcgcgctcgatctgattgatgccggtttgaccggcgatgcactgcatgaggagggacaacgttggaagaaggccaaaactgcactcagcgttctcggaaacatgttgttggccgattcacttccggaaaagaagactgcggagctcccgcttccgccagccgaaaaaattgaatcactgccacttccaccactcgaaaaaatgaaaacacccccacttccacctgccgacaaaatgccttcgccgctcccaccatgatcaaaagtggaaagtgatgagcaacaattctacgacagcatttctgcggctaccactatgatggacagcgcctcaatgcagcagcaggcgccgctcaaaagaaaacagctgactccaaaaggcaaaagcaacaatggtatgaagaaggcagctgagccgcagcatcatcacaatgtgggggacatggacaagactcttgacgaattttttgagagcgttagcgcagcgacgaccaatttgtctatataaattgttgtttcatgcaattgtattgaattttaattaattcattaatacgaaatgctgaattctttctcca

SEQ ID NO: 64251 - DNA, 209 bp, Heterodera glycines
  Genomic contig location: Contig_ID=SeqID_34466; Location=474..682; Strand=-
  SCN-specific regions: Sequence locations=1-97,127-209
ctcaaaaattttggttaagtttcaaaaaagttatggccagaaggaactcaaaaccccagtaattcgaactttttttggctctgatttttttgtgtataaataaaaattttggaaaatttgcaggctaatagcatttttcgaatgctttcgaataataccaagaatgtttaatttggttgagaaagaaaaaagttatggtcgaaaaattc

SEQ ID NO: 64252 - DNA, 91 bp, Heterodera glycines; identical to SEQ ID NO: 53030
  Genomic contig location: Contig_ID=SeqID_34468; Location=428..518; Strand=+
  SCN-specific regions: Sequence locations=1-91

SEQ ID NO: 64253 - DNA, 1581 bp, Heterodera glycines
  Genomic contig location: Contig_ID=SeqID_7249; Location=254..1834; Strand=+
  SCN-specific regions: Sequence locations=1-552,574-1415,1437-1581
atgcgcatgcagaaccctgctggcctcatggggacaatgtatgcgcctgccagcggtggatttttcctgccacaggccatccagaaccaacgtgctgcgccgttcatgcaaacaccgaatctgtccggggcacaaatgcgtggcgctgtccctcgctggaacaatatgggcggtttcagtgaggagtgccaaatggtgtctttgtttggcatttccattttttttgtagatcatccaatgcaaggctacatgatgggtccagctggtggcggtcagttcggcggcgctaaccaaattgctcgtggaggacctcgctccggtggtggcggaggaatgcgtcagtacgggggacaaccgcgccagcaacagaaccgcatgcctggtatgggcggaggccatcagcagcaaggaatgcgttaccaggtgaaaacatgcataaaaaccgacacgcaaaaaaaggggtacatggggcgagactgatccaggggggggactgatataaattccaacaaatttcaaaaaaatccgccaaacaaaaattagaacaaaaagattttattaaatattaaaaatgaggatggtgttcgtatattggacaaaaaacttgtgcaccgccccaatgtttttttttcaattgcagggacagccgagaggaatgcaacaacaacagcaggctcaacaaccacaaattgcctattcgtcgtatccgcagcagcagagccgtggcggcatggcaccacagatgggtggcggaggcggtggaggagtcaaagctgaccatgcgatcactgctacacaccaggaaccgttgaatacacatgatgcttaccgaggctgccatcactgtatgtattgctgtctgtcatcaattaaattcacctataattttttattttttcctaaatagggacaaaagcaaatgtatggtgagcgtctgtacgcgatggttgccagttgcttccgggacggtgatgtcgagaaagttggcaagatcacgggaattcttctcgagatggagaatgccgagattttggtcggtttttttcatcactcacaagcatagctgtgcgggggggcggttgtgacgccgaacgcaaggggtcggcgggtgtcgaacgcacgaggcggggggagggttgagaaaaaggaaaagaaaaaaagagaaaaagggagcggcaacatcaaggaaatggtcgcgaaattgcgttcgactaaccctgaggggtttctcgtcgaacgcaaaaaaatgaagacttgaaaattgattagtttctttaagaaatttcgctaaaattttccaatttttctgcgactgacaccattttcctcctgcgttcgacgaattttgctgaagaaaattcgtcaaacacaagaagaggggctgaaaattttctcaaataaaatttgtctttcatgtcagattttcccaaaatggcatgtcattatttttttgttatttagttgttgcttggagacgaggaaatgttgcgtttgcgcgtggacgaagcagcaacagtgctttaccaggccacgggtcagaaggaggcgcagtaggataaatgaagtggatggattggatga

SEQ ID NO: 64254 - DNA, 936 bp, Heterodera glycines
  Genomic contig location: Contig_ID=SeqID_7249; Location=2082..3017; Strand=-
  SCN-specific regions: Sequence locations=1-936
  Gene Ontology: Mol. function=structural constituent of cytoskeleton; Cellular component=actin cytoskeleton; Biological process=protein targeting
gacaattttttccgctgttgctcaccgcagaagctggacacctggacgtctgtcgagtgctcgtcgagaaaggagcggctcttgaccagcaagaattctttgggaagaccccgttgatttgcgcaagcggtgcgggacgtctggatgttggtgggtagaaaattgacatcaaattcaaacataatttttcaaccttccttttcagtggcttttctggtggacatgggcactgcagttaacaagacggacggcggtggctacaaccctttgatgtacgcagttgaaaatgggcacactgaagtggcgagactccttctggaaaagggcgcggacaaagaacaaattggcgcagatggtgggtttaacacaaaatttcactgttttatattatatatccccccccccttaaggcagacgcgcaatggacttggccgaagaaggaggcggcaatgccgaaatgatgactctgttgcgcacctttggcgggaccaacgcaatggcggagttctgaggagaagagaaatccgttctcttacatgtattgtattctccatgtgtaacatatttgtgtgtttttcaagctcaactgctccgatttgtatgtacttattcaaactgcaaaaaaaaatttcaacatacttaacatgatctctctgtactgaatgaccattatttatttgcttttgcaatagtttttgactaaatttccaaccattttaatcaatttaggaacaaaagaattttgaatttcttgtttggttcagcggttccgacagttaaatatttttttcaaaaaaagtgatcctaccatcggtatattacccccatttcgaccaatctcgaatccctgacacgaattcgaacacaagcccaaaattcgaatttccgtttttagtctaaaaatggcttaaataattttatattgaagcactatga

SEQ ID NO: 64255 - DNA, 1272 bp, Heterodera glycines
  Genomic contig location: Contig_ID=SeqID_7250; Location=98..1369; Strand=-
  SCN-specific regions: Sequence locations=1-566,589-860,886-948,974 -1272
atggtctttgcccggttttgggatgggaatgactttagcgtttttccacatttgtggtataatgccggaagagatggacagattgaagagattggccatatattcaatggcaatggggccgaggtggcgaatttgagcagcggagatgttgtcggggccaagggcggtagaatttttggaggaaatgatgccgctgtgtgtaataatcagccccacccccccgccctcccgaaaattaaaaaaattcttaaaggaaaaaatcctacgagaaatattttttatttttacctaaaaagcggagtgcatcattcattacaaaaaatttctgaaattcaaaaaaaaaaatttttacctcagtggaagttttggtgccgaaagtatcgcacttacatcgattgtgagggcggtgacatggagttgaaacgtcatctgcaggaggacgaacgggaacaggtcggacaaactctcgttgacgggccgccgccctccgaggcgcagcatcggcacgcgcttcgtcatgcaccgcctcccccaaaccgtaagaaaaatttacaaaaaaagtgtaataaaacattagcaaaaatgactattccaaacaatttttattcggaagattaaaaaaaagcaccgatcgtgttgcttcatgaagaatttttttttgggttttaatcgttttttgaattttttcttaaaattttcattatttttttgcgtcgaatgtcctagtgatgtttttgtttggaattttcaagaaaaattcttacaagtagtaaattttttgaatgaatttaaagaaagaaagaaaaaattgaaattttttttagagatttttcaaaattttgtgatgaaaattacttcagtttttaaaaaataatttttttttttctgggggggggggacctgtggatagtgacgatccctttggtgactactttttttccacagcacctggtggtggtggtagtggtggaagcaacaacaaagtctcctccacgccggcaaagctgcgcagcaccaatggtaacaacaataagcgtccacgtccaccgcttctcgaattggaatcggatgacgacgacgctgtcgtcattgaaaatgccatgcaaacgcgggatgccattggacgagcgatgccgcggcacgaggtgccccgaaagcgtacggttttggaagaggaggaaaatggaaatggtggtggtgaacagcaacggattcttcgtcctcctccgatccgattcggtttccttcttctcccaaaactccgccattgcg

SEQ ID NO: 64256 - DNA, 2960 bp, Heterodera glycines
  Genomic contig location: Contig_ID=SeqID_7250; Location=1..2960; Strand=+
  SCN-specific regions: Sequence locations=1-396,422-484,510-781,804 -1606,1628-1645,1669-2207,2230-2281,2303-2960
ccccccccccttaaggcagacgcgcaatggacttggccgaagaaggaggcggcaatgccgaaatgatgactctgttgcacccctttggcgggcccaccgcaatggcggagttttgggagaagaaggaaaccgaatcggatcggaggaggacgaagaatccgttgctgttcaccaccaccatttccattttcctcctcttccaaaaccgtacgctttcggggcacctcgtgccgcggcatcgctcgtccaatggcatcccgcgtttgcatggcattttcaatgacgacagcgtcgtcgtcatccgattccaattcgagaagcggtggacgtggacgcttattgttgttaccattggtgctgcgcagctttgccggcgtggaggagactttgttgttgcttccaccactaccaccaccaccaggtgctgtggaaaaaaagtagtcaccaaagggatcgtcactatccacaggtcccccccccccagaaaaaaaaaaattattttttaaaaactgaagtaattttcatcacaaaattttgaaaaatctctaaaaaaaatttcaattttttctttctttctttaaattcattcaaaaaatttactacttgtaagaatttttcttgaaaattccaaacaaaaacatcactaggacattcgacgcaaaaaaataatgaaaattttaagaaaaaattcaaaaaacgattaaaacccaaaaaaaaattcttcatgaagcaacacgatcggtgcttttttttaatcttccgaataaaaattgtttggaatagtcatttttgctaatgttttattacactttttttgtaaatttttcttacggtttgggggaggcggtgcatgacgaagcgcgtgccgatgctgcgcctcggagggcggcggcccgtcaacgagagtttgtccgacctgttcccgttcgtcctcctgcagatgacgtttcaactccatgtcaccgccctcacaatcgatgtaagtgcgatactttcggcaccaaaacttccactgaggtaaaaatttttttttttgaatttcagaaattttttgtaatgaatgatgcactccgctttttaggtaaaaataaaaaatatttctcgtaggattttttcctttaagaatttttttaattttcgggagggcgggggggtggggctgattattacacacagcggcatcatttcctccaaaaattctaccgcccttggccccgacaacatctccgctgctcaaattcgccacctcggccccattgccattgaatatatggccaatctcttcaatctgtccatctcttccggcattataccacaaatgtggaaaaacgctaaagtcattcccatcccaaaaccgggcaaagaccataccaaccctgccaacttccgtccgatctctcttctctctccaatcgccaaaatccttgaacgcctactactcccctctctcaatacacacctcccacccgcaccacaccaacacggcttccgccatggcttctccactgtcaccgccctacattctatttaccgcttcatcacagacggtctcaaccgaaaacaaccagttgagcgcaccgttgcagtagccctcgacctctcaaaagcatttgacaccgttgaccaccgattactaatatctaatatcgaacatctcaacaacaacactccctgctcatcacaaaagatggctagccaactacctcggcggtcgccaagcccaagtcaccttccgcgacactacctcccccctccacactatccgtatgggagtcccccaaggcagcgttctctcgccaacccttttcaacttttacaccgccaacttcccctcacctcctcccggcattcaaatcgtcacatatgccgatgacatcaccattttggcccgtgccacccaaatcaattctgccagcgaccaaattaactcctttcttccacgtgtcatttcctggctcaacgatagaaagctgatcctctcaacctctaaatcctcatcgaccatcttcacgaccagttcacatgagcaccgcatcgacccccatatccacgccaacgactgtcctatcccagtccttcgtaatcccaaaatactcggcatcacatttgacccacaggtcacctttaatgctcatgtgtccactctccgcaccaaacttcaaaaacgcaacaatatcctccgtgccctcgcaggaacaacctggggccaatgcaaagaagtcctctccaccacttacaaagccattggacgctcattactaaattatgcagctccaatttggtctccccagctggctgactcccactggtcaaccctccaacgctgccaaaactccgccctccggacaaccactggctgtgttactatgacatcctctgaacatctccattcagaaacatccatcctgcccgccaaagatcacaatttccttctctcacaacaattccttcttgcctgccgtgctcccacccatccctccttcgatgttcctcgccctcgtccatctcgccaaatgaaatggaccctcgagcaccgtttcggccatataatagactctaccctatcagatacacgtggagaaatcctaccggcacaaaaactccttcacactcgtatggttgctacaacaattcgttcctccaccaaccgcatccttggcaagccacccccacctatcgacaacagcgaaacttccctcccgcgtgtagcacgctcacgccttgcccaactacgagccggcttctccccgctgatcaacagctacaacgccaaaattaaccctcacataaccaactcatgcccagcgtgcaatgccaccccccacgacacaattcatcttttcaactgcaccgccaaccccactaacctcacaacccaaacgctgtggacccacccccgtctggccgcgactttcttgaaactcatgccagttatccctttcacccagcaaggagtcggc

SEQ ID NO: 64257 - DNA, 1371 bp, Heterodera glycines
  Genomic contig location: Contig_ID=SeqID_7251; Location=17..1387; Strand=-
  SCN-specific regions: Sequence locations=1-170,195-456,478-520,542 -599,626-881,906-1071,1102-1371
atgcggcacactacgggccaagggcgaagcatttgcattggacgccaagggtttgacgatggttggcacccttccatgcgacagtaattttttgaatgatatttattgtgacaaaaaagtatggtaataaaaagcttagggggtgggcattttttgaaatttttttttctttggtaattttgttgttgtttttggatcttcagcggttttgagttttcgtttctaaaactcttaaaaaggctgccatttaacgatttaggtgactattggaaaattttttaactaaaaaaattactttttttagctttgttaatccgtgaactgcccgcgagtgccgatgatttgtctgtccgtcatgcggttgtccgttttactgatgttgagccattgaacgtccgtttggccgcctcgcgactgttcgcattcattcaaatggggtcactgtttgacgcagaaatggcccaccataagctgcaacgaacatgtttatacatcgacaattgtgccggtaccgaaaaccaaaaaattattccttttttaattggctataatttgtcgaaatgccgttgcctttgtaaaaaagtttccttttccccgaaaattctgtcctctttttcaaaaaatcaaatttctagtaattgcacctaatcaaaagtctaattgtagcttagaaaacgggtaatacctataatattaagatttactctttgcctcgccattttgcaaaaaaaaaaacttttttttaaatgccctgaaaatttctcacaattaggcggttttccttgtcgctgatcacaatttggcgtccattttcgaccaactccgaaccccggtctcgaacaaagagtcgaaaattcaaaaaaattatttttttttgattttgcttcaatgcacactaaaaatatgaaaaattgaaagccatcaataaatcattttgtttttaatattactatttactttagtgtttgtctcattttctcgtcattcgttggccaaagttttgagcgaagggcgcgttaaattgttgccagaaacgcaagaaggttttgcatatttattggatttttttttcataatttacacaaaatttaacaaattttttccattttcagatgtccaaatcattgaccaaacaactcataatcagagttcttcgtcttccaccgcaaattcagtgaacactccgtttggaattttgccaatttgttgtatgaaatttttgttttttttggtttaattgctttttgtttagctgagcccgatccagcaaaatttcaatatgagcatagctcgggctatttctacgatccggcaaccggcttttaccatgacccaaaaaccgaattttactactcggccaagagcagaagt

SEQ ID NO: 64258 - DNA, 460 bp, Heterodera glycines
  Genomic contig location: Contig_ID=SeqID_34475; Location=244..703; Strand=-
  SCN-specific regions: Sequence locations=1-64,131-217,254-460
atgttcaaagctgggctcaaattggcctttttgctcttcgcggcgcttttcccgtcaggtaaggaaattattgttttaaattattattttatttttataattactacaaaaataattcatttttaaattaccgtatttcgctaccgtattttgagtttgtattggacatacggtagcgctatagttattggaaatttgtacacatacggtcgagatgttttttttttttttgtatatttatttttcaatttttcagttcctgcattgagatgcgtgtccagcattgcacttacgtacatcaacaacatgaccggcggagtaatgatcgttgacctgagcaagccggttgaatgtgcgttcggttgtgcacgaggaacctgcagcatgaactttggcggtgaattgaacagccattttgggcttcgaattgtgcgcactctgggcgacgacggcgattaca

SEQ ID NO: 64259 - DNA, 75 bp, Heterodera glycines; identical to SEQ ID NO: 54636
  Genomic contig location: Contig_ID=SeqID_7253; Location=61..135; Strand=-
  SCN-specific regions: Sequence locations=1-75

SEQ ID NO: 64260 - DNA, 59 bp, Heterodera glycines
  Genomic contig location: Contig_ID=SeqID_34482; Location=504..562; Strand=-
  SCN-specific regions: Sequence locations=1-59
acttttgtacctcttttaatcactgttgtacctcttctaatcactgttgtacctcttct

SEQ ID NO: 64261 - DNA, 669 bp, Heterodera glycines
  Genomic contig location: Contig_ID=SeqID_34483; Location=57..725; Strand=+
  SCN-specific regions: Sequence locations=1-62,84-186,221-228,250 -289,311-322,358-419,448-669
atgtcgtcaaatgaagaagaagaatccggcggttcaaatgatgaccaattttcgtaagtataaatttattgaatttttataaagaaatgcctaaattacatgtccaaaagtgtggtggcctatgtcggaaagggccaaatgggcgatggcccagttttttggttaagtgtcctttctcatttgttcgaatccaaccaaatttttattatttatattcttaacaagtaacttgtgctctctattagcctgtaaaatttcaaaaaattacgttgagtttcaaaaaaaaacaataaatttgtgccaaaaatgttcggaaaagcagttttttttaaattttatcttaacttttatttttatgacacaatccgggactatgtaaaatgtataaaggcttacattttgttacaaaaattgaaaacaaattttttattttttttgaaaatattagctctccgatcagtccggttagccccattcaaccgatgagcaccgattggagcaacgcaattgacgcgcaggaaatgggcgccggaggtgttggaggagggatcagcagcggaagcctgcatgagagcctgcacgaactttcgcgttggaaaatttttggaaaaaaaattgatgcttccttgcataccttatgaaaaatcgcgtttttagggcaagcgctca

SEQ ID NO: 64262 - DNA, 383 bp, Heterodera glycines
  Genomic contig location: Contig_ID=SeqID_34484; Location=244..626; Strand=+
  SCN-specific regions: Sequence locations=1-264,286-307,329-383
atggccataaaatatggaccaaaaatcgcaaaatatggacataaaattgcgaaaatctcaaaatatggacataaatggcaaaaacgtcaaaatatggacataaatttttcaaaattgagtgtaaaatttcttcaaatttattggttgaaattgcatatgagatatatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttattttgacataa

SEQ ID NO: 64263 - DNA, 154 bp, Heterodera glycines
  Genomic contig location: Contig_ID=SeqID_34484; Location=371..524; Strand=-
  SCN-specific regions: Sequence locations=1-154
tgattgcacgtaattgccgaaaaaattcgagaccaatttccgaatgttgaccgactaattgcaaaacgaaagccgtctttgtcaaagcgccttaccgagtcaaaaaatttggaaatatatctcatatgcaatttcaaccaataaatttgaagaa

SEQ ID NO: 64264 - DNA, 844 bp, Heterodera glycines
  misc_feature (16)..(16): n is a, c, g, or t
  misc_feature (20)..(20): n is a, c, g, or t
  misc_feature (27)..(27): n is a, c, g, or t
  misc_feature (70)..(70): n is a, c, g, or t
  misc_feature (110)..(110): n is a, c, g, or t
  Genomic contig location: Contig_ID=SeqID_34485; Location=185..1028; Strand=-
  SCN-specific regions: Sequence locations=1-163,189-330,361-661,683-844
atgtggcacactcatntacngcatgcngatgtgttcggtcttggcatttatttgacaactcgtgaaattnttctcacaaaaaatgggacaccgtttgggttatttgaatntaaacaaacaaaattaatatttcttaaattaaagtcaaatgattttcgatttgatattggttttaaaaattttagaaacacagaactattaaccaaagtataaaacatttaaactaagatttttcgatcggaaatatctatatgttctatcgttattttaattttaattcgattttttcaatcatcaaaaggaaaaaaggtcaccaagccaaaaagacgctcaaatatgtttttgttaaattaatggacaagtttttaatttttagaacaatcgacttttatttttcgtaatttatttttatttttgatggcgaataaaaaataaagaaaaaaacattttttattttcagttaccgccgccattaccgttccatttccgattgatcacctccagcagcagcagcagcagttgttcccattcgtttctttgctttcgcctgctgatcaaattgaggcaaactttgggccaaactttctctttacgaacacacaaaaataaatgatcggacaatttgctgctactgttcttatgttttcatatcaagcaacttttttaccagcagcaggaatataagggaatttctctttatcaacagtgtaaaaaatggattatattcactcgggaagcatcgaaaatgttccgaaataagtaaatcagtagtaaaaataagtttttagggtcaaaattaagtacattttttaaaacgttgtttttttgcattttattcaataaa

SEQ ID NO: 64265 - DNA, 81 bp, Heterodera glycines
  Genomic contig location: Contig_ID=SeqID_34487; Location=960..1040; Strand=+
  SCN-specific regions: Sequence locations=1-81
tcttcgacgccaaaaatgcaaacggagtgccgccatttgtgcgaggggcaaaacgcgtgcggagcccataaagcctccctg

SEQ ID NO: 64266 - DNA, 1018 bp, Heterodera glycines
  Genomic contig location: Contig_ID=SeqID_7254; Location=978..1995; Strand=-
  SCN-specific regions: Sequence locations=1-193,220-545,616-618,640 -680,703-706,731-741,765-884,906-1018
atgtttatgacgtggacgaacgatgaaaagtatagtggcaaaactatgtttatggatgacgatgatctgctgaaagaggtgttgaacaactatgagattattaatgctccaagtgtaactgaaggggtaagttgcatgaattcttaatgggattaatgttcgttcattatttcggattcttcttcagtctatgttgccttttcctttctatttttaactatttcaagatttttcgtctataagatgcgaccctagtgatagcaaaaaactttacaaaatgcgcaagattcattgctttttttgatagcattcatattttgttttattgcttttcagcatatcaaagaacttaatgcaatcgccagacgacgaatatatgggggtggaatttaccgcactggacttgtgggtgttggcgactacacagcaattgacgctgctgcagtgccaagtgcgatgaaagaactggttgaaacaatcaatcagccaaaggacccgctggaaaatattaaaatggccataagcgctcatctagaactcgtgagataatttaaaatcaaaaaatgttttgtttaaataaatctttaactatgttttaaaataattaattaaaaactccttttgcagctcaaaattcatccttttgatgatggaaatggaaggacttccagacttctgctgaatgttttattgtttaaaaaaggggtaatattttattttatattttaaagagaatgcttcattatttataattttattttatagatgataagactaaattctagtaaatagtctattttataattatgcgtaaaaaacgtccatggtttttgtttggtctttttctgttgaactaatgttaaacttgaaatttactaaatagttaaaaactgtatttccaaatgtttatcctttttagcataagcccatcttgttcaaaccggtagatgaagacaagtacgtaagctgcatcaaagtctatactcttgagacgccggagaacaaatttggtatttaa

SEQ ID NO: 64267 - DNA, 1197 bp, Heterodera glycines
  Genomic contig location: Contig_ID=SeqID_7254; Location=3309..4505; Strand=-
  SCN-specific regions: Sequence locations=1-681,707-1112,1148 -1150,1173-1174
atgcccgactttcatcttcgtcgtcgggaggacaaggaaaagcggcagtcacagccgggccaaccgttcgacatcgacttgaacgagaatcaggggaccatccgagcagtgaaaaccgaggcgcacctgcacattccgatgtcgtccggcaatgtgtgtggtgtcattttttgcactaatatacataattaaatcgtattttcgacccgaatttttcaaaatgaatgtcaaattcgtaatcattttaacaatttttcaaacgcagtatttgaaagttgatcgccttaaataccgttaatttatccgaagttttaaggtgatcaaaatcccattggctgctatccaagagccttcacgtaacatcgacataaaacaaatgcggtcggacatgtgcgcctcgggcatttgcggtccatttctcaagggccattttcggacatttgcgaaatcccccccccccgcccagtcgcacttcatcagcagcagaagcactcactcactgacaaacgttttgtgctttggttattgcgtgaaattgtttttttggggccatttgctatcgattggaaaatgccgttggcttttgctattagtcaatttaactcaatgctttctcactagtctgaccaatttggcatggctgttttattaatgagttgctaatcgatttgttgtacggtatgaaatgaacaaattaatttttcaacgtcatttttgtttccaaattagcaatttgtgggcaaaataacagccagtgaaatcttggcaaaaatcaaaaatataaaattcatagagacatggaggatgaaggaacaacagttcatttgtcttgattaggtcatatgattaatgtattttaacgctaaaaatataattaaattttgccgcatttcttattacatatgagtaggattaggattcttaggtttttacttatttctgcggcttaaactcgaccagaaatgcacgaaaagcacattttttgttcgggaatttttggttttaacgcccctatccgaccctagaaatccctattttgactttgcccctaaaatgttttatccctattggacatttcgccccctatttttgcccttatttcgtgatttttcaaaatatttaagaaaatatttatcaaaaatgaagatttaaagcagcaaaaattgaaatttgcttttaattaatttaaaaaataaa

SEQ ID NO: 64268 - DNA, 518 bp, Heterodera glycines
  Genomic contig location: Contig_ID=SeqID_34494; Location=234..751; Strand=+
  SCN-specific regions: Sequence locations=1-518
gtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaacacgagacataagcgcccgaaggcttggcctgaggaagtgcctaaaccggaatccggagtgctcg

SEQ ID NO: 64269 - DNA, 907 bp, Heterodera glycines
  Genomic contig location: Contig_ID=SeqID_34495; Location=47..953; Strand=-
  SCN-specific regions: Sequence locations=1-534,556-907
caccaaaaaattagtggacaattgcgagaaaaggacgacgtaaatctgaagttgatgagcgaacgcattcgaagcacacaagcacagaaaaagatgagggacgagaaggaactgctggaccaaaacattcagtcgttggagaaccaattggccaccaaactgttacattgccaacggttggaggagaaagagagagtactcaccgaaaaccgagtgacacttgagcacgaattgaggcaagcatttgggaaagctatgcaggagaaaggctaattaaggcaattcaggatcagagaccaaaacaatgaaacattgcgcaaaaagggcattgaattttcacaattggcaacggacctccgcttgagattggaccgattggacatccaattcactgaacttcgcgaggttggctaataaacataggtggacaggggggggggcaatttcgtaaaaatttcggccaaaatttatcagtggtgatggatgaatcgaagtctctttccacggaaaacgaaaatatttaataccttttcattttctctccctttttagagcgtaataaaaaaggcatcctcatacgaagcgaatgccaacaaaattaaacggcttgaggaagagaaaagttcgttgaaacggaagttggaccgagcaaaaagaatggaaaagtacgaaaatgtggacgaattgctgcaggaggaaaatcgcattttgaaggttagtaaataacggagaacacaaagaaacgaaagaattttaggaaagcaaataatttcaaaatttaatttttgaaggagtctctgacctgtccaagttgcaaagtgaatcggaaaaatgccattctggacaagtgccatcacgtgttctgttttgaatgcatccgccttcgctatgacaatcggcggcgaaa

SEQ ID NO: 64270 - DNA, 1113 bp, Heterodera glycines
  misc_feature (520)..(520): n is a, c, g, or t
  Genomic contig location: Contig_ID=SeqID_34496; Location=348..1460; Strand=+
  SCN-specific regions: Sequence locations=1-156,178-197,219-361,403 -531,582-769,835-1000,1022-1113
atggacagctgcgaaagtgtcggcacaaccgacgcggaaggggcagaacaaaagcagaacgtaagcaagctaatgattaatttgtaagatgaaaaaatactctcagaagtattgctaatacaatataaacgagctggggaagttaataactttagcactaaaaacaatttttattttggaacttaaaaaaatattggttttaacaaaatttaaaaattcaattattgtaaaatggagtaggtcggtaggtcacggtctaatcgaaaccgaaaaccgggctatttgttcattacctgggatgtatttaaagtatgttgaaattccgaaatagttatgtatgtacataagttttatttttaatattcttctaaaatatttccaaaaattatttagttatttattctctaaaattgcaatttttataaaaatctgttaacaaatagagccaacctttcttaaaacagttctcaaaatcgaaaaatttgttcagttttttggaacaaatctgttaacaatattntgatacatttgtattaaatatattaaaatttggttttaaataaatccataaaataattattgctggtgcttctttgttcggccaattcatttcaatttcatttggcccattaatcactgcgtattcgctcgacataggcaatattcacctacacacgtgcggcccgtccattgttagctgaagcaaatgcacagctacacaacattactatgacaaattccaagaacgaagacatcaagaacattgtacaataatttatttattttttgtttttataaatattttattaagtacattaaaatttctatttttttctcagattgttgaattgaaagatagtattgttgggtcgctaatcgagttgcgcgatatcgataaatgcgttgaaaaaatcatgacctcaaaggagtcaatgaacgaggaggacgaagtcaatcaggtcctttttctgaaaaatatacattatcgttaagattagtaaaatctacaaaattcaaaaattgtttttccagattaattggagttgctgggatgacgcaatttcgtgctttcacataacctgggaatattcgattttgtattctttaaaaaga

SEQ ID NO: 64271 - DNA, 554 bp, Heterodera glycines
  Genomic contig location: Contig_ID=SeqID_34499; Location=613..1166; Strand=-
  SCN-specific regions: Sequence locations=1-554
gacgaggcagagggggcagaggaattgccccaagccaaactgagaatgggacgactcatcttcagaatgatggacttggagtaatttcagaggctaatctaaacggtataaaccgtttatttcatgttttaattctgttttctttagaaggaactatcatcgatttttccgactctcagccatcgcagcagccgcccattgtcaacgtgccgacgaggggaattttgcgtaattgcaacggcattgacgcagcatcggatgtgcagaaagcaaatggaactgccaccaatgaaggcgaacatcagcttcccatcgccgatcagcctgtgccatttggaggcgcttctgtgccgcgtgtcgcttccgtcactgggcgtgggacgcgaggagtgcgcggcggattgggaagaggaggttcgttttcagtgctaaacactcataatttggtggttagcaccagcacaaaacaacaacatcagtcgtccaccagtgaatgcggagatttcgccacccaaatcggtcaccttcgactcgacgaccgttttcaatggtag

SEQ ID NO: 64272 - DNA, 795 bp, Heterodera glycines
  Genomic contig location: Contig_ID=SeqID_34501; Location=64..858; Strand=+
  SCN-specific regions: Sequence locations=1-304,448-462,484-486,658-795
atggcgccgaacaacaaaaagccgccaacgccgacgaaaaaaacgtctcgcgcttcttccagccaattcgctgcttcttgcggcaccgatggctttgatgactgtccgccctccttggcttcttcctcgttacgtgccattggcttgtcctttgtccgtgccaaactccgatggcgacggttggacgaatttcggctggagtgccgtcgggctgtgatcggatgggcattcatcaacgaatcgttaaaggttcatgtgctcgacacggtggaagatctgtgcgcggaactgagccgatggagtgaataattaaaattataatttattacaaataattaatatttaaaattaatttaagaaaataactgttagtaaaatttatttcccattattattaagatttttaatttataattttttttattttaatttaaaatattaattaaacagtaaacaatacgcatattttttattattttaaaacatattttaattaattaatttaaatttataaagtgtttaatttaattatgtttaaataagtttattaaaatgtattttattttaatgtaatttattttttattaaaatatacttaattttttctttttaattgttttaaaaatatataaataattaattaatttaatttaatttcagttttcttattttagcggaaaagcatgctcaaatatttccggaggaagaaaatcaggccattcgacaagccgccttcaaggcaaaagcacaaagtttggactcggcccattcgctgtacagtcaacgcacatttaa

SEQ ID NO: 64273 - DNA, 86 bp, Heterodera glycines
  Genomic contig location: Contig_ID=SeqID_7257; Location=2214..2299; Strand=-
  SCN-specific regions: Sequence locations=1-86
atcagttccaattatttatccggtcagcacaacacagcaaaaatacaatatatacacatagcaatcagtgatcagaaaagaacaat

SEQ ID NO: 64274 - DNA, 1029 bp, Heterodera glycines
  Genomic contig location: Contig_ID=SeqID_7258; Location=1593..2621; Strand=-
  SCN-specific regions: Sequence locations=1-404,426-1005
atgactactccctccattcgtctcatcgcgacgtccaaggcgcctgctgcgaccggctacaggtggaaacagtggacaacaattgtgaaagctcaatttttttgctttttacagccaggcagtgctcgtcaacaaccagacgctgtacgtgagcggccagaccgggatgatatcaggaaagacggatgtggtgccgggtggagcgcgcgccgaggcgaagcaggcgatgaccaacatcggggagattctgacgtacgccggctcgtccttcaagcacggtgagtgagcaaaagtcggatcacatcatccatcatcagtgaattcccgccccttttcagttatcaactgcaacatcatggtgaccaacatgagcgacttccaggatgtcaacgaaacgttcaagaacttcttcaccccggacacgtaccctgcgcgcagcttcttccaggtggtcaagttgccgaagaatgcactcgtcatgatcgatgcggtggcggttgttgcgggccagtgagccgaagtgcagaagagcgcacagatgaacaacaaatgtacattcgtgtattgtatattgatgtgatcatgtattcgatcctattgtattattgcgtgtaataactgtcctcgttctgatcacgattgtatgtatatattatgttgcgccaatcagataaatgcctattgtatgtattctggtcctcgttaaattttacagaagtccgctaaaatcctttacagcaagtcaaaatttttcgaaaccgagaaagacggcaattgtccggaaaaaccgttcaccgcttggtcaaagagtttttggggctttgaaattcgttttgaatggggcctctagcaaaactaagaatctgactacgattaggtatctagcaacaaaattgagattaaaatgaaaagccacctactcttctcatttaccatcactttgctgatttcaagacagcaatgatgatttttcttgagatgctaattttcagagtgtaatttaactaaaaattgccaatttcgaataaa

SEQ ID NO: 64275 - DNA, 561 bp, Heterodera glycines
  Genomic contig location: Contig_ID=SeqID_7258; Location=575..1135; Strand=+
  SCN-specific regions: Sequence locations=1-38,60-561
  Gene Ontology: Cellular component=cytoplasm; Biological process =regulation of translational termination
cgaacaaacgaccaacgtcctaatttctgaaaccaccattctccaaatggctgctccctccattcgtctcatcaccacgtccaaggcgcctcctgcgacgggtcacaggtcggaacaacggaggccatcaaaaccatcttcatgttttttgttttttcagccaggcagtgctcctcaacaaccagacgctgtacatcagtggccagaccgggatcgcggcggggtcgacgaatgtggtgccgggtggagcgcgagccgaggcgaaacaagcgatgaccaacattggcgagattctgacgtacgccggctcgtccttcaagcacggtgcgtgagcaaaaacctgatcatccagccatcatctgtgaatttgcgccccttttcagtgatcaactgcaacatcatggtggccgcatgagcgacttccaggcggtcaacgagacgatcaagaacttcttcaccgaggacacgtaccctgcgcgcagcttcttccaagtggtcaagttaccgaagagcgcgtacgtcatgatcgacgtggtggcgatcgttcagggccagagctga

SEQ ID NO: 64276 - DNA, 402 bp, Heterodera glycines
  Genomic contig location: Contig_ID=SeqID_34502; Location=45..446; Strand=+
  SCN-specific regions: Sequence locations=1-216,266-284,330-402
atgtgccgtctttgtcggttggattctgttgtggcacatttgctgaaagacaatttggagtggacttttccggaagcgattgaacacgaaatggacagcaataaccaaatcacattggcatcattagctgctgcagaaaatcaaaatttttcagcacaaaattcgaaaatatttcttggcggaaccattggaggtgatacacttagcctatcaatgaattaatttaaattaaaaacttaaattgtttaaggaatttttaaatattgcaaaaaattgtaagaacgtattaaaataatttatagaaaatatttggtatatttttttaaattcactttttaatggattcttgcacttacaataatttttttatacattaaaaaaatgctctaaaattaatttcta

SEQ ID NO: 64277 - DNA, 615 bp, Heterodera glycines
  Genomic contig location: Contig_ID=SeqID_34504; Location=107..721; Strand=+
  SCN-specific regions: Sequence locations=1-350,372-615
  Gene Ontology: Mol. function=gamma DNA-directed DNA polymerase activity; Cellular component=mitochondrion; Biological process=DNA dependent DNA replication
atgtcgtgctcaattttggcggatagtaagaaaattctcgtgcttttgaacttccaacttgtccaatgtacattaagcgaatcgcaaacatttaattggttgacggtgaattcgtaccaacttcaccccaccacgcccgtactgaagtgccggctcagtcaggcactcgaacaaattcagccggccatggccgtgggtgtccagccagctaatctgcacaagttcaactcaatttttaaacggactatcgccaattgggttggttgcggaaccctttccttataaagaaagatattgccgagatatggcttttcctttttacgtttggttcggaagcccactgtcatttgttatctcgcctttgcttgtttattattccgttttttcagtttgtccagtcgagtgcggttgactttctccaccttttactcgtctgcatgcgatggttgtgccgagaatatgaaatcccagcccgttacgtcatttcaattcacgacgaagtcaataagaaatctcataattgttttaccacatttttcaggttcgttatttggtcccggaaaaggacaaatatcgctgtgcgttggctctttcactgagcaatatgtatgtgag

SEQ ID NO: 64278 - DNA, 76 bp, Heterodera glycines; identical to SEQ ID NO: 51235
  Genomic contig location: Contig_ID=SeqID_34506; Location=630..705; Strand=+
  SCN-specific regions: Sequence locations=1-76

SEQ ID NO: 64279 - DNA, 839 bp, Heterodera glycines
  Genomic contig location: Contig_ID=SeqID_34509; Location=1..839; Strand=+
  SCN-specific regions: Sequence locations=1-156,180-315,337-351,373 -401,424-491,513-612,635-671,693-839
caattttcataaatttcaacccctatatttgaatcttttaaccctattttcgcccttattttgtgaatttttttgcccctatttaggtctcaatgttgatttatcgcccctaaaaatcctcgtccttattaatatccggtcgtgcactaacatacttgatatagactgttacaatttctaaaatgaattttacctcaattattatgccaatgcctcgtacaatatcatatgtacaattataatgctataacaggcactcgcgcaaaaacgtcctagagataaatgaccgcagtattgtaaacatgttttttctactaaaaaatataaaaatatatagttctcgtcctgtttaaatttgggaataattaaaaatagtggcatgttatcctgacgctgggtcagttaaaaaatttttccaaaaaaggggggggccatcggtagagtattaccatttcttcattaagaaagcaataatggaatcggaaaaagaatggagcaacaatcaaaagcttatagaccttgccaaaacttcaaaagctaatgtcagaggcacaattccaaagggcttcccttatttcacggtcaattttggtctacagcccgggtttgctcatgtggtcgaagatgaaagaaaatttccgttcaatttcgcgcaggttttccctagtcagtttaaacttttaaaacagttgatttaggaaatcattggaggaatgctcgacttgcctcacagccattggagaaaaccaaaaaagcagagttttgatcaaattatggagagaagaaacaaattgaaaaaaaattggacaaaatacgattggacagaaattgtgagaaga

SEQ ID NO: 64280 - DNA, 1104 bp, Heterodera glycines
  misc_feature (15)..(15): n is a, c, g, or t
  misc_feature (17)..(17): n is a, c, g, or t
  misc_feature (41)..(41): n is a, c, g, or t
  Genomic contig location: Contig_ID=SeqID_34510; Location=41..1144; Strand=+
  SCN-specific regions: Sequence locations=1-102,126-128,151-175,211 -287,329-380,402-1104
atgtggcagcaacancnggaattccaaccaaactctgaatntggttccgcgaaagaattttcttcgtgcctcgtaaaatgcattacaacgtaatgatgttgccaacaaaagcaaagagaagacagagcttttaaaaatactcattggtattatggataaaggggttttgttaatgatttaaaaaattaaataatctaaaataataaaaatcatgatcgcctacaaaaaacaaccaatttttattttttgatatcgatagttctaaatgatttatataattagcctacaaatttttaaaatttattataaaaagttatgataaaaaaatgctcgaaaacgagatttttaactccttcagcaggccataacctttttgaaaccttttttgaatgttaatcaaatttttttgaaatttgcagattaataaagaacattttgaactacaatatctaatgattataaacaaattttgagcatatgccttttttctgcgccttagtttcgatatattaagcataaatagctcattttccacttggtttaaagcttctaacttgcattttttgtgacttttttatacttttttgttgactttcatttttaaggcaaaatttgacttttagcgaagaaaaattccgaaaaataggtttaacttcgaggcggtacaaaaatttccttaccactaggactcaaatgacgagactgaaaataataataaaatctggcgtggtgatcttttgaaaatatttttttgttaaactagcaggttagcggcttcggcgcatctcccgctaggcagtacgattgtgttgtagaattatgaatgataaaaccgactattatggctcggccgcttcgcggcctcgcacccttctcttggcattttcttatggcacaactgggactcagttcttcgacattccaaacactgggactcaaccctccggcatttcaacactgggactcaacccttcggcattccaaacactgggactcagcccaccggcattccaaacgctgggactcaacccaccggcattccaaacactgggactcaacactccggcattccaaacactgagactcaacccaccaccattctaa

SEQ ID NO: 64281 - DNA, 338 bp, Heterodera glycines
  Genomic contig location: Contig_ID=SeqID_7259; Location=1077..1414; Strand=+
  SCN-specific regions: Sequence locations=1-338
atgccgttgttttcccaccggattggacagcggcgagtgccgtgcgtgcggcacgttcagcaacagatgcgcagcagcgagtgggccgcgacggcgacgggtccgtggcgagtgcgacttggccagcaaacgttcgctgtgcgaaatcagcgggacggtgtcgtcgaggcgacactgtgccaaaaaggaaaattcattcaaaaaaaggaaaagcctttttattagcgacaaaaaaatcattcgcgcgaaagcgaaacattttgtttggcatttaaaattatgggaacattttgaaaggtgccattttgttataaaaaagccatcaattgaaaatttca

SEQ ID NO: 64282 - DNA, 901 bp, Heterodera glycines
  Genomic contig location: Contig_ID=SeqID_7260; Location=561..1461; Strand=+
  SCN-specific regions: Sequence locations=1-134,156-544,566-829,853-901
atgaatgctcgagaatggtgtcaagagtcggggcccctcggcactccaccggcaaattttaaagaattttttatttgcatgttcacacccgaaccgaggtccccgcaacaaaagtttttggaaattagccagccaaaagccatgttagccaaatgctcgaattcgaaactcgaaaacataaatgaaaactctttcggacttcagtcagtcattgtaccaaaagtttgcaagaatccgtgtaaaacccatttttaaagccgtcgaaaattttccgattaataagcaccgaaaaggaaggcaccgtattcccctcgttcggcacaaaattcccccaaattttgcctgatagtcggccacggaaaagccaagccctttggcgtccttgcgcagtgtgaccacaatgggcacacaatgccacaccgcaaagccggacagattctccagcgagcgggagcgcagccaccggttggcaccagcggcggacgacgcgcggcatcgtcgccgcgccgccgtgccgcccggcgacagcggtcgcgcaccgcttccgtcgtcttcgtcgtcgtcagcgacggaggccgccaaatcggccagccgaagctccgactttgcctaggaaattaaaaactcaacaatttccagtggaaaatctcagataaattaaatccgattttatggcgtccaaaaaaatgacagaaaaaagtgtaatttatatagataaaatttttatgatgttgaaattttccaagtatggcatttcgaaaatggcagaagataatgaatgtgacaaaaaagataaaaaaaattctaatttaatttttgtttacgagggaaattattaaaaatttaaaaaaacagtttttgctactgaaaaaacggaaaataattattaattgtaagctaa

SEQ ID NO: 64283 - DNA, 1778 bp, Heterodera glycines
  Genomic contig location: Contig_ID=SeqID_7260; Location=981..2758; Strand=-
  SCN-specific regions: Sequence locations=1-289,312-346,381-412,495 -604,627-765,805-986,1038-1101,1123-1273,1323-1346,1370-1633,1655-1778
agctattgggccactcgaatgggccccgaatatgacgtcattgtggtggatgtgaggccggacgagcgtgtgttggaggacggcggattgggcatcgaatggcagggcaccgtggacatttgtgacggtgaaaattggcaaaaaaaggattaaatttaattaattgaatttcgatggcatagactgactgcttcttacccttatgtaacaaacaacatgatatccataagaaaaatttttgatttcacttcataataactgtgtgggaaattccatgcaaatgtatgactaattaattaattgattgattgctgtctaattgacaggactattaattaattatgggtttatttaatttaatgaaaaaaatataaaaattagctgcatattattttttgggtgccatttcaccaataatagaaataaatattcataaaacttattattttgatttaataaatttattctatctgtaatatttaattaattaattacgcctaattgacagtgctattaattaattacatgtttctttctttttaacgaaaaaatttaaaaaaattttggtgcctttaactaattagcgctcatttataatgctcaaaatttttatttcacaaatttcttagctttaattgtttaataaaggaagtcagctgtgttcccaccatttcattgaaagcattcgaaaggatggaccggcagcaaaaacgggcgcactgaaagcgggcgacgaacttttacaggtgccaaaacattgggaggataaatttagtttaattaataaatttaaaataaattttagcggattaattccaaaaatttgataattttaatccttttatcggatttattacaaaattttaggtcaatgaaactgccctttttggtgaatcgtttgtgcgcgttcgcaacgaattgaacggcgcgcaaaagaattgcggcgaatttgtccgtctgattttttgccgaagggctgaaaagggtatttaaaatttttttttttaaatttgaaataattttaaatttcattttaagagcatattaattttgtgatgccatccgagcaaagtttgccgttggcctacccaatattggcctcattgatgtccattgatcagcactttatcaaagtgattttattcatcattagaaattttaagagctcgtgaaaaaattcgaaaaaaatttattttagaggtttttacaaggcaaacgaaagttgtaaaaaaactatatacctaaataaataaaacagatctcatttatgatcaaatattttataatcaatttttatttagcttacaattaataattattttccgttttttcagtagcaaaaactgtttttttaaatttttaataatttccctcgtaaacaaaaattaaattagaattttttttatcttttttgtcacattcattatcttctgccattttcgaaatgccatacttggaaaatttcaacatcataaaaattttatctatataaattacacttttttctgtcatttttttggacgccataaaatcggatttaatttatctgagattttccactggaaattgttgagtttttaatttcctaggcaaagtcggagcttcggctggccgatttggcggcctccgtcgctgacgacgacgaagacgacggaagcggtgcgcgaccgctgtcgccgggcggcacggcggcgcggcgacgatgccgcgcgtcgtccgccgctggtgccaaccggtggctgcgctcccgctcgctggagaatctgtccggctttgcg

SEQ ID NO: 64284 - DNA, 1027 bp, Heterodera glycines
  Genomic contig location: Contig_ID=SeqID_34513; Location=485..1511; Strand=+
  SCN-specific regions: Sequence locations=1-58,149-178,229-416,438-1027
atggttgcgcaacagcaaaagccaagacggaagcggtcacggagtgaggacatgcacaaggaggagccggaggatgatgatgaagaggatgaggaggaagaagcgacggcacggaagcggaagagaagtgaggaagcggtggatgaggcgccgcagcggtcgtcggatggtggggacgaggaaaagcagcagcgcagcagcaacaaccacaacatccatcgtcacaaacgcgagcaacaccaccaccgggaggcgacggcacggagcaacagcggtggcaaaacggcgacgacgaagacaccaccggcggcacaggagaagcggaagatgaagccgccgagaaagcatgccgataatggtggtggtgatgacgcagtgaaggaagaaaacgccgccactgacgatgtcatgaggagtggggcagcagctgctgctgatgaggctgaagcggcgcatgggctggaggaggtggacagcgttggtccgtacattaactcattcagtattcgaggcgggaaaggtttccgataaagccccaacatttcaaccccctccccccccccttctgaaagggtgcttaaattgctcaggatggctactttaagcagattttcaccaaaaatttctacctaatttatgtatttagcaaaattttttttggaaaatttgggtgaaggaggtgaaaaaaacggtttatgccagaaaatttgattttctctcctcttagaaaaatgcttttttttatttaacaggtaaacaatttgactgggaaggaggagaagaggaggaggaggatgttgaattgggctttgaccttgtagagaatgaccatttggaccatggaaatgacgatggcgatgacgaaacggttgtggtggctgtggtgatgcaaaacgatgacgaagctgacaatggtggtggtgaccaatcggttgctgaacatgaacaacaacaaaatggccatgatcaacaattgcaggtttttttaggaacgtgtaaaaaatgggtttttgatatttttggttga

SEQ ID NO: 64285 - DNA, 207 bp, Heterodera glycines
  Genomic contig location: Contig_ID=SeqID_34519; Location=1..207; Strand=-
  SCN-specific regions: Sequence locations=1-207
aaaattccctcaaaaataaaaggtctattgcgcaccgccctctctatcatgctcgagagcatttgtatgtgtataaaatttatcaaaaaaagagatagccatttttctgggataacctctaaatataaaaatcctctgtgaaataaaatggcgattgtgcacagcccctccgtctcatacgcaagcgcttttgtgaggtataaaatt

SEQ ID NO: 64286 - DNA, 304 bp, Heterodera glycines; identical to SEQ ID NO: 53844
  Genomic contig location: Contig_ID=SeqID_34519; Location=537..840; Strand=-
  SCN-specific regions: Sequence locations=1-304

SEQ ID NO: 64287 - DNA, 503 bp, Heterodera glycines
  Genomic contig location: Contig_ID=SeqID_34520; Location=110..612; Strand=-
  SCN-specific regions: Sequence locations=1-270,292-503
atgacactcgcatgtgataccatatcatatgtgccgtcatatgtaagttccgcatacgatatgttcttatggcacgtcagttcataattgaaacgtggatatgatttatgacacgtcatatctgagatatcatccgaattgaaataggccctggataattaaattagctcatcaaatggtcattccaatgtgtccatttggtttcagttcgttttatttctcccaaaagcactgaccaagatgggcatatccgggactccgtcgatcaatgcccggcaattccaagctgctgtccgcgtacccaatggccttctcaaactcggccaaccgttcgttggccctggccaaattgagcagcgcctcggacttcataaaatcgtcctggtgaccgttggccaagtcgacctgctcaacggcctgtgagattggctcagtttaattaattaattacttcattagtaatgtcagagagacaattaatgaacgatttcattataaataaa

SEQ ID NO: 64288 - DNA, 931 bp, Heterodera glycines
  Genomic contig location: Contig_ID=SeqID_928; Location=311..1241; Strand=-
  SCN-specific regions: Sequence locations=1-351,375-385,407-440,462 -489,519-569,601-931
atgccgacacttcaagctgagcaacatccgccaccactgtcgccacaaacaaacaatgtacagcagcaacaaccaactgtaccgagtccgctgaacgagcgccaacagagtgtacaaccaacgcagggtgaacatccacaaatccgggcaaacgccaccttgcaaacaaacatggttcaagcgcagcagcagcagcagcaaagtcatcagtttttggcacttgaccacgacaatgacgatcagcttttgaaccaaatttttttggtagcaaaataaaaaaataataaccagcaattgacatgccaattacaggatctcaccacttccgctgaaatgcaacctatcgccttggataacaacaacaacaataatatggttagcaagaatttttggtttgtttatttgtctaatattccattttgttttagaatccacaaatttcttcgtcagcatcttcatctcgtcgccgaaacaatgccaatgccggacgtggccgaggaagaggaggaggaaccagacgcagagcggtgagacgcatgaatgaatgaagattaaaaaaacattttgtgaattattattatttgtttatttttaaataaagaatgctcgtcaacagccccaaagcgaacgaattcagtcgtcccaaccccaaacggtccaaatactttctccatcagtggttcaacatggccaaggtttaacacgtgaacaatgcgatagtatacttcccaatctggaagtgaacgaggcaatggtccgaaatgatgagcgatgtgttatttgccaaatgggatttgacttggggtcattgaatgctaccgaactcccatgtaaacatctttatcatttgtcatgcgctagagattggcttatgcaccaaaatcgttgtgccatttgtatgcgccgttttgtgcttgactctgatgcttaa

SEQ ID NO: 64289 - DNA, 842 bp, Heterodera glycines
  Genomic contig location: Contig_ID=SeqID_928; Location=1358..2199; Strand=-
  SCN-specific regions: Sequence locations=1-147,171-235,261-708,737-842
atgtcacaaatgctgccatttgttcaaagcccattctttaattcgatgccaatgccacatcaattcccacatcttccatttctgaaccaatttgctcatccaattatggggccattcccccatccggtttttgttcacacatcgagcccttctccctttcccctcccgccagggataacattttcaaatcgccaacaaattgaacgcattgctacacatgttcatggccaaaacattgcacaacagcaacagcaacaaattgtaccaaggactaatgagggaattgctggcgttggaccatggcaggaggaattttaccaggatggtactacaacaaatgattttctcgacttcaatcggcaaattggttcatacattccgtaatccttttttttaatattgaaggaaagggattgtgtttttagtggactaacccttaagctgcttgaatttaattttgcggaaagaattccttttcgcaatggcacatccgcgcccggcataaaccttttgttggaaaatgagcaacatttgcgtgttcatatttgtgctagagaggccagggctacccttttatcaaacactctcttggttggaggcacttaccggttcatgcatttgaatgtgagaccgaagcgcgattttggacaatctgtgaactacactttatctttcgcatttggaagttcagttcacttgattcgggttatcctgttttatttatttatttgtcattttgaatttaatgagtttaaggggccgacagtagcatttaatccattaactcttcgaagtccgagcgaccgggttcctcaatttgtttgtccaaaaaactaaataaa

SEQ ID NO: 64290 - DNA, 2125 bp, Heterodera glycines
  Genomic contig location: Contig_ID=SeqID_929; Location=699..2823; Strand=-
  SCN-specific regions: Sequence locations=1-149,172-221,244-343,365 -414,436-2125
atgccaacaaattttggggaattgagagagcgaatttgtgaggagatcggctatggaaatggtacaatgaagctcatacacaaaggtaaatgataccaatggaagtgagaaaaggtggtggatgggttttgttgaagtttggcatttaccaatgaaatttattgttttattgatattgccctgaattttgagacggggacggtgcacatattctataaaactttaaacactgtttataaatgacgtttaatttcacgggaaaaagatggtttagcatatttgcttatgagaggaggtatcactaaaattttcacaaaaatttacaaaaaaaaattgtactgagattattattttttaatttttaggcaaatacattatcgccccgatggaccggcggttggccgagcacaaattgaaggacggagacagaatttttgcgattggcgttgtggcaacgccaaaaccggccttgggtgttgaaatgtaggcaaattatgagaagatacagttagccaaactgaacgaactgtacaaagcaatttgagacgacattacggaatttggagcggaatttatttagaaaggtttttttgataattgccttgttaaaatcaaaaaaataagccgggcaaaacctttgatttttcagaacccaattaatggccaatctctttggcctcattgagttcaatttcattcgttgttcaattatccctccccttcagtgatttgtccctactgagtttgaccaattgattcgtcacaatgggttcgaccggcgtttatacttcggcaatttgctcatctctttatatttttccccgacggattacccggtgaattgggcgaatgtgcttctctctcacaatctcccccgcccataaacacatcatttggatgatccgtgccgaagtttggctaaccacaaacactgatgggtgccattgaaacacaaataaagtgttgtcaatgaattgattaatttattttttagttttcagatttcaatatgagttgcggagtctgcggcgggaaaatttggctgaaatgggcaaatcaatgcgagaaatgcgatttggtgtgccatacaaattgtttggagggggcacaaagcaaagaatgtcaatcgaccgaccaatacactttcgatgacgacactttcatcaaattagccagtgatgaaattggtaagcctaaaaaggaattaactaaccgaatagaacgaagggttagtgggagaacattggcaaaatgtttgtttttctttagccgaacggaaacggtccaacgtctcgcaatcgacagttgatgaacaaaaacctacgccatcggaaaaatgttcggatgggaaaaacgcttcttccaactgccgaaggcggcgaattgccgagagattgcaaacattttcagcacttaccttaaagagtgtgcaggaatattctcgaagacggacagtccaaaagggacagtcggcggagaatgagaacagcaccagtgacattggttggactgttcatccatcttaaacattctttgaccaaattgcatatttttcagaatcccccggttctccaaaatcgcctttttcggttggggcggaagggtcttttggaatggtatccattgcggaagtgctcgagatggatttgctcgactctctcgagggatttggcccaaaatcgcaatttagtgatctcaaatttgaaccgggtaaaactttttgcttttataataaaatgcgaattgattggcctttcttttcccacaggcaatgcttacaatccgcaagttgtgtgtgaggcgaaggtcaaaggacagcgtttgtttgattggtgcgagacggaagagcggaagaaacggatcaatgggcaggtgaagtgacgcaaattgaggggtccgttgttctaacgcaacaacaccctcagattgacctggtccaggctgaaattgaagcagtgactcgtctacggcgttccttgcccaataaatccggtgcttcgatttggttttgattgctgaattgtgaactcaaatttgcaggtgttgattttgaacgcatcgaacatcgtcttcaggcattggctttcattatgatgctttattgctatgcattaaatgtcctcga

SEQ ID NO: 64291 - DNA, 283 bp, Heterodera glycines
  Genomic contig location: Contig_ID=SeqID_929; Location=3669..3951; Strand=+
  SCN-specific regions: Sequence locations=1-283
atgcaactctctgtgctttcttttgcattcgttgccctgtttttggtcggttttaatttaactagttgtttctttttttgcgttttaaaatttccggggatattttttgacttttttagtgcctcgggttttcagtgagtccaattccgattccttaaatatgttcaaataaaaacttttgcggtaatttttctttaagacttctgcgctaattgagttcaccgaagcgaatgcgccaaagcagaacaacggtaccgacacgaacgcggaaaaggaggaaaac

SEQ ID NO: 64292 - DNA, 2179 bp, Heterodera glycines
  Genomic contig location: Contig_ID=SeqID_7262; Location=280..2458; Strand=-
  SCN-specific regions: Sequence locations=1-72,97-245,340-1323,1350 -1433,1459-1517,1551-1606,1629-1867,1918-1977,1999-2179
atgtccagccctgctagacaggtatctcgaccggagctgatcaagtatttttggtcccaccggcattgtggtgtttctcggtttcccttttttggtcccgtaattccccgtcccgaattttgcctaaaattccggtatccttcagcagctcgtatttaggctgtcttatttgatgaagccgttgaacgtttgcagaaatgtgctggcaatctttccggcgcgtgtcttttccatctgatgaaatgtaatttttacaataaaaactataatttcattaaaaataaatattttaatgaattatttcacaaaatttagtaaatttccaattaatttttattacagtgcttttgcttgaattcaaactctatcgagcgttctttgtggcctcgactaatggaactgatcccggcacatttaaaaatgattttatccgctctgactttgccgttcttcacaatgcgcccactgcttataatatcgaatttttccgcattgacatggccattgctcgcgaagagcttcttgcttctagtgacatctacttttttcagagttgtcctgaaagtgtgtgagctattaattgggggataggtccgagctgatcgagagtgtcggccgagagttctcgactcgagcaaagtcacgggtttcattttataatagcttagggtattggctggacaaactattttgggataaaattcgaatcctttgataatgtcagcttcgcaaatgttggccaatccattttgacactttggtctcggcctcataactagggatgcaatttatagttgctaaaaacataggctcaacaaattttttttgctcaaaaacctctcatatttgtgcattacagaatgagaaaagtgaaattttttcatcaataagcaagcaaaaaactttgaataattccatgctgctttattacgattaactttagccttggacatcgattcggacttcttcgaatgtgattgaagagaaaatggacagagaaaaagttagaccaacgactaagtatggcttagtaaaccctttgttaattttttaaacgtgaaagtgcggcctcaaacctaacgatacgagttagaatttctctaattttccaagtttactaaatttagccattatggaattttgaaaaagcacgtttaaacgagcgtccctggcctgtaccaaattttggatctcctttttttaaaaagtcggaatttcaagacaatttttgctttttgaaccacttttttgcggtgcgctttttgaaaaaaacttttctgcaccggggggggggggggggttaagcggtgacaataggcgccgcttgggaaaatttttaaattttaatacgatttgttaacagaatttgtccgaaaggtcatttttgtagtcatcgctattaaaaaaaaatttaagaaatgaggagaccggcgatgctgagaaataaacattttttaactgttgaaattgtacaaatttctaaaatcccttttgtgttctatcttaaaacttttaattaaagagacatttttgccaaaataattattaaatttttcaagtttggagaacagtttcactaatgaaatttaagctcgttttaacaaagagaaaattatttgcaatgaataaagtttaagttaaagagagaagaattggatttttcaataattggtcaccgatggcacaatcccttcactttgatgaacctggtcggcaattccctccaaatctaaagtttatttacttattaagctgtaaatattaaatagtcaaattctttgttcccatatgtaaaacagtgccccccccccaactgagcttatttcttaggcagtgcttatttttgagtatttgagaaatttttgagttttttaaattttccaaattatttaaataaaaattttaattttaaaatttcagggtttgataatctgcccttttcggcaccgcctgaccaaatgctcaaaactgcaaaatttgggcatttttaaggattataaattgtcctcggtgcccgtatgtgtgtagagaaaatttatgaaaacaatagcgaaaagttaatagaaagcaatttttgagaaagacatggacattatgaaaatttttgaaaaaataatcaccggaaacaatgtccaaatactgaaaaattgattatcagggattttcgagaaacaataaa

SEQ ID NO: 64293 - DNA, 362 bp, Heterodera glycines
  Genomic contig location: Contig_ID=SeqID_7263; Location=1048..1409; Strand=-
  SCN-specific regions: Sequence locations=1-362
atgccaatgaatgatgacaacaaaaacaatgcacagatgaatgataagggaaaggcaccacaacaatttctacagaatccgcaacaagtacagtacgcacaacaacaatcacaactgcaaccagcacagtacccgcaacagcagcaaattatgccgcagcaagtatttttaccctctgagcaattgcaacagttcccatggctgtacggtatgccagggctgaacagaatcacacttaaacacaatgccaatgaggccgtaaagccatcgccagccgaacagttgagcagtttccttgcagagcagcaacgtcaacaacaggcaaccagtcaattgcaccgtcagaacctgcattcgcgagg

SEQ ID NO: 64294 - DNA, 570 bp, Heterodera glycines
  Genomic contig location: Contig_ID=SeqID_34522; Location=669..1238; Strand=+
  SCN-specific regions: Sequence locations=1-278,307-326,350-570
atggaatccgtttcatcttctttaaagtcaaccgagggccagacccagcagcagcggaaggaaattgcaaattcttcagtaagaccaaccgagggccagcaatcggtccgttactttcgtcgaattcgcatttgttcaacttcctcggattcatcggatgagatttttaattcttttgaacgtcaggacaactcagtgattaatgttaagaacactaagcaattgaacatgatcaaatctcccgaggtaagcagaaataaaaacttgaaattctttggtatattttaataaaattgtttaatatttcaacctctatcaatgaaattaagaagaacaaaaaaggaaaatcgcgtgaaattattgttaggcagcgttctctctctccgagaagtgacattacaatattaaatacatcaaacaaaacatcggtttcgaaagcacctgcaggaaagcacaaagaaagtgacgatgctagaaacgcgcgcaagatcttcgttggcgggtttaattaattggaaaaagaagattagttaactttttagattatagcatacgacgacgaagaattca

SEQ ID NO: 64295 - DNA, 99 bp, Heterodera glycines
  Genomic contig location: Contig_ID=SeqID_34524; Location=1..99; Strand=-
  SCN-specific regions: Sequence locations=1-99
aaaattaaaaaacgggcgcgaagcgcccgtcctgaggccgcgaagcggccgaatgttccccacaaaattaaacaaacgggcgcgaagcgcccgtcctga

SEQ ID NO: 64296 - DNA, 566 bp, Heterodera glycines
  Genomic contig location: Contig_ID=SeqID_7264; Location=459..1024; Strand=+
  SCN-specific regions: Sequence locations=1-258,292-506,528-566
atgaggtaaaatttttacctaattaacgcctttaataggtttgccgtccgccgattcgttcaatcgtcgcacttttcgcgcacttttttgcattatcattgttaatatcggcggctatttctttacactaagttgttacattttgttaattcccacaatttcatcgccgatcactgcttggttttaccaagcaattacagcaattccttttaacattggctcagcatcaagcggacccattttatactttacgaggtgttttttaaaagaaaaatatattttttaatttaacttcctatttcagtactgaatatcgtcaggcattccaaacggagtttccatctgtattcaaacgaattttgaatgtgaatcgagtaattccgctgcacaatggacctcaattaggcactacacaatggtgaatgatgtcatccagcagaagatgctcttcggtaccagcccaatcattaattggcacttaattgatgccgcgcgttccttggcctattggcccagaaatcatagaaattctctctaatgttttgattactaattcatacaacaga

SEQ ID NO: 64297 - DNA, 648 bp, Heterodera glycines
  Genomic contig location: Contig_ID=SeqID_7265; Location=289..936; Strand=-
  SCN-specific regions: Sequence locations=1-5,27-59,81-153,176-178,204- 477,510-648
atggtaaatatgcatttattcttgaaatcacatccaaatttacagttttatttggccttcaaagatgtccatcccagctggtctctgattggaattgcaggaatttatgcagtcatcatagtaattggcgccatccttaatttgtctgtgattttaatcacaatcaaaacaaagtaggttttatatatatttaaatttattatgcttattgcactcgattcataatagcccgcaatttgcttaattagctcttttttagggttgccgtccgctgattcggtcaatcctcgcacttttcgcgcactttttttcattatcactgtgaatgtcggcggttattggttctctgcaatttcccatttgctgttaattcccacaatttcatctccgatcactgcttggttttgtacagcaattacggcaattcctgcgactttcggcgcagtgtcaaacggacccattttatattttacaaggttttaaaattttaaaaactaaaatatttattagcaattatagtaccgaatatcggcaggcattccaaacggagtttccattcgttttcagacgaatttcaaatgtgactcaagttattccactgcagaatacccgatcataagctttgaaagatataatttaaataataaa

SEQ ID NO: 64298 - DNA, 527 bp, Heterodera glycines
  Genomic contig location: Contig_ID=SeqID_34533; Location=539..1065; Strand=-
  SCN-specific regions: Sequence locations=1-50,77-158,204-204,230 -385,412-494,516-527
atgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctgaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcacagcacgttctaaaaaatatttatgaattaattttgcaaaataata

SEQ ID NO: 64299 - DNA, 635 bp, Heterodera glycines
  Genomic contig location: Contig_ID=SeqID_34534; Location=321..955; Strand=+
  SCN-specific regions: Sequence locations=1-536,558-607,629-635
atggccgaacaatgggaggaagaacgtgccgaaaagcaaaggctgacgaaaaaactgagaagggcgagtgaatgggcgaagggagaagcgaacaaacgcaattataggacaaatgggaattttaaagtaattaaggcggaactactccaaagagaaacggaagaacaattggaagtgcaacgaaaggcgaaagagcgactggaaacggagcacaacgcgttgttacgcttggagaaacggcgaacactgcgcgaagagaccgaatcggtgggcatggcactgatcagagacaaattggcggcgaaagagcgcgaagtgtccgcacaggtcatttgaggggaaaaggaagagagagacaaatggaaaaggaaaagcggactttagcggcaccgaatcatcgaattggagcgaaagctgtggcacatggaaatggcaatggaaagcgaacaatgaaaagaaggaataacggcgccagcggacggcacggacaaattgagaaaaatgacgggaaaattggaagaaaaaggacaaaagtggcagaaatagggagaaaaaagggaggttgcctgctgatcgaccgtaaactgacttggaatttgttctcttgagtttcttttcaaattttctttgaataa

SEQ ID NO: 64300 - DNA, 985 bp, Heterodera glycines
  Genomic contig location: Contig_ID=SeqID_34535; Location=169..1153; Strand=-
  SCN-specific regions: Sequence locations=1-181,219-286,308-390,461 -476,500-519,541-603,625-985
atgccaaaaatgaggcatacgatgccaaagttacatcataagagtgccagcacagatacggtaatcaactgtggtgtactgtaaaatctgggccaaaaaattgacaaggaaaggagcgcgaaaaccaattggcaaaacgaatcgaaggctaacagccaattacacactttgtgatcctttcttaaaaatcaaaaatgaattaaatttaaaattttaaagactcacattttggtaaaagtatccaaaattaacgaaaaattgaacaaaacggagaccagtgccaatattcctggcaaaataattcccggccaaatggctgaccttttaagcaataaatcaacaaattcttcctagtatttagcagtagagagagctaatcaatgagatgccaattaaaataaaaaattcatgtttttattcattgtaaaaaaattgatgaaataaaaatttgaaataaaaaggttttgcattaatgtcacacaactttttactttccttttctccggatgagaattgcaatttcccacaattttaaggcgcgatatttgttatacttaaaaaattttatgaaagaaaaagctttacattagatttcagatagtttatttgttcaaatattcctaaattttacgatgtcacagaaatacggggggaaatggagaaagaaagaatcacagcgaaaaattaatcagatttttgctgaaggcctgacaaaacatctttgtgttggttggccaaaacgacaagaatgtgcccaaagtctcggccttcctgcacattgagacgcaaagagttgacgaatttctgatcatattcagtcagtactgcatcaccttggtttctgtagaaaaaatgatttgataatgctttaaaactgctcgagagacggtaccaagaccgagacttggcctcaaaacacactcgagaccatgactcaacaagacgagaaccagaaacccgagactgttctcgaggcgagaataaa

SEQ ID NO: 64301 - DNA, 687 bp, Heterodera glycines
  Genomic contig location: Contig_ID=SeqID_34537; Location=52..738; Strand=-
  SCN-specific regions: Sequence locations=1-137,159-687
atggatgacacggaattccgaatttttggggtcggaattccgatttccgaaaaatttatgagctacggaataccgatttctgaaatttttttggacctcggaatgccatccctggtatatggtatgttagggtttcgactttagaaaaagtgaaaacagcaattattctatctagcatttccatcatcattttcttcaggaagccgaaaagagttggacccccgagcagtgggggacaaatgggcgctggccaactgggcgtcagcccatgtttttccgatataactcctttcatagttgtacgaattgagtcaatttgatagcatttgacagccttactattatagtgcaagttttcaaaaaaaaattcctgatatttcaaaaaattacagctaatagagaaagaacacttaggtatttgttgtgcaatcgaaaggtttcgatgaattaaaaatttagttactcttgaacaaaataattttgtaaaattttccatttgattgttttgagaaacgcccattagcacctccaacaaaacggtgcgtatcatctccttgcactcaatttaagcccacctgtgaatgttaaaggattcgcctttgttgcgcgctttttccagaaaattgatggcatttttaaccgaatcgtcaatgagacacgtgcacttaattaacaattattaataaa

SEQ ID NO: 64302 - DNA, 887 bp, Heterodera glycines
  Genomic contig location: Contig_ID=SeqID_34537; Location=72..958; Strand=+
  SCN-specific regions: Sequence locations=1-509,531-887
aagtgcacgtgtctcattgacgattcggttaaaaatgccatcaattttctggaaaaagcgcgcaacaaaggcgaatcctttaacattcacaggtgggcttaaattgagtgcaaggagatgatacgcaccgttttgttggaggtgctaatgggcgtttctcaaaacaatcaaatggaaaattttacaaaattattttgttcaagagtaactaaatttttaattcatcgaaacctttcgattgcacaacaaatacctaagtgttctttctctattagctgtaattttttgaaatatcaggaatttttttttgaaaacttgcactataatagtaaggctgtcaaatgctatcaaattgactcaattcgtacaactatgaaaggagttatatcggaaaaacatgggctgacgcccagttggccagcgcccatttgtcccccactgctcgggggtccaactcttttcggcttcctgaagaaaatgatgatggaaatgctagatagaataattgctgttttcactttttctaaagtcgaaaccctaacataccatataccagggatggcattccgaggtccaaaaaaatttcagaaatcggtattccgtagctcataaatttttcggaaatcggaattccgaccccaaaaattcggaattccgtgtcatccatgccatatactatacatttttgaaacacgtcactacgttacggtagagataaaatatgtttgagtgtgtgccaagtttttttctttgttccaagttatatgggtatcatatcatgaactcttttaaaattttgagtcaaaatttatttacccccccccccccgtttttgtaggcatttcgtagaaaatgagttcgatgtgatcgcccgcgtggcgttgggg

SEQ ID NO: 64303 - DNA, 104 bp, Heterodera glycines
  Genomic contig location: Contig_ID=SeqID_34540; Location=269..372; Strand=+
  SCN-specific regions: Sequence locations=1-104
cgcttccaattccttctacaatcgcctttatacatcccattatgaacgctaaaattatcagagtgccgaaaatcgcatgtgatctacgcctaacaaaaaatggt

SEQ ID NO: 64304 - DNA, 558 bp, Heterodera glycines
  Genomic contig location: Contig_ID=SeqID_7267; Location=138..695; Strand=-
  SCN-specific regions: Sequence locations=1-558
  Gene Ontology: Mol. function=anion exchanger activity; Cellular component=integral to membrane; Biological process=bicarbonate transport
atggaaaatttagccagcggtgccatctgtggagtgatgtatcatctgttcagcggacaaccactgaccatcatcggttccactgggcccgtgctcgtgtttgagaccatcgtgttcgacatgtgcactgtcagtttaggggaaaagcggttttattaatccctatttcaggggttatttagcctaaggaatatagggattattttcgtccgagtacaagtttttggctataactttttttcttttccaactaaatccaacaatcttggtatcattcgataaccctaaatgtcctctattagcctggttttaaaagttttttcaaaaaaagtatagaaactcagttttttaaattttgcaccctctgatcagggcctgtcactcaactatctgtccttccgcttttgggtccatgtttggaccgcgctgattctttttgtgatggtggcgactgatgcttcatcgcttgtctcctacattacccgcttcacggaagaatcatttgccatgctgatcgccgtcattttcgtctacgaggcttgtatgaagctgttcaag

SEQ ID NO: 64305 - DNA, 416 bp, Heterodera glycines
  Genomic contig location: Contig_ID=SeqID_7268; Location=1..416; Strand=+
  SCN-specific regions: Sequence locations=1-416
agagattgtcctcataccgtatccatttaaaaaacacaccgtttcactgacatatactttctgctttcccaatttcgctttctggaattcagtgtttagcagccattccctacatttttcttcccattcattagtggtgcggtgggaatgccattttttgcttttgcgtcgcctttgtcaccgccaacggcgccgccgctttttggcaatccgtcgctctttgctttcccaccatttttactcttctcaaccgctgtcaacagttctttttgtgcctgaattttcattaaattcaatgcataattattattttgtattcatctaaaaaaatgaagtgatcggatgaaggaagtcccggaactgagagggaattttcctgggacatttttacaatagcccaagatagggactgtatc

SEQ ID NO: 64306 - DNA, 1400 bp, Heterodera glycines
  Genomic contig location: Contig_ID=SeqID_7268; Location=728..2127; Strand=-
  SCN-specific regions: Sequence locations=1-293,315-1004,1070 -1164,1201-1211,1235-1400
  Gene Ontology: Mol. function=anion exchanger activity; Cellular component=integral to membrane; Biological process=regulation of pH
gtacggcattccgccacaacaaacggcggatcaagccagggaagctttttgagcgccgttcgctccatttccgacattggccgcacattttcccatggcaaaaatctgcagggacgttgcacagattcggacagtccaacgaagcggcaaacatccggcaatcagcttgagctgcccaaagtgagtaataggtccatgcctggatcaaggccatgataagcctgatttttcctgggcctgaatttttgttcaggaaatccaggcccaacatggaacccatgtccagttccaggcttttttcaaaactgtcagcccttagcagtttggtcaaattgttccagactttataacacttaatatggcttcccaaaaatgcatcagtatgggatttgcagctttttttcccccatatcaatgcatgccttaaaaatttgcttaatcaccacgacgactgaattttgcagtaattgtcctcattcattaggttatataattccgtcacataaattatgccaagaattttaattagataatcctggtgcatttttttgtttctaaggttggttctttgcccaaggacatgcaaaaggagaattcgcagagcagtgacttttttgcacgaaatatgcacttcatgaaaaagttgccgcccggcgctgaggcgtccaatgttttagtgggagaggtaattagttaattaccccttagcaattaataaattttctccaaaaatgtgtgacatgcactcaggttgacttcctcacccatcatgtcactgcgtttgttcgtctcaagaaggcccaactgcttggcgatctgactgaagtgccggtgccaacgcgctttctgtttttgttgcttggcccctccgggcatgcggcacagttcaaagaaattggacgcgcaattgccactttaatgtccgatgaggtgaatacatagagatgatcaataagatcgtgggagcatatgcatatgggcgcaatacatttccacactctccgaaatttttttatttattaacaggtattttttttaataaaaagtattaaaaaatatttttttaatagaacaaatgctttcaaaaattttgtctcggcgaaatttcggccggctaaattatgacggggtaatttttcggcggcgaaactttgtcctgttccctaaaaaatcaatttaaaaaaatcaaatttttaattactatgcatttgctgactcgctgctgtgtttctcagattttccacgaggtcgcctacaaagccaaacagcggtcagatcttttggacggtgttgacgaattcttggacgctgtcactgtgctgccacccggggaatgggacccgaacattcggattgaaccgccaagttccatccccaatcaacagagtcgtgttcaggtg

SEQ ID NO: 64307 - DNA, 1123 bp, Heterodera glycines
  Genomic contig location: Contig_ID=SeqID_7269; Location=1028..2150; Strand=-
  SCN-specific regions: Sequence locations=1-346,368-982,1013-1123
atgaacaacagccaaaacaacggtgacaaaatgtcatcggctgccccttcaacaatgtcagcagcagaaggtggaaattggatatttattgtatttgggctaatgagtcaattaaggggggggggggtgccacaggttcattttgtattgtatttgactaatgaatgtctaataggtcaattaagagggcaacactataaattcgttttgaacccctattttttgatcaaacatcaattagtctcaaacaaattgtcatggcagcagctttcaaaggtgaaaattggatatctgttgtatttgggctaatgaatgtttattgagtcaattaagggggcgccgtaagttcatttttaaaatatatttaggctaataaatgtctaatgagtcaattaagggggcggcgccataagttcatttttgaaaatccagttggtcaaagatcaattagtctcaaaagaattgtcatggcagcagcttttcattatcgcaatgttgcccgtatttgtatgctttatcatattttttctgcgcattgtcctggaatttagcaaataccccccaccaaagaattggaaaaatgcgtcagtgaatcagaatttcttaaaaaaacgagataaggtaattgattttttgattttatgcgctaattgaatgtatggaaataaacaatacaataatccaattacagtatatttgtaaaactgttgaacctttcaaaaaactgaaattaatgaggttcatatacattttgttgacctttcgtattttgtataatatttaatgctataaatactgtattactgacgcatttccattggcatataatgtatattttccactaacgcatactactgtattactaacgccttttcaccgtcgtatactgtattactgacgcattttccggcggccgccgtttacggtcctaatttataagagaaaacattcagcctctggatccgctagcaaagtggcaattaccggacccgctgcacctgtggaagagcctcagccagcagcaggccaaactcagccgacaacttccgccgacactttggccaacattcatcaaacggacaaagagatcgctgctgaccgacgcgaatcactttggatgtga

SEQ ID NO: 64308 - DNA, 490 bp, Heterodera glycines
  Genomic contig location: Contig_ID=SeqID_34542; Location=424..913; Strand=-
  SCN-specific regions: Sequence locations=1-214,287-298,320-396,419-490
atgtattttgaccatgaaatgcgaagggaaaaggaacaaagaaaaggaaaaaagggacagagaacgaacgaaacttttgatgggaaattaaactgtggatggacacaatttcattttgtcgttccttttggtgtaaagttcgggaagaaagcacaaacagaagaaaaagacaccacgcaaaggtcggcagagaaagaaaggacaatcgacggacgaaaagttaattaattaattaattggagagagagagagagaaaaaaaagaaagaaaaaaggaggaggaaaagcattggcaaattgggagaaaacaaaatgaagaacaatgagcaaatatgtacacaaagtaccaggagaatgattactcacacatttggtaaagagaaagatgatacgattggttttgaattgtccaaaaatgtgcaaaaaaaaagtgccgcgaagtcttgactcatggcagaaaagttttgcagttgccaggtttaaggattaaa

SEQ ID NO: 64309 - DNA, 463 bp, Heterodera glycines
  Genomic contig location: Contig_ID=SeqID_34544; Location=127..589; Strand=-
  SCN-specific regions: Sequence locations=1-463
atggcggaataccgcggctttgctcgcattttgaccaaatcagatttgctgagcgtcgaccggataaaggaggagattggcataatgttgaacgacaaaaagtgagtgccaaattcgaatttacagtttttgttttcgcatcgtcagatacaaagcaaacgctcttcgcctgtccaaactccaccgacaaaagccaaacccaccggaggagcagctgatcagatggaccgactttgtgctggagaacggaccactgaaggaactgatcccggaaagtgccgagttgggaatggtcgaatatttctgcttggacattgcgctgatttgcttgatcatcgcttttgccatcctttggctgtgccggaggcttttcggcgcacttttggcaccatggaagagagaaagcgcacgacagaaaaatgacaaaaaaaaagtgtcggaacgagtgatcaaggaggactga

SEQ ID NO: 64310 - DNA, 409 bp, Heterodera glycines
  Genomic contig location: Contig_ID=SeqID_34549; Location=461..869; Strand=-
  SCN-specific regions: Sequence locations=1-180,221-266,325-325,347-409
atgagtgtgtgccgtgccgtgcacatgtgccctcatttacgagttccttccgccggaatcccagcagaagcaaatggtggtggacaaaaggccaaagaatgttttgttgaacgaaaatttcaaaccgatgtatgggtggtggtcaacgaaaatgatagggggtgggggtaattaatttcgaaaaaaaataaaataactaattaattaattaattttaaatgaaactatttgggtgaaaagaaatgttttcgtttagttctaatctcaaaaaattaattgaatactaattttattttaaaaattctattttatttatttattattggaattcttttgtctttttaggcgcccttatttaatttctttttcagacattaacttgttttaaaaattttattaccctaataaa

SEQ ID NO: 64311 - DNA, 661 bp, Heterodera glycines
  Genomic contig location: Contig_ID=SeqID_34551; Location=95..755; Strand=+
  SCN-specific regions: Sequence locations=1-597,619-661
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatagatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatagattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttt

SEQ ID NO: 64312 - DNA, 1107 bp, Heterodera glycines
  Genomic contig location: Contig_ID=SeqID_7270; Location=1950..3056; Strand=-
  SCN-specific regions: Sequence locations=1-1107
  Gene Ontology: Mol. function=peroxidase activity; Cellular component =extracellular space; Biological process=protein targeting
tactctgaccaattgtataagcattacgcagctgcttctcaatacgaatatgcgcgacattactacactccgttcaatcagtacccacagccgcaaccaccgcaatattttaacccggaacacatgcagaaactgtacagggaagcggtacggtatgccaattgcaatgccatagttaaatgggacagaaaaaagcgcgaattgtccatttgggtcttggacagtaaccatcgttctactgttacagtacacggagtacgataaacgcgagttggaaaacgcgttgcgcggctacttacagtacatagctttggcctacgcccagcccatgtcggtcttcccgcggcactacgacttgcgcgacaaattcccgcagtgcgccgcgtggattggcctcgcccgggaccaggggaagtgcggcgcgtgttgggccgtcgcaacggccgccgcgcgcgacgacagggcgtgcattttcttgacactccgcaactatttggtgttcaccaagaacccgaacctgtactcatcgaccatggacctgatcagttgcacaaaggaagccgatgggtacgaagcgaaaagccaaacggaaaaacgaattgaaattcaatgcggaaaatgggggaaaacggaaaaatgggggaaaccatggtgggttaggcaaattgcaattcagctgcaacgggggaacgccacaattggcatggaagtatttggagaagtacggctatttgacgggtgcgccggtggtgaacggcaccgggtgcaagccgtacgtattcccaccgctgaagtcggacccggagaaggagcggaaggcgcccgagtgtacggaacattgccaagcgggatggaagcggatggccatggacaaactgagcggacgcattctgccgccgagcaatgagacgcgctaccgcacgggtgagaaggaaaatgccaaaggggaggccaaaaggtaacatttcagtgatcaaaacgaaccactggggcatggacgactttgaaggacagctgaaatgccaagagcgaaggatggacgaatgttatggcaaaatgttggagggcagcgagagaggaatcatggcagaggcaagacaccactga

SEQ ID NO: 64313 - DNA, 204 bp, Heterodera glycines
  Genomic contig location: Contig_ID=SeqID_7272; Location=1205..1408; Strand=+
  SCN-specific regions: Sequence locations=1-125,147-204
atgtttgacgaaggaaaaatgcgcggaaatggcgacgaaagaccaaaacggcaccaaatgaagcacactcagtggcaggaaaagcggacaaatggaggaaaagcggacaaatggaagaaaagcggacaaatggaagaaatgaggaaaagcggacaaatggaggaaaagcggacaaatggaagctcagagaaacggatgagatga

SEQ ID NO: 64314 - DNA, 992 bp, Heterodera glycines
  Genomic contig location: Contig_ID=SeqID_34552; Location=30..1021; Strand=+
  SCN-specific regions: Sequence locations=1-532,554-859,881-992
atttagccaattcattgcgtcaacaacgcaccgaggacaatcacatttcgataaatggacaaatttactcagttgacggacctaatgttaatgttggtgttgaagggcatgatttgagtgtgaatgggagagtttatcaaaacagggccacagagcagtatctggaaattatacaagacaaaaacataagaaatgtaattgtcagtgtgccattatcgttattttctcgcgaaaacataaccgttgggcaaacgcgacatattcacgctgaatgcgatggaaatttatatatcgaccaatcggcagatgactgtattcgcatattatgcgttgatgtaaaaaaggatgccgctgcaaagaactttgggtcaacaagtggaggctttaattttggatcgacgagtgttttttacaatttttcggtccgaggaactttacatatccataattcgtcacttgagtgtgctaacattgaatgtgatgcatctttaaatgtaactcactcaccaatagaacgtaatgcgcaaatgaaatgtggtgggagtttaagtattgatgagtcaccaatgggaaatattcggcttaactgtgatggatctttgcggatcgaaaaatcgaaaatggaaagcagtcagattgatgttggtggaagcattgggattgttaagtcaccaatgggaagtattgggattgactgtggtggatctttacggatcgaaaagtcgaaaatggaaattggcaacctagactgtggaggaagtttaaccattgtagaatcgccagcgcaaaatcttcagttagactgtggaggaagtttaaatatgaaggagtcgccaatgaaaaatgttggcattaattgtggtggaagtgcaaccattaagaagtcgaaaatggaaagtggtcgcattaattgtggtggcagtttttcaattgatagaacgccaacgggaagtgttcgaattaattacggtggaagtagaattaatttatga

SEQ ID NO: 64315 - DNA, 412 bp, Heterodera glycines
  Genomic contig location: Contig_ID=SeqID_34553; Location=81..492; Strand=-
  SCN-specific regions: Sequence locations=1-227,255-299,327-346,371-412
atgtttgatgatcgcatcaatgaagaagatgcaaaggataatgacgatgaaataatggtgacgtcagcagaaaatgacggaattacaacaacggcagcagcaacatgttcaagcagtagccagaccggaactgataggaaaagccgagaagttcaagcagcaatacaggaccaacaacaaacaggaaatactaataggagccgagaagttcatgcagtacagtaccaactacagcagcaacaacaacaaacagcagtaaatgccgagagaagccgagaagttcaagcagtacagtatcaactacagcagcaacaacaacaaacagcaggaaatgccgggagaggccgagaagttcaagcagcacaacacctacacgatcaacacaagcataaccatcgtgttcagccgccaa

SEQ ID NO: 64316 - DNA, 225 bp, Heterodera glycines
  Genomic contig location: Contig_ID=SeqID_34554; Location=255..479; Strand=-
  SCN-specific regions: Sequence locations=1-225
ttttaaaatttcgaaaattttgaaaatttttcgagctagggctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgg

SEQ ID NO: 64317 - DNA, 506 bp, Heterodera glycines
  Genomic contig location: Contig_ID=SeqID_34555; Location=77..582; Strand=-
  SCN-specific regions: Sequence locations=1-259,288-296,318-391,420-506
caaaagttgtttacaaccacttattgccaatttaatttcttgcagatttaaagccatccattgcctgccggttctcggcacagcaaagcactaatagggtgtttgactcacttcaaaaaataattcattacccaaaagtttttttacaaccacttattgccaatctaatttcttgcagatttaaagctatccattgcctgccggttctcggcacagcaaagcactaatagggtgtttgactcacttcaaaaaataattcattacccaaaagttttttacaaccacttattgccaatctaatttcttgcagattgaaagccatacattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactc

SEQ ID NO: 64318 - DNA, 305 bp, Heterodera glycines
  Genomic contig location: Contig_ID=SeqID_34556; Location=423..727; Strand=-
  SCN-specific regions: Sequence locations=1-49,80-84,107-205,238 -259,282-305
atgtataagcatcgtttattcgaaagttctgcaatttatagtagggttcgagccccgtgggtgggcgtggctttttaaattttagggatgaatttatgagaaaatttttcatatcatagggttgtatttttctaagttttagaaattaaaaatcatcaaggaatatttgtcctcaaagtttccctatgcattcaaatacaatacgtatatttaaaaaataataattctaaatttaatgtagattcttaaaaaattggatgctttttgctagcttttcatttcccgttttgtacatacgaaataaa

SEQ ID NO: 64319 - DNA, 58 bp, Heterodera glycines
  Genomic contig location: Contig_ID=SeqID_34557; Location=445..502; Strand=-
  SCN-specific regions: Sequence locations=1-58
aaaaaccaaataattttgtattattttcacttgatataaattaaaatttgaatttttt

SEQ ID NO: 64320 - DNA, 157 bp, Heterodera glycines
  Genomic contig location: Contig_ID=SeqID_34559; Location=914..1070; Strand=+
  SCN-specific regions: Sequence locations=1-157
atgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatga

SEQ ID NO: 64321 - DNA, 1104 bp, Heterodera glycines
  Genomic contig location: Contig_ID=SeqID_7273; Location=1..1104; Strand=-
  SCN-specific regions: Sequence locations=1-338,617-727,777-897,946 -1104
  Gene Ontology: Mol. function=structural constituent of bone; Cellular component=collagen type I; Biological process=epidermal differentiation
tcaaggtttgccgggtccaagtggcccgccgggtcctccccgagcgccggaccaagcggctccgtggttgggccgcccgtgctacccgggcgtcaaaggcgccaaggcgagtttcggcacaccgctaattttgcacttttcagggtgacctgggctttcccggaccgccgggtccgccagggccggcggcgctgacccagcacaaaggcacaattgtgggccctgaggggcatccgggcgcaaagggtgaaaaggtcgcgcgcgcgggtttttgtttccccatcaaaaaaattaactgttattttaaatgctttatgctcttttacttaaatcaattgaataattattattttctcaatttaaataatttaaaaaataatatttattataaaaatttttaattaaaaacaaaacacgattatacttgaatatattcttttaataacttcctttaaaaatatgaaaatataaatttttgcatttttggtttacaaattttataattggctattaaatttttatcaaaatatttttataaaatcataatcataaaattactatattaaatattaaaaattaaattaaattttttcaaataattttttatttataaatactaaccaaaatttttcgcttacgtagtgttaattagttgcatagaaactaatatagaaaatgccctcacatgccttcaattgctgcttctgtgccggtgtgtgcccgtttcaaaatttattaaattttttgcataaaaataaattttttaatttataattcagggagaacctggcgatacaggcccacgcggttatcctggccaagcaggcattcctggacagccgggactgcctgggatgaagggcgaaaagggactgccaggcccagcagggccaagggtaaaatttattatcaaaaaatgtaaaaaattcaaaaaaaattttattacagggtaaagaaggtcggcccggacagcccggtccacctggcttcaaaggcgaccgcggggtggacggcattccaggagtgccgggacaacttggccagaaaggagaccaaggctttcccgggagagacggtgcgcgtcaaattaataaagaattaatt

SEQ ID NO: 64322 - DNA, 1017 bp, Heterodera glycines
  Genomic contig location: Contig_ID=SeqID_7274; Location=192..1208; Strand=-
  SCN-specific regions: Sequence locations=1-190,212-214,286-378,402 -445,467-484,506-703,778-895,921-964,986-1017
  Gene Ontology: Mol. function=structural molecule activity; Cellular component=collagen type IV; Biological process=extracellular matrix organization and biogenesis
ctgcaaattcttcggtgatcagtcgccatggcgaaaggcaacagggaaatggagacaacaacggcaaaacaacaatgccaaagtcggcaaaggcagccgctgatcaagcagatggagcaaatgcttcgcagctttgcattatggcatgttaaattttggggcattaattgaaactaattaagggaggtaattggcttaataaaatttgattgccttaataaaatttaattttcaattttgcaatgaaattaaacaaactttaaaaattaaaaactattttaatttgttcacattttattgataatcctgaaaatgattgtcattttgcaaaaatgctaatactttcaaaacaaatttctttcttattttaagaaagtgatttaatttaaaaaattattttactgaaaaattaggattttcttttcataaccaaggcattctaaaattcttttcaattttatcctcatttgttcattatctttaaatataaaagtttgttttctgttcaggccattgcttcttgtcattgtcattctgttcattgtcgggacaaatttagtggaaacggttgtcattgtcagaaaaattaattaatacccgataaataaatttattaccataattatttattcaattcagcaatcagcttgtcgtgattgtacacagcgcggatgcttttgcattggagaaaaaggcattctaaaattaattaattaattaactgacatttattaatgcgttatttaagaataaatcatcaaataatattaattgattttaaggctccatgggaccgcctgggcctcaagggcctccaggattggccggcacacgcggttttccgggccctgaaggactgcaagggccaaaaggactaaaagtcaaatattctagcaaaaaaaaaaaaaattttaatttaagggtgcacaaggccctcccggaccttttggcgtgaaaggtgaccgaggcccagtgggcacgccaggcttccccggcaatgatggcaacccaggacat

SEQ ID NO: 64323 - DNA, 1210 bp, Heterodera glycines
  Genomic contig location: Contig_ID=SeqID_7275; Location=781..1990; Strand=-
  SCN-specific regions: Sequence locations=1-67,119-163,189-297,320 -382,420-947,969-1162
atgcgtaccattctcttcatggccatggtttgcttggtgatggctgtcctaatggaaatgggtgggcaaaaatattttattaaaattataaaaaatatatttttatttatttattttagcaaattcaaaagcagtcaaaaaagacaataaaaaaggtaaaaacaattttaaaaatttattaaaatattccttgaaaggagcagtggcggcatcaccagcaaaaggaaaagcatcgccaaaaggaggcaaaagcccagcaaaaggaaaagcggcaaaaggtaaaaaaaaatggaaatgatttaaaataataaaatattaagttagtaaaaaagataacaaattgaaagcaaagaaagaaaccaaaggcattaaaggtagaaggattataaataaaatattttttgtaatataaattaaaacagttaaaaatgcaaagccaacaaaaaaaggtaaatcggcaaaaggcgcaccaaaaacaggcaattaatgtttttttttatttgtcgaaaagtaatgaatttattcagccaagaaagtccaagccgccaaaaaagcaccaggaaaggacaaaaagtcgctaggtaaaaaaccgtttgaaatttcaaataattataatctgaaattttaacttaatttagttaagccaatcgtccttaaagcaccggtaccaccccataaaatgcacccgatgattgaatccgaaggtaaactctgatatctattcaaaataaaggtcatcctttccgaaatttttatcagctgtgccaccgcccgcccatgcgcgttcgcttgcgaccgttccttacagtacaccgggggcagccgaccgtaactcattgccatcgtacacttcggctggcaccaatttggacatggccgatgataatgatgattatcagaattattactacggaacggaagacagcagcagggaatttgatgcatcggcggaggaggaggatgaactatatgaggaggaggtcggggcaatgagtgggcagacggacgactacggtattggcagtggacaggatgagtacggtcatcaaccggtggacgtgccgccaaagtcggtgatgctcgactgaagagcatcaatgaaatcaatcagagatcaccggaaaatcattttttcgtaatatagaccaaaatttatagttgctaattttttgtatatttttatttgtaaaaatagttttttattaataaa

SEQ ID NO: 64324 - DNA, 69 bp, Heterodera glycines
  Genomic contig location: Contig_ID=SeqID_34564; Location=1010..1078; Strand=+
  SCN-specific regions: Sequence locations=1-69
aaactgatcagaagcgcaccaaactttgcagggacactgaaaggacgagaaataacctatttcaaatag

SEQ ID NO: 64325 - DNA, 239 bp, Heterodera glycines
  Genomic contig location: Contig_ID=SeqID_34564; Location=1..239; Strand=-
  SCN-specific regions: Sequence locations=1-56,83-239
ggttcgatgatactttttaaaatataagcttaaactttttggcctgtttaaaaaggaattaaaaatatttaaaatatttattcatctcccttttgatagaaaaagcatcagagagccttaattaacctgtaaataaagttttgtgtgtttcagagcactttctgaaaaaatacttatgaattaattttgcaaaaaataaataattaatgaaaaagtcagaatttcgaaaaattttaaaa

SEQ ID NO: 64326 - DNA, 693 bp, Heterodera glycines
  Genomic contig location: Contig_ID=SeqID_34564; Location=933..1625; Strand=-
  SCN-specific regions: Sequence locations=1-77,99-327,364-498,533 -661,688-693
aaaaaatcgatttattcaagtgtccgtttggggtactcaaacaattatggggagcaaaaatccaacgcagaattaaaatacaggctatagggaagctattcccgaaggatttggtctccccataaatctgggcgcatcggttcggggggactgccccgaaaacaaaaaaatcgattttttcaagtgtccgtttggggtactcaaacaattatggggagcaaaaatccaaggtaaaaataaagtagtggtatatcgaagctattcccgaaggattcggactccctataaatctgggcgcatcggttaagggtactgccccgaaaacccaaaaaaaaaatttttttggataaaaattatttaaatgaactgactagataatatttaaaataggttatttctcttcctttcagtatacctgcaaagtttgctgcgcttctgatcagtttctgaaaaaaagttaagcctaacatcggttcagggagactgccccgaaaacccaaaaaaaaattattttgaaaaaaaattattaaaaggaaatgactagttactatttgaaataggttatttctcgtcctttcagtgtccctgcaaagtttggtgcgcttctgatcagtttctgaaaaaaaagttaagcctaaaccttttggcctgtttaaaaaggaattaaaaatttttaaaaattttattcatctc

SEQ ID NO: 64327 - DNA, 93 bp, Heterodera glycines
  Genomic contig location: Contig_ID=SeqID_34565; Location=433..525; Strand=+
  SCN-specific regions: Sequence locations=1-93
atggggagcaaaaatccaacgcagaattatagtacaggctatagggaagctattcccgaaggattcggtctccccataaatctgggcgcatcg

SEQ ID NO: 64328 - DNA, 147 bp, Heterodera glycines
  Genomic contig location: Contig_ID=SeqID_34567; Location=432..578; Strand=-
  SCN-specific regions: Sequence locations=1-147
atgacgccaataaattggcaaaccctcgaggtaaatactgaaggtccacaaaacttccaacgcagtgaaatcggcgttgacaaacagcgccagcacaatgcacgggaggacgagaagttcgacgcggaaagtgtcctcgtctttatt

SEQ ID NO: 64329 - DNA, 570 bp, Heterodera glycines
  Genomic contig location: Contig_ID=SeqID_34567; Location=366..935; Strand=+
  SCN-specific regions: Sequence locations=1-549
  Gene Ontology: Mol. function=KDEL sequence binding; Cellular component=cytoplasmic vesicle; Biological process=intracellular protein transport
gttctgttcatcggttctctcttcgccacctgttatttcatgttcgtcaaattccgtgccacttacaataaagacgaggacactttccgcgtcgaacttctcgtcctcccgtgcattgtgctggcgctgtttgtcaacgccgatttcactgcgttggaagttttgtggaccttcagtatttacctcgagggtttgccaatttattggcgtcattttgccactattctttagctgtcgcgattttgccccaacttttcatgcttcaaaaacgcggcgaagcggagacaatcactgcccattatctgtttctgcttggcatttaccgcgctttatacattttcaattggtttatttgccggttcatttttctgccattttccaaatttaagggtctatcgctattacactgaggcgttctacgacccaattgtgatcgtttcgggcattgtaagttaagaaaaaacagcgccttacgcctcgcattcctttcacaggttcaaactgttctgtacgccgatttcttctatctttacgtcactcgagtggtcaaagatggggccaaattggaat

SEQ ID NO: 64330 - DNA, 3537 bp, Heterodera glycines
  Genomic contig location: Contig_ID=SeqID_7276; Location=2161..5697; Strand=-
  SCN-specific regions: Sequence locations=1-57,119-124,146-184,212 -310,332-623,646-955,983-1021,1043-1048,1110-1424,1448-1565,1587 -1623,1652-2164,2194-2497,2519-2882,2904-3120,3142-3537
caaaagtatcgatgtgggtgatcagaagaggcgggtcatttcagtacggaacaaatgattttaattaattaataattattttaaatatattattttaaaatatttttaaatattatttggaggcaaaaaatccatcaatatattttacacattcaatgcattgcacttttattattcacaattgtatttttttatatattttataatttaagcatattattgatagatttttgccatatcagtcgacactttttagcgagttattgcactttatttatattcgattaaaatacgtagcataacctagtcaaaataatagtttttgtcttctcataataaagcaaattcatttttctaaaatattttacttctaattttctcttaatttttttgtcaatttttaattttaaaacgattttagaaatgaaaattttacttttaactttttttactatcctttgctttattgacttaacgtcaaaccataagtcgaaatttgaggactttcttaaaaatcgagaagcaatgaaactgatcaaaagttacaaggaaaatcagatcaaaactgttaaggaactacatattgagctagcaaaaacagggattcaattgggaatatgcactttaaaaatatatatgggtaaaacaagagcactatttccgatacatcaaacgaaagccctcgattagaaatgaaatttgaaaaatgtctttctcgtgatctatcagatactatctatttaatcggaagtgagaacaattggcgaaaatacagaatgacgaatgaaaatataacagatttatacattgcatgcacaaaatgttatgcgttacaaaacaaagaaaaaaggcttaggccaattgttgcaagagcagttattcaatttaaagagagataaattggccacctcacaagtaatgccatggcaaaaagcttattctatcaataatatgcttaaattataaaatatataaaaaaatacaattgtgaataataaaagtgcaatgcattgaatgtgtaaaatatattgatggattttttgcccccaaataatatttaaaaatattttaaaataatatatttaaaataattattaattaattaaaatcatttgttccgtactgaaatggcccgcctcttctgatcacccacatcgatacttttgacacttcgccacatcgataccaatttttctattttaattttctcgatgtttcatcatattcctttttcggcatgcttttttcaaaaaacttggctaattgtaagattgaccggcccgggccgcccggttccaaagagtccgtttaacatgcagcccaggcccagcagtcccaaattctgaaccgggcgcggcgttcgatggggccgggctttttgcaaaagttatggaatgctgattaaaattgaaaattgcttaatcttttatttttttaatttaaaatagtcagctatcttaattccatattttaaagctaattttttaacctcaggcaattattagggacaatctttttgtgtttaacattagggattccatttttttaattttaaatgtgtaacatttggtgggacttcaggtcctaaaaatttccgaattccacaattttaagaatttcttcaaaataattattatttactttataataacatatcccaaaaccaaaatatgcgattgcttcagttttggtgactatcgccgacatgggccgttttctctcaagtacgaattccgacttcgctttcggcactctctccccccccccctccgtttttccccatttttaggcgtgtgcatttgggtggataaacgactgtttcaaattcgcagaaactgtttctctcggcttcgctggttttgcttgacaatttgttgtcagatttgtttgttttggaagcgacggagaaaattccgaaatcgaaaaggcgaaaatcgccgtgccaataagtccgccacagcgacgacttttgcgccgagcgtttcgaccacctcgggcaagttacgaaagtgcaaatgacgttggccatgatggcctttttgtagggggtgaagccattcccgaggaaatggcctcagaaggtccctttgtggccaatcacgtggtcgcaccgtgtggcactttggccacaattgacgaattgtcgcgggaggccgttacaacaacggacgacaacaacaacaacgaaggaagcggcagcgaaagccgaattcgccctccgcacctccgcttgggcgtctgttcgcgaagggctcagagaaggctaaagcctccgccattccctcccattttggacaccgtttcggaagcggggacatttcaaggtcaattaaggaaccaataacaaataattgaagattggtcattaaagatgtgtctgagatcagaacagtgcatggagaggacgaatttgaggagagagcgggaacaaacagcgaagacacgcgagcacgggcagacgaattggaggggggagagagcagcgacatggacggggtggaggacaaggaggaggagcagtacacgccgctggagaagcgcaaccgacgcgtgtccgcactgttcatcctcgtcgtcatgttaggcgagtacttcgccgtccatccgtcactttcattcggttttccttagggtacaccgccggtggcgcttgtctgatgcaattatgggagcgatggtcattcgtcgatgccttttacttttgtttcgtcacagtgaccacaatcggatttggcgacattgtcccacagaatgtcacttttttgcctgctacgttggcttacattgtgatcggtctgtcaggaaagcagctccgtttggctgaccggctctttaggcctgatcatcaccacaatgtgcatcgacctcgtcggcagtgcttacatccaggacatccatttgtacgggagggcactcgggagcagctttctgaccattggcggaaaagtcattcaccttggcgaagtgttctcctacgtggcttttctccagaagaattacggtctcggcttgctctctttggcatttcccttcgcttggcttaccttttctctcgtcaggacttactcccgaccaactcgacagactcgcccaattgccggaggttggcatgcacagcaactgacaataaagggaccaattcgttcaggaatacctgctggactgcttgatcaatgggcggcagcctgacctcaattggattggcgggcgccctttcattccgccagtcggtgctttgtccgctttgccttccgacctttgccttttgcaggacatttattacttcaaatggattgagcagccccggacattgtccttcacctccgaacggcagttggcctccagcgagtctttggatctgttcgttccgagggttccgtcgtggcattttccctccctttccccccccccccccttagaaacacttcgctgtgttccaccgctcgcactttgacccctcgcgagtattatcaacgagtgctggtccattactgtcgccaaatgcaaacggaagcggtggccaaaacgccggcgatt

SEQ ID NO: 64331 - DNA, 659 bp, Heterodera glycines
  Genomic contig location: Contig_ID=SeqID_34577; Location=298..956; Strand=-
  SCN-specific regions: Sequence locations=1-659
cggggcagtccccccgaaccgatccgtccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttata

SEQ ID NO: 64332 - DNA, 660 bp, Heterodera glycines
  Genomic contig location: Contig_ID=SeqID_34580; Location=1049..1708; Strand=+
  SCN-specific regions: Sequence locations=1-317,348-537,575-660
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtga

SEQ ID NO: 64333 - DNA, 56 bp, Heterodera glycines
  Genomic contig location: Contig_ID=SeqID_34580; Location=1..56; Strand=-
  SCN-specific regions: Sequence locations=1-56
ggttcgatgaaacttattaaaatataagcctaaactttttggcctgtttaaaaagg

SEQ ID NO: 64334 - DNA, 60 bp, Heterodera glycines
  Genomic contig location: Contig_ID=SeqID_34581; Location=900..959; Strand=+
  SCN-specific regions: Sequence locations=1-60
atgacaacatcacatttgacgaatggcatgaacggttcggctctttcgttgaacaggagg

SEQ ID NO: 64335 - DNA, 1471 bp, Heterodera glycines
  Genomic contig location: Contig_ID=SeqID_7279; Location=160..1630; Strand=+
  SCN-specific regions: Sequence locations=1-372,394-412,434-437,459 -483,505-535,564-590,612-635,665-1471
atgttgcgaagattgagacggagatatccccttttcgcacatttactgttaaggcaattagtcaaacgtaaatttgcaaagttagacaggaatttatcaaaaagcgatgacaactggcacatgacatattttgcgaatgttagccttttggtacaccgataataaagaatatcaatcaccgatcagacaacccagacagatttactttattagctttagaacacggatctatagacatttctttaagtaaaacaagaaatccgttctacggcaaaaaaaaaaaactgataaaatcatttaacttaattgtattaaataaaaaacataaatttacttaaaaaccggaccttctgtctgaaaatcttcggttgtgaaggaggtgccattgtaggcaaaggatatttatttggtgaaaatttattatttcttaatagaccaaaatggctttggacaaaatatgtcacaaaaatttgcggattttggacaaaatctgttaacaaattgaaaaatttcaaatccgttaaaaagtcaaatcttaaaatttttaaatatatttaattaaagtgtcaaaacatacacattggaaaactaacacactcattttatatctatgcgattctgaagtacgtttaaacaaaaaaaacttaaaattaattttaattttggctaattacatgagttgttcagttctttgcaatttgcccatttgatttggcaaacgctgatctcctcatccttactgtctccactcttgcctgaacgttactctccttgcactcctcaagtttcgaactttgcttaatcgctaaactctccgctggtcgtcctccccttcgttgatcactggcgttggtgaaggtgggaagtcagctcgaaaaaatttacaaaaaacaaacaataggccctaaaattttcaaggaagagctctgatttaaattttataacaaatcgtttaatttattatttcctgaatgatttaaaacaattggcaaaaaatcatttttttatataaatcagattttaaaattgagctttcgattaaattccactcctacattatgccaccttgtttaaagtcatttttaaaaatttgctttttgtcaccattattcaaccttagaaatccctattttcgggtattcacccttaaaaatccataatagcatttttacctctttatttactgtcttattttgtacttttttcaccctttaaatccgatccataatcataaggtgaatgatgaaaacagccatagaacagcggttcaaatgtcacataaattttgtttaattgatcatgattctcgcggaaaaataacacctattaaactccagagggttctcaaaaatggcacaccacagctgtttaatttggagacgtgttgtttaattgttaatcagttcgatgagcaacgttgcggttacatcggtcttgcaaaatttccagcgctgtgggatgcatgatataa

SEQ ID NO: 64336 - DNA, 86 bp, Heterodera glycines
  Genomic contig location: Contig_ID=SeqID_7279; Location=1932..2017; Strand=+
  SCN-specific regions: Sequence locations=1-86
atggaagtggttgggattttgctcacttttcagaacatatgggtttttaagtatgactcaagtgcagtatgctctaaccatatatg

SEQ ID NO: 64337 - DNA, 2114 bp, Heterodera glycines
  Genomic contig location: Contig_ID=SeqID_7280; Location=109..2222; Strand=+
  SCN-specific regions: Sequence locations=1-1137,1160-1474,1497 -1955,1978-2114
atgagcggattgaaaagattccgaattgtctcatcgcctaaaaaaagaatggtcgatgactttccaaccaatctcaaacatcttcgcgatgtaattctatttggcttttccggcctgttctatgtccgtgccagagttgcagatcttcagttttcattatacaaggtttcgggtcgtctattctggccaccattatgaattaacacggatttaggcatgtccgttgaagcgtaacgggatgttatgtaagaaaaaactcgacgaggaactgtattgtgccagttgtgaccaccgcgccaacaaggcaacccgcaatctgtacatgagattggagctccgagattgcgaaaatccggagataagccagactgcgactgtcttttccgcggtagcggaacattacctaaaccttaaggttgagcaatttgccaaaatggtagaagagcagcccggacagctcgaagcactgcttaaatctaagattgagcagactgtcgctgtcaaactcagtataaaggtgcacaaaattcaatatatggatgtaaaaatattcttttttgagtttaaggcaaagggagagctcgagacgttggactgggtcgctgtgtccgtacagcaggagaaccgtgagagtgagggagatgacgaggcgtcacctgatggacaaatgaacttgacacaaataacgaagatggataaataatcgagattgagaacaggagcgtgaattcggaggcctatggcccgcctaagaaacgaacaaaaaagaactgatccaaatcaattggctccgtctctatggccaattatttgtagtagtctttggcctagttgatgttaacccggattaatatcatagagagggaaagagagatagaccattttgttagtaccatatgtatctttgtacaattcatccaaaaattagtttttcaagcaaccacagctgaaccgacgatgaaaagggagcaatccacagcggcgggcattctttcattattatcggcagcagcgcacaatgacaatacagcggcagcctcagcctcggatagcaatgccaagcgactacgtcgtcatagttgggactttaagacgatggcccattttgaagaggaacgggcaaaggcggaggaggatagacagaaaaaagagaagcagcctcaacaaccagcaccttgtttgagcaaaaacagcattatgtgcaccgagtggaacggttcgcactgcaacgccatgtgaccgagtttgtagttaacggaaagcatgatgagccggaagaggcgcttctctgcgccttcgagcatatcatcgctcgtgcaatccgaaacgcagaggattcccatcagcaaactgacaacggaagaggcgcatctgcgggcgacggtgtacgtcgtcaaaggcacgtcataagacttggaattttcttaatggtagaggtgagattttccctaagcgttattcgctcctttgttaatgcaaaagttttctttgcaaaacaccaggtctaaccgacccgattctgctgcccattcgtcctccggagcaaaacacggcagaagtgttgatggctgagctggacaaacttggccagtcggatggcgatgaggatgtgcatggtggagggatcagcaaacgttctttgttgctcagcgatccaattgaagtggtcgtcacatgtatagcacctccggtggtgcggcgccacgtttttaccaataccagcattggggctatgacgaccggcagctgatccgtgtgatgaatcaggacgacaacttttgtttattcatgcactggttgccacccgttcgtacacggaccaggaatttttaaaggcaacttcgcgacgacaacccttaacagaggcggatgatgatcatcagcgggattcagtgaccgctgagatagcacgacgcgtgataacgagaaaaaatttttgtgctggctacgaagcactgaacagtctggtgtccaaccgggagcggatgaatgcgacagtgacggagctaatgcaagctgcagaaattccagcggaccaagagtcgtatgagatggagcatatcgaccaaattcagcagttttgggtcggttgttggtgtttgaatgagtgctga

SEQ ID NO: 64338 - DNA, 566 bp, Heterodera glycines
  Genomic contig location: Contig_ID=SeqID_34583; Location=264..829; Strand=-
  SCN-specific regions: Sequence locations=1-114,136-242,264-498,522-566
atgccagatttaacggcaacaaatatttcgaaaagcaaagtaaaaaaagaaacgaaactttactgtcaagaaaatgagttttgagtcaacatataatttaacccaatttgtcctgaatttaaaaatcaaaaatgcgactatagttacatttaaattcgtattttctcggcgctggactctccgtcgatcgccgtaaattcatgaaaatcttaaatcacaaaaaattgtccaaataacctagcaaaccttttaatgaaaatttggcttctgtgtctcggtcggtttggttttttgtcacccatcagtcgagtttcattctcaatactcgagttttctctaattatcataaatattttatgtcggaatcaataatctgtcgaacacacctggcacagggatgccgtgtcttagtcgatgttttgcccaatagttaatatagttttctattttttagtgaagttttaatgtacgatgtttttttgcgattgggattaaaacaataaatttaaaaccttttttaacccatcctaatcttattgctgtttcaggtccaattgtatctttaa

SEQ ID NO: 64339 - DNA, 634 bp, Heterodera glycines
  Genomic contig location: Contig_ID=SeqID_34587; Location=619..1252; Strand=-
  SCN-specific regions: Sequence locations=1-22,44-242,264-311,344 -464,486-634
atgtggtccgccgccaggtgcatttggtgggccgccccctggcggcttccctggcggagggggacctatgcgtgggtacgaaggcggtggaggagggggatttgctgaacgaccgagaccatattgatcagtgattgcaaaacaatggttgatctgatctggacccttttgataatgagaaaaaccatgatattcgttcttatgttttcttttcctttggtggactttcatgtcttcctcatttttatgtagttttatatgttctctgcttttaatatctaattggttttgatggcttttttattccttccatttaattaaatttggtaatttaaaccattatacttggacaaatgcttatgtgagaaattaaagcggttttccatttttttttgtcataatgcaaggatcatcggcacgttcatttttaaatcctttgaaaaaattgcaacgaaaagaagacttggagaaggaatttgtggagagtggtgagaaagaccgggtccaagaggttgtggaacgacgacttcacgagtcggggtgggcgaaacgagtggagagcatgtgcgaggagtacatcgcgaagaaggtagcgaaggtgaataaggccgcatgagttattgttttaaataaa

SEQ ID NO: 64340 - DNA, 71 bp, Heterodera glycines
  Genomic contig location: Contig_ID=SeqID_34588; Location=313..383; Strand=+
  SCN-specific regions: Sequence locations=1-10,44-71
caccaccacattttcttcctcctttcttcttccttccttctctccaccccatactttttttttaatacaaa

SEQ ID NO: 64341 - DNA, 569 bp, Heterodera glycines
  Genomic contig location: Contig_ID=SeqID_34589; Location=494..1062; Strand=+
  SCN-specific regions: Sequence locations=1-47,70-136,158-519,548-569
atgagcaaaattgaaactgtcaaattgaaatcggatatcgaagaaatcaaatattttcttccattttgtcccaatgtcaatctgcacaaaaggacatgcactgttgtcacattcggtagagcaaaaatatgagaaattttaaatgaaacccaaatttttgctaggtgttgggcatactgttaaggctgaaaaagaactgctcaaaatttacccggaatgccatttgatcgctgctgatccgtcggatgaaatcaatgccaatttgactcaatcaatcggtggcacttttgttcatggcccaattggtgctgagacggccaatcaacaaccagtgatctcatggggaggtaggctaaactttatggaaatgcttttctttaatatatttgcacttcactaccagtgattgtaggtggcattccgaggccgaacattttaggaaatcggaatttctaggccaaaagtttttaggaaaacggaattccgacattgcggaaatttctaaatttttgaaaatggataaatttttcaattttatttttttttagtagcatatatgtaaaatgtta

SEQ ID NO: 64342 - DNA, 3468 bp, Heterodera glycines
  Genomic contig location: Contig_ID=SeqID_7283; Location=391..3858; Strand=+
  SCN-specific regions: Sequence locations=1-215,242-263,288-520,585 -964,986-1897,1931-2053,2128-2434,2458-3068,3092-3223,3265-3468
atgggacgttctactcggaaaacgacgacgacgatatggtcgttccgtcaacttcagctggacggcgacgacgacgacagaggcgcagcggggggcggacgggtcccagctgctcgggcttcggctcctttggcccgccgtcgtcggacagcacggacggctcctttgtggagttggctgcgtggagtgattgatgatgggatgggggggggggcgacgacgatgatgatgatgatgatgactaatttataacataatcttgctatataaaataataataataatttcgatatctgttgaccgcgcgtgagcatgcgcaaagcgaatgggggggggggggtgtggggtaaggggggtcagacgcgcacgcgcagccctttgcaactgaacagcgcacgcgtgactgcaaatagtttgcctaaaatgggcggggggggggggttggagggaaaattagagtcgacaaaaattgaatccgcccacctcttcaattgactcagacgggacgcggccgaaggcggacgacaaccaaagcggaagccggtgacaacgacgacgacgacgacggtgaagtcgttgacgacttcttcaccgtggtcggtgtctgggagcgggccggctcccggtcgcgtgccacgcagaccgagaccatccaagtgcgcttccacaactgggagcgggcgcggcgccccgacctactgctcgcacgctgcatcgcccgtctgatggctcgcgtgctggacgggcgtgcggagccgctccgcgtcgggctgtccgtacagccgcccggctgggacaactgcttccacgtgccgatgcgcccaccacagcagaacagtgcgcacgcgctggcggccgccctcgaaacattcgcgaagcagtacgacgagctcgacctgttctccgccgacgtctgcttcaaagtgtcggcggtttgggccttgcccggtgagctcgtcctccgcatcccccacccctgtccctcgacaaagtttgacccctccccccaccgtttagccgcgcgcgtggagggcgcatgtgccgaggacgagcagcgcgcacgtggcactgtccgctgccaatcctttgtgccggttgtgaacggggcgggcggcgaccgctggtgcatggcacgcgccatcgtgctggggctggcccagcggcgcatctgcgtactggagcggcgcaacgtggtccacttccgcgccttctgtctggcgcagcgtggcgaagcgggcgcgcccgaggcacgtcgcctgttggaggacgcagcggtgccgctggaccgcccaacgtacggggctgccgaggcgcaacgagtccagcgctggctggacgccagcctaggcgcccaccaagtgcggctggtcatcttcgcccgcgagctggcctaccgcgtggcgtggaagggcgcgcggccggcacgctttaacctgtgcttggtggtacaggacggccactacgggtacatacagtgcccggagcagctattccatgtactatactacctttagccaaaagaacttgtaaaattgaaaattgtttaggcgcgccagtactgtgtggactgcgagcagccggtggaccggcgcacacacccgcaaggctgccgggcgctgtgcccccagtgtcttcgctttggctggggccgtccctgtgcgcgggagccgggccgcgcgccgtcgcgctgcgccgactgtctgttcgtgttcgagaacgcggactgtttcgaggcgcaccggcgccgggtggacccgccgccgcctggctggcaacacgaccgtcgtcgcggcagaccccaccgtccgatgtgtgaggagcggcgcgtgtgcgcccgctgtcgtcaggtggtgtggacccgtcacggcgcgcacgcgtgcgccctcaacaacaatgttggccgacagcaagcagcacaacaacaacaacagtgcgaccgatgcttcgggattcacgacgcgcagtggaccccccacttcatccagccgaagcgggcgcagtgtcagctgatcgccaacgacgcggagcgcccagccgccccggcggaaggcctcgaggacgacaacgacgacgacgacgacgatgataacgatggcgatgctgacgatgtcaacgacaacgacgacggtggtgatgcggaacagaatcgacaacgtcgacgacggcgcacgctgcgctttctgttctgggacgtggagtgtgcccaagtggcggacgaaaatgaagagggggacgagggggtgccggcgcgaatgctcaaacatgtgccgctgctggtgtgcgcggaggtgatctgtgagcggtgtgtggccgcgggcgtggacttggagcgcgagccggaccgacgggcgcctggctgttgctgcggcggtgcggcttggcgagacggacaacaccgccggtggctgatgcgcgcgcgcgaggacgcgttcagcgacgacgacgacgacgacaacgcagacgcggacgggggacggcggtggcggcggccgaacccgcgccgcttgcgtttcttccacgacgcggcgaccgggcgttcgccgatggcacagtttgccgattttgtgctccacgacgggcccgtgaatgtgcgcaccgtgatgctggcccacaacggggtacgggggtgtacaaaagcggagttgaagaaaagctaccatctacgctttgtaggggcgttacgatgtgcatttgctgatggaggagctccagcggcgcggagtgcgtccccggcggctggtcgccaccgggctgcgcgtctacacgctggagctgggcggacgaaatcagcgcagcgtggtcgccaaggactcgctgaactttttcggctgtgccctgtcaaagctgccggccatgttcgggctggacggcgtgccggacaagcagttcttcccctacaactacatcagggccgaaaatatggatgtggcgcatgtgggactgccgccggctgccgactacgacccggaccggatgcgcccggcggagcgcgacgcgttccagcgctggtacgcggcggagcaacagcgtcgacccaaccgactgttcgtgctgcgccgggagctgctccgctactgtgccaacgatgtgcgcattctgcgacgcgcctgtctgcgcttccgccacgtggtcggcgagctgtcgggcggcgtggagccgttcctggccgcctccaccatcgccgggctggcgctggccatctaccggcaacaacatctgccccgtgatctgatggtgcacacgccggagggcggcttcctgcgcggacgacgcgcttccgccgcctcgcgccacttcttcgcgctgctggagagactgcacccgcaatggcgcggtcgactgcgcaccgcccgctggtccatcggcgaagcgtgcgtggaggacgatggttaccggctggacgcgctgctctaccgcccggtgccgctgcgcccgctcgtcatcgagttcaacgggtgcttctttccg

SEQ ID NO: 64343 - DNA, 987 bp, Heterodera glycines
  Genomic contig location: Contig_ID=SeqID_34593; Location=798..1784; Strand=-
  SCN-specific regions: Sequence locations=1-118,151-156,240-240,270 -321,444-446,474-481,557-628,696-835,871-987
tttcgcttgaatgttcgtgcatggaataatagaagaggattttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaaggggttggtaaaccggtgaaaatttgccgtggattgggatcggacattgcaattattgtccgtgaacgaggaattcctttgtagggggcgagtcatcaactcgctctgaatacgtccctgccctttgtacacaccgcccgtcgctgccccgggactgagccatttcgagaaattcggggacggttagtgttccggcttcggtcggtatgcagactggaaccgatttaatcgcagtggcttgaaccgggcaaaagtcgtaaca

SEQ ID NO: 64344 - DNA, 718 bp, Heterodera glycines
  Genomic contig location: Contig_ID=SeqID_34593; Location=643..1360; Strand=+
  SCN-specific regions: Sequence locations=1-272,308-447,515-586,662 -669,697-718
ttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccggggcagcgacgggcggtgtgtacaaagggcagggacgtattcagagcgagttgatgactcgccccctacaaaggaattcctcgttcacggacaataattgcaatgtccgatcccaatccacggcaaattttcaccggtttaccaaccccttttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagt

SEQ ID NO: 64345 - DNA, 153 bp, Heterodera glycines
  Genomic contig location: Contig_ID=SeqID_34595; Location=207..359; Strand=-
  SCN-specific regions: Sequence locations=1-153
caccaaatcttcctcactgaagcacgggaccgaactcaaattggtgtcccggcaaaagctgcgtccaatcgatgccatgacgatcaacaacagtaccagcagactttgccagcaaattcaccacaagtggatgaaaaatgggcacaagctgag

SEQ ID NO: 64346 - DNA, 61 bp, Heterodera glycines
  Genomic contig location: Contig_ID=SeqID_34596; Location=370..430; Strand=+
  SCN-specific regions: Sequence locations=1-61
atgtgcgacgaagaagttgctgctctcgtggtggacaatgggtccggaatgtgcaaggcga

SEQ ID NO: 64347 - DNA, 738 bp, Heterodera glycines
  Genomic contig location: Contig_ID=SeqID_34598; Location=384..1121; Strand=-
  SCN-specific regions: Sequence locations=1-59,86-253,335-738
atgcttataacaaatttcaattcaactaattgtaagcgaaatttgtttgttagtcgcacaaaaattattttgtaaaataacaaaaatgattcgaatttttgagtacctataataaaatttttttttagcaaaagaaaaacggaaattgtttttggattttgtatagcaaattagtaaaaaaaaaatcacctatttatttggaaaattgtttaattttcatattttattttttcaattcaaaataaattagtgaatttaattatggatttagtattatttatgttattaaaatatttattaattatatataattaattatattttttaattatttgaaatacaaaagcatttttaaattcattttagaactacttagtctggcccagccgtgatgaggccgttttcgatgatgttgtcatggagttgggcgtgtatggctttatgcttggcaacagagttgacggcacggtgccatactttgaccagcctggtcacttggtccgtaccaagttggcatccagcaatgagggcggcgtttcagttggaaccggcgcatttgactcagtttacttgtattaaatatgggagacaaaaaaattgttgcataacattttcctatcgtaacttttcctactactgtatccttcttgggtttttttacagtatctttggtgggacaaataatttagatgataaaatgatgatgatttctgttgtgttgtttatgaaacaaataaa

SEQ ID NO: 64348 - DNA, 324 bp, Heterodera glycines
  Genomic contig location: Contig_ID=SeqID_34601; Location=63..386; Strand=+
  SCN-specific regions: Sequence locations=1-324
  Gene Ontology: Cellular component=mitochondrion
tttacagttaaattgttttttacatatttatttacttttaaaagcacttttgtttttcatttgtcaacacctttctgagtcccattagtcatgctcaacacggggttggtcattcccttgctgttatgaaacagaaataatttcatgtttagaaaatttctcggcaaaacttttgtcataacgggggcatcgcgtggcattggcaaggaaattgcacttaaattggccaaagacggcgcgaacatagtcatttgcgcgaagacaactcaggacaacccaaagttgccagggacaatttacagtgcagcggaggaaattgaaaaa

SEQ ID NO: 64349 - DNA, 1004 bp, Heterodera glycines
  Genomic contig location: Contig_ID=SeqID_7284; Location=798..1801; Strand=-
  SCN-specific regions: Sequence locations=1-110,132-840,881-1004
atggtgatcaactgggaccccttcattcttttcatttcgccaacaattctagttgatctcaccattgattctgtccattccggtgaactgcttcccgatggaattgatgattttgatgggccaaatgcaactccaactgctggccaagcgttgtccaaatggttgcacactccgagaaatgatggccaacccaagcgattgatttgtcatggttttacgttaggatttagtaaatgggtcatcgatttaaaggaggtcagtcccaactttttcgtaaaatgtttggattaattgccatttgatttcggtttcccattgtttaggcatttctccgtgccaccacttcttctgcctgctacaaaattcaaattgaattttttgagccaacagaaattgtgccatttgaattggtgaacgaacggaccagcgaaattctaaaattggagaaaggagaagttgatggatgggttttcccatggataatgaaacgatgccaaattggagggccggcggttcaatgggaggacgaaaatttggataatttgaacgatgtccattttatgcttcaagcagattgcattgggtgatttgcttttattggtgccgtcacattaaatttcatttcatttatgccattgtctgcgcaaaaggcgggtcaaatgaacgcaaaatattctctgaaaatgagtgccggaaaaagtgaatgaattattaggaaatgagaaattctgatcattgaatggaaattgatctgataattactcctcatatttatttgttgcttctttcatttgatcagaaaactacaaaaaactggttttgctttttggatattgataatttatccaaaaaatttaaaaatggtttataaactggaaaatcttgacaaatgcgcgaccgcgatacgcgattggcggcattttttttgcgcgatccgcgaccgcaggatttttctgtgcgcgctccagccctgcttcgaccaatagctgtcagttttcaataaa

SEQ ID NO: 64350 - DNA, 877 bp, Heterodera glycines
  Genomic contig location: Contig_ID=SeqID_7285; Location=1371..2247; Strand=+
  SCN-specific regions: Sequence locations=1-8,35-605,627-877
atgggcgccagaaaaacagacaacacaaaaagactcgccattgacaactcatacaacatcttgggagaaaagctagctaacattggtaggcttatggacgaaaacgaagatgacggcaacaacaccgactgttctatttcacgccaattgttccaaatctgcttgacgcttctacaacaggtccaaagccaacagagtgagcttttcactctcaaacagcggcaaattgcggacgaagctgtgcaagatcacgagcggcggcgaagcgttgtcgtaatgggtctactcgaatcgcagaaacaaaagccatccgagcgagtcgctgcggaccgaacggccatctcaggcgttctcgatgagcttggcatcgagagcccgatcactgtttacagaatgggttccacggaccaagcaaagacaggtcaaaaccgcccgcggttgatgaaagtaattttcggctgctcaaaacatcagagacaaaccttgacacaatggaacaaactgcgcgctcaaattagtcaaaaaccggggatgagcaacatcaaaattcgcccttcactcagccaagaggaactcaaggcccgacgtgtgctgcaggaagagtgcagcagaaaaagaaaggaagatggcggcgaatgggtggtttacgctgacaaagtgatgctgaggtcagacattgcgacatttaaaaataacaccaattgacttgctattttaccaaatcacactcaaaaaacatttataaattcgcacttttccggtcttaagcatgttaagcccaataaccccaaaacgaaaataggggaagttaaagcatgcttagttaatattagatcactttacaacaaaattgatgaaatagctttaaatttggtaa

SEQ ID NO: 64351 - DNA, 177 bp, Heterodera glycines
  Genomic contig location: Contig_ID=SeqID_7285; Location=2185..2361; Strand=-
  SCN-specific regions: Sequence locations=1-177
atttcctatgacaaaaaacaaagttatagttttcaagtatccatgggctaaagaggattgggttttcctcctttgtccatgtttcagttaacagaaaaatgtctatgtttttatttaccaaatttaaagctatttcatcaattttgttgtaaagtgatctaatattaactaagcatg

SEQ ID NO: 64352 - DNA, 655 bp, Heterodera glycines
  Genomic contig location: Contig_ID=SeqID_34605; Location=100..754; Strand=+
  SCN-specific regions: Sequence locations=22-237,259-655
atgcaattaaattgcaaacattttgaattctcagagattgaaaatgacctgactgatgctaacaatcgaattgtggacgctttttcaaaaatggagcagtcttttgatgacgcacaacgccaggaaatgcaaaaggacggatggacatttctgagacaattccaatacgaccaactttgtacagatcaatgtgatcacttttatttaaaccatccaatttttatatgtaatcttttcgaattttatttttcaccacttaaagatgctcaattgcccgaaggatttcgccattctatcgacgaattttcacaaatgccaaaagaaacgcgtgaagcaatgctatggaagcgaattgagcgcatttcgaggaatatccctgacgtaaataggccaattatggcaattattaaggaattaattggtggttatgctcaaaaaattgtgcaaatttatgaaggaaatcgctgataaattggaccgacggaagatggaaaagaacgaacgtttgtcgggccagcggcgacgaaaacgacggcaattggaacccatcggcggcatcagtgtgctcagcccaattatgttgcaaccgtttatgttttcgccgacattgacgtaacaaattaacacatttcattaatgaactattaattgataa

SEQ ID NO: 64353 - DNA, 315 bp, Heterodera glycines
  Genomic contig location: Contig_ID=SeqID_34607; Location=6..320; Strand=-
  SCN-specific regions: Sequence locations=1-79,101-111,177-315
atgaatgttcccgattcatttgctgttggccatagaccacgtcgtttctgttcaccgtgtataattcgcttcaattccatagaaacacgaccacgaacattggcaatggtgaaataataattaaaattaataaaaaaaatttacaattaactaaattttattcattttattttttagattcaacgctgtcctcaaattaattcgttgagtaccgtagttccgaaagttaatggctacggtggaagtcacacgccaaattgggcatattgctaccacaactcaagccctccctaccgtaactcatactacgatatg

SEQ ID NO: 64354 - DNA, 190 bp, Heterodera glycines
  Genomic contig location: Contig_ID=SeqID_7287; Location=341..530; Strand=+
  SCN-specific regions: Sequence locations=1-14,37-190
atgaatttaatttgcttttcgttcttttttgttgttcttgtgacaaatgtcatcggtgaagggtaattaaatgaattcaaatcaattttcaaatgctttctgtttctttagacttgccgaggacaaatggaaaaagtgcgaattgaatgggaacagaatgatcagaatgggaaaggacgttaaaaagtaa

SEQ ID NO: 64355 - DNA, 866 bp, Heterodera glycines
  Genomic contig location: Contig_ID=SeqID_7287; Location=935..1800; Strand=+
  SCN-specific regions: Sequence locations=1-261,290-431,454-560,587-866
atgagttcctcttccgctaaattggccgagttccaaaatgctcttccgttcggtgtttttttgaatgatttcgacggcgcagcgcttggaattgtcgcatttgaaattcattgtgccattggaacaaatgacgtgaacacttgcaaaacgatggtaagtgaaatttaaaaaataaatttgaacattttgaatgaaaaaatggttggctacggggggaatagaacccatggcacaaaacaactgagatttgaatgtattaagaattttttttaataaaaattttaattttgtaggctaccgaagaaaaaagtcgaaaattgaccactcggggaattcgaacttccacaaccactcgggcaactccgccaaaaacaaagctgaaaattgtaactccattcaaaactgaaacaccacgcgttgtaatcgttttcattttttaaaaatttaaataatgctttttctagtctgaaattgaaaaatcaccgaaactgaccaccctggaaacccatacaaaaacaaacccaaatgtcggaacttcatctgccgtaatcatttccctcaaattaaattaaattaaaaatttttagccgaatctgttcactccacgtgattctactgtgaagcatttcggcacaaattgcgtccaaattgattttccagctgaaattgcccaattttcgctgaacgtttccgccgcactattcggcattgcctgtaaacaatacctaagaaagtacaaaattggacaattgccaaaaaattacgatgaaaaaatggaaataaaagacaaaatggaagcgtgtggaaaagtgccgacagagacaaattgcaaaaagttaaaaaaatggaaattaaaattaaattaa

SEQ ID NO: 64356 - DNA, 2260 bp, Heterodera glycines
  Genomic contig location: Contig_ID=SeqID_7288; Location=1578..3837; Strand=+
  SCN-specific regions: Sequence locations=1-139,173-286,319-604,626 -755,794-938,1016-1152,1190-1219,1241-1667,1694-1844,1920-1942,1966 -2190,2214-2234,2257-2260
atgggccggacgaaggcatcgaaattttcgacgcgaaagacggatactgcggtcgatcttgggttggacatattaaggaatggcaacgtgtttcaattaagtgtaccaatgttggtttttattatcgttatcaatttaattaagttcatttctaaattatcagtccaacactgttgcccacgagtttttacatgcgctagccctctggcatgagcaagaccgggacgatgccaacaaatacatcaaatggaatccaacgccacgaaatgttagccaggattacaagaattttcttttgcaattttacattaaaaaacactggcataatttaatattttagcaaaaagagccggcgaaaacagaaaattacggctttccctatgattttcattcaattttgcattatgaagctgtgaaaacaagagggtcagttattttaaaggtataaatgaaaagaaaataatttggcaatgaatcagctattacgacatgattacgctgaaccgtttttaccaacgcacaatgtttcactcaacatatgaactttcgtttaaagacgccgccattatcaacaaaatttattgcgacggtaaatcgaattaattcattataaaatagagtgaattaatttaagaaaattgcaaaaacgtcgaaaacaaatgccaaaagggaggatatcccaacccaaagaattgcaagcaatgcctttgcccggtgggatacggtggagaaaaatgcgaaatggtcgaaaatggtaaaaaaaaaattaaaatgataaaaattattaatatttcagatggaaattgccaaactgacagggcaaatgaaattgaagcagattggcaaattcgaacgttgaagccaaaagtgagctgcacaaaaaaggatgagtcatgcggatgccattggcaaataaaggcaacatttatatgaaatattaaaaataaaattaaaaaaacgaaaacaaacaaataaaattaatattaatattataaaattaatttaaagaaaaaaaacatatttacagccacaagatggcaaaaaggtgatcatcaaattgaaatggctgcatgaaaaggtgctcacctgtgatgacccttgcggcacttatcgagtcgaaataaaataccgaaaagacaaaagggcgcggggtaatttaatttaattaaataataattatttaaattttgtaaaggtgcatttatttgctgttctgcccaaattgaagaagatgaaacaaagaattggattgaggcgggtgcacccggcgaggacattctcatttcggcttatcccaatcagactaattttgaacaattgacggaattgttcgaattgacttacgaaacgggtatgggcacgtaataattattattttatgctaattgcttttaaattacttagacggcgccaaaattttgccagcgagcgattgtccggacggtgtgaattggaagccggagagatcacccggacatgttctgatttgcaatcatcccgataccggcaagcttgttgaatgctgcacgaaggggcagaaatgtccattaagggctaactcaacattcagctgtaaactaattgtggtaaaaaccaagaaattattaaatttttgatcaaaaaaagattttagctttggccatactcttttagacagttttggcacactttgggaaaattttataaaaattttgcgaaatttgggtgtggcctagtctcagagagggtatgaataagtaaaacggaaatattgataaaaaattattaagctaaacggtcaataccgcgagatcagaggcgtaaacgaaagcaaaatcttctttttcgaatgttttgtaagtgacattaaataatttaattaattaattgtaaaaaaatacattgtcaattaattaaaaattaattgattgattggttaaatttatttttaaagaggcgagaaggagagatgaaaagcttttggggttattggaaggacaaaagcaaagacccaattcgcattggcgattttcaatgcttgagctacgaagaagccggcatcataaatccgccagacaaaacagtgattgattacccattgcgcttcaaaagtgccaacataaacgaataatgatgccaaagggatgaaccaactgcggagaatggatgtgatgcatagggcgggtgtttttacctatttaaaagttttcctttttataatattttattttttagtgtatttaactttggttttgtatttgtaaatttatttatattgtaa

SEQ ID NO: 64357 - DNA, 178 bp, Heterodera glycines
  Genomic contig location: Contig_ID=SeqID_34612; Location=77..254; Strand=-
  SCN-specific regions: Sequence locations=1-81,104-111,142-178
atggcaaattcatcaaaaatatgcgatagatcaggcccgtatcaaggggtgggggtaagtgttcccgcctcaccccgataattaaaaatcaaaattttaataaactgcaacaatttataaaaaaaattataacataattttcatacagtcatgctcatatgtttacgacagcccataa

SEQ ID NO: 64358 - DNA, 317 bp, Heterodera glycines
  Genomic contig location: Contig_ID=SeqID_34613; Location=457..773; Strand=+
  SCN-specific regions: Sequence locations=1-125,147-190,233-317
atggcggtgttcggctttcatttagtcttgacaatgattgcagcggtaatttttaacaaaacagcgcaatgccactttctctgtgatttgctgttctttaaagggttggctgtcaaattcgttcgtaaatattattattattttttgtttaagtcttggttatttcgtgctagaatcgtctgttttgtcagaattaaatgcctgtgaaagtgaaaacaaacgcagaaggaaaaaagagtaacggatattttttgaaattttcactcgtatttttagtgatttttcaggaaggatttccttcggattggtggcaatga

SEQ ID NO: 64359 - DNA, 186 bp, Heterodera glycines
  Genomic contig location: Contig_ID=SeqID_34613; Location=1..186; Strand=-
  SCN-specific regions: Sequence locations=1-60,82-161,183-186
attttttctttgtgtctctgagcaacaaaatggcaaaaaaaacgaagtcgtaaagatataaatgttctttaaaagatatttatttaagatatttgattgtaaggctcgcgagtgttatttcgggcactaaacaaatttgggttagggagagagcagcagccgaagcggcggccattctttacgacc

SEQ ID NO: 64360 - DNA, 451 bp, Heterodera glycines
  Genomic contig location: Contig_ID=SeqID_34614; Location=216..666; Strand=-
  SCN-specific regions: Sequence locations=1-8,30-286,316-364,387-451
atgacacaaaatgaaaatattttgcatttggattataaccgcttgaaaacatcaaaatcaataaggctacaacggatgaaaatcttagccgggcaacaactaaatgaaaagggaaacaattgggatcagttactgattcatgcattatttgattataacatcgccatacatacggttattgaaacattcaccatttttaaacaatatatttaagacacccaaaattaccagtagaccgattgctaaagttacctaactcagaaaattatgagtcatatatatccatttacacaaaattacattcagaaaaaagcattgaaagcttggaaaatagtgcgtaaagaaatagaaaagggacaagataaatttaaaaaggaaaatgattagtcgaaaagcgagagaaaagacttttaaaattgctgatttacttttcctaaaaagaggtattaaa

SEQ ID NO: 64361 - DNA, 126 bp, Heterodera glycines
  Genomic contig location: Contig_ID=SeqID_34618; Location=309..434; Strand=-
  SCN-specific regions: Sequence locations=1-72,95-126
tcgtagctcggcttctgatcacttccatactactcgttctgagcaacatcatgacttgtccgtcttggtcttagaaaaaattataaaaattggattattcaattctaccaaggtagcaacaggctg

SEQ ID NO: 64362 - DNA, 434 bp, Heterodera glycines
  Genomic contig location: Contig_ID=SeqID_34620; Location=229..662; Strand=-
  SCN-specific regions: Sequence locations=1-374,396-434
cccctgacagcatgtgctcgaactccccgtttttaggagagtaagagaggtagttaatccgtgtttaatcaattatgaaattcaaaaataaacaaaaaaaaatatttcaaaaaacagttattcacaggacctaataaattcaagacttatgtcagtttttataatcttgaacaacaatgaaaactgcatgatttaacgaaaggcaaattaataattattagggtgcaaatttttaccgacaaagaattcataaaaaggggcctaaatagggacgaaaaatgacaaaagcaacatataaataatttgttttttttgccaattatttcattttcattgttgaaaacctaagaatcctaaaaatttatgaattaaaaaaggaaaatatgatgaatggttaaatgatatttgcggtcggataattgtggcctgctgga

SEQ ID NO: 64363 - DNA, 682 bp, Heterodera glycines
  Genomic contig location: Contig_ID=SeqID_34621; Location=190..871; Strand=+
  SCN-specific regions: Sequence locations=1-344,368-682
  Gene Ontology: Mol. function=apoptosis inhibitor activity; Cellular component=cytoplasm; Biological process=chromatin modification
atggagaaaatcattggcgcctatcagccttcggtcattgtgcttcaatgcggtgcggactcactgacaggcgatcgtttgggctgttttaacctcacattgaaaggtattcgacagtaaaatccctgaattgctttttgctttaggacatggaaaatgtgtggagtacatgaagaaatttgacctgcctgtgttaatgctcggcggtggcggttacaccattagaaatgtcgcgcggtgttggacctacgaaactgcggttgcattggatactgaaatttcaaatggtaaattttccgtttggtaatttgagcattttctcatttatagaattgccttacaacgattactttgagtattatggacccgactttaaattgcatatcaatccgtccaatatgcccaatcacaacaatttggaatacttggataaagtgaagtgagttactatctgtaaacttacgttttaaagcatttattgtcccaagggaaagaatattcgaatcattgcgccaaattccgcatgcccccggtgttcagatgcattgtctgtttttgaacacttcgtttgaatctgattttgatttcagcacctgagcccgatgcaatggttatggatgaagaggcgcaattggacgaggctaatcccgacgaacgtatcccgggtaaaaaagaaaaatga

SEQ ID NO: 64364 - DNA, 4026 bp, Heterodera glycines
  Genomic contig location: Contig_ID=SeqID_930; Location=1796..5821; Strand=+
  SCN-specific regions: Sequence locations=1-1004,1026-1187,1209 -1894,1917-3381,3404-4026
atggctctctttagagcccgcagtgacaagacgccgacccacgccgggataccagcccctgatgaggtccgagagggagggtgcggccaaaaccgaaccaatcccgcggccccccgtggtaaggcggcagcgattcaaaggcaaaacggcataactattcctataaaagcctgcgctcaatccggcctagtccggacccagagggttcagcagtggtcagccgtggaggagtccgccttaaaagatgtggtggtgcgaaacacagacgaccgggggctcattaattgggccaaaggtgtgctccctgaatggcaaagattgtgccagctcaacccgaccatgtacatggctcgatcgtctccatcgctgtccaataagtgggcatctctgcggcggacccatgttggtcctggatgcccttcgaaagaaggctccgggccctcacaagacctttcagatgtaaaaatccaaccagccaggttggcccatgatacggtagccgagctacctcaacgtactgtcccttgcggcacagacggtcatggtgtaatcgattccgatgagatcgagattgccttagcagaggtatcccggtcgagtccctttgaagaacgcgagccgttcgacttaggggcgacagagaggatcacgcgtaagcggctgcgcaacgccgttcgcgatgtggttccacctcggaaacgcagggttccatccaccccttcacgtaaggaacaagatttggttccagaggtggacgggcctgcacctacggatgtgttgacacacccacccacagaatccgaaccagaaccgatgcttgacccactctcacttgtccaactggtaaggccgcaattaggccgggcaatgggatgggcagccgaggagatggaactcgggaatgtcgtgatggacgtggagctgaagagggagttcaaccgggaggtgaggcgtgtcggaagaacgcctcccgaccaaatgtataagcgtggcgcaggtccaccactcccacagaaacgagagcccgaacgagtagccctacttgagcaactcattgcggcgcgcgtggaacgtggcatcaacaggggacttgattggttccttgaactgaatgtcgcggtctttgcagccactagggttctgagccgccgggagagagtggaaactcttgctgatcggctgcacatcaacgattctgccactctgtccgaagtatccagacggcgagctaaagctgaaaggaaactccggtgtgcacgggaacaaccatggatgagcaggcggatcaggaaacttggtgtgagggtcgagagactcaaacaactagctgacctggtccggcaaagaatagctgggagaggtaatagatcgtcttacgaaggccctaggcggagattccgactaagaccctctttacgttctgttactgaagcacctgtcaatccaccccttaacgggaatgaagtttacacgttctggcacagcctttgggcgcagagcctccgtgctaacacggatgactgtcaattgaggaaattcaaaaaccagctttctgctgcgcgacacacggatctgacgagcgtcggaaccagctcattggttcagatgttcagcgcggcccttcggaaaatgaagaagggcaaagctcccggtcctgatggtatccgtgccgcgtggtggggagtgttccggcgaattgcaccgtatgtggctacgtgggtggtccgagtaatacgtggggcagaaccagtagctaactggatttgcaacgggctcactgtcctactgcccaagagtagtgacaatgccgaccctagtaattaccggccaattacatgcctaaatacctgctacaaactcttcactgccgttatcgcacaaataaccgcaagttacgttgatgttcttggtggcctacctagacaacaagtagcactgcgaaaaggcgtttggggcacctctgtgtccctgatgatcgatgcgctaacggtggctgacgcgagaaaagctaaacgcccacttggagtctgctggttcgacttcaagaaagcgtttgactcagtaccgcacaacttaattcgctggatcctgagagtcatcggactccccccggtcatcttgtctgtcattgtctctgtgatggatcaatgggcaacgaggctcaagataggtggaaaggtcatgcccaagaccatcccggtgcgaaccggcgtattccaaggggacaccctatcgcccctgctgttctgcctatcggtgtggccaatatcgttcgccctagaccaatttcctcagtatcagtttcgttgtgcaaaccatcttcagcagggctttagtgtcggacacgtgttttacatggacgacctgaaatgctattgcccagacagggaagtgttgacagcagttattcagcaggtgcagaagagcgcttctgccctcggtctgacgatccactacaagaaatctgcgtggctcgaccaggacggcgggaaaagtggcaaagccgtcttgggtgtaccagtacttgtcggcacttacaagtacctgggaatgcacgagagattcatgattgtaagcaaagacagtcttgagtcagtcaggggaaagttcatggggcggcttaaaaccctgtggacctcgaaactgacattcggacaggcaatgcttggcacaaagagcatctgcatgccagtcgtgcgctacgtgctgcagaatctattcctaccaaaatcggaattcaaccagacccgtctggtcctgagagagtgggatcgtcagatcagagacctactggatgaatgtaatatccggcaggttttccgaagcaagacggagttatatgtcagccgcgaagagggtggctggggtcttcctagcatggaagacgccctcgaggaagaggtagtcacaaaacttgccatacttgttgcaagacaagaaactgagccgttgttccgggtgtgtgaagctcttgaaaggaaaaggtgccccacccccctgtccctaggattgcaaatactgaaggactggggagttggggtagagttacagggccgcacattgctgctgaacgggaacacagtgggcccatctcaggcaaccagaaaactcactggagaactggtcctgaggagggaagcggaacggctcagtagatggagaagtaaagtgaaacctggctgtggcatgactggaggggcatggcgggatgtgcccggaatcgatgtccatcttagcaataggtggctcgtcaaaggtgcactgtctccgaccgttgtctcaaacagccttgccatacgagcaaacacggtgattctgagagggagtggcgggggctacaccaaaggtaccctcctccggtgcagaggatgtggtaacacgggagaaacacgcagacacattgtgtcagcatgctccctgggaaggcagaagggggctgcctcccgcaggcacgacaacgtctgcaggatattggtgcgagccatctgccacaaactcaacattgaaccgcccaactcagccaacttcccccatgtcgttgtgctggaaggcagtggtgctaagatgtggatagactttcccttcgtggtgccacataagatccgccacacacgacctgacatcgtcgtcttgtttgagtggaacggggtcagacgtcttagtgtcatcgaagtggctgttagcgatgtggcaaatatgcaaacacaacacatccgcaaatcccacagatatggcaccaactcgactgaacccttcgtcgcgggggtcacgcctacgtataggaatgactgcctggcagcgcagttgcgagcgaaatttaaagcccagcaagttgatgtgatcccgatcattgtcgggaccactggtgaaacattggatggcgagtttgggcggatccgaaagggtttgcctatgctcactaaactgcagatgccaaggctgtggtcagaaatccagcgggcggtgatcctcggatcatatcgaattttggttgaacatcttgcgctaccaaaggggggcgcttga

SEQ ID NO: 64365 - DNA, 832 bp, Heterodera glycines
  Genomic contig location: Contig_ID=SeqID_930; Location=1..832; Strand=+
  SCN-specific regions: Sequence locations=1-340,384-392,425-641,669 -705,735-748,812-832
cggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacga

SEQ ID NO: 64366 - DNA, 1885 bp, Heterodera glycines
  Genomic contig location: Contig_ID=SeqID_930; Location=36..1920; Strand=-
  SCN-specific regions: Sequence locations=1-856,878-1109,1173 -1186,1216-1252,1280-1496,1529-1537,1581-1885
gccttaccacggggggccgcgggattggttcggttttggccgcaccctccctctcggacctcatcaggggctggtatcccggcgtgggtcggcgtcttgtcactgcgggctctaaagagagccatttgggttaaggtttctctttccaaatcacaggatatcatttcgcttttgatcgcttttcaaatgtattggttagaccgtatacaagtgattttgcgccaccccagctccaagggtggcgcgccaagctagtaaggccagccccagctcaaagggtcgtaccccaagctagcaaggccggccccagctcaaggtggtaccccaagctagcaaggtaaaaagagtggtgatcctccactcctgcgatcagcgagggaggagttgcacaggctccatcctgcgcgcagtgcaagactctggcttcaagaatccacacgtgggagacacacgcatggtcgcaaggtccttcatagccggagcctttacggccctttctcgtgccctgcttactagcatattactctatgctacctgttagcaagcaggttggtacactcggccatccgaaccccacttgctcacagttctgaaaccaacaacgcagcctttgcctacgagggctagggctttcggtgcgtgtgggattatacgagactgtcgtgttccctaaccagtgcgagccaacaccagaaaggggcctggacttaggttcgagttacagggtgaggctggagtctccatggccattccccttcgggctcgctatgacagcttcggcgtggtgcagcggggtaacacacggatgcccccgagctcactccgaagtgagtctgtccgtgccattcggcccgaccttttttaggtttcacgaaataccgccctgtaatctttcgccatatccgggaagaactgtcaggctcaacagaaatactggacccgcggctaagaaggcccagacgtttttggccgatgggaaggtaacccagcgccctcggattagcgcaacccgtgcagcacctagggactttcgcgacctgtaggccaactcctaacaggctccccggaggttccgagtatcgccacactcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 64367 - DNA, 477 bp, Heterodera glycines
  Genomic contig location: Contig_ID=SeqID_930; Location=2419..2895; Strand=-
  SCN-specific regions: Sequence locations=1-75,97-477
aaccaatcaagtcccctgttgatgccacgttccacgcgcgccgcaatgagttgctcaagtagggctactcgttcgggctctcgtttctgtgggagtggtggacctgcgccacgcttatacatttggtcgggaggcgttcttccgacacgcctcacctcccggttgaactccctcttcagctccacgtccatcacgacattcccgagttccatctcctcggctgcccatcccattgcccggcctaattgcggccttaccagttggacaagtgagagtgggtcaagcatcggttctggttcggattctgtgggtgggtgtgtcaacacatccgtaggtgcaggcccgtccacctctggaaccaaatcttgttccttacgtgaaggggtggatggaaccctgcgtttccgaggtggaaccacatcgcgaacggcgttgcgcagccgcttacgcgtgatcctctctgtcgcccctaagtcg

SEQ ID NO: 64368 - DNA, 384 bp, Heterodera glycines
  Genomic contig location: Contig_ID=SeqID_931; Location=663..1046; Strand=+
  SCN-specific regions: Sequence locations=1-26,104-104,161-192,216-329
aggtcttgcgcaacaaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaa

SEQ ID NO: 64369 - DNA, 240 bp, Heterodera glycines
  Genomic contig location: Contig_ID=SeqID_931; Location=700..939; Strand=-
  SCN-specific regions: Sequence locations=1-62,86-117,174-174
accaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 64370 - DNA, 296 bp, Heterodera glycines
  Genomic contig location: Contig_ID=SeqID_7290; Location=2975..3270; Strand=-
  SCN-specific regions: Sequence locations=1-92,136-143,193-296
atgtgccaaggtcagcagaaagacgattcgccaagaaacaaagcaacggatatattggagaagagaaaatgaaggcggaaggaaagggttaaaatttgaaaataatttgaaaataatttgtttgaaacagcttttaaagcatcatttaattaaaaaatattttttttggtataaataaataaaataatatttcagcagggcataaaaacaaattattaggacgacttatggttgagagacaaatttgataagattcatggacagaaaagctgaagaaaatgaaggcagaaaataaa

SEQ ID NO: 64371 - DNA, 1060 bp, Heterodera glycines
  Genomic contig location: Contig_ID=SeqID_34626; Location=25..1084; Strand=-
  SCN-specific regions: Sequence locations=1-165,187-246,268-470,493 -562,585-671,693-1060
gtccaaatgttgcaccatatctgggcctcaataaccaatccaaactacaggagaccgatgaaccccggaaaataattattcctgggaaaagacttgaagagaaaactcctgatccggaatcggataatgatacaataaatgagttaactccggagccccaaacaacatccacactcaaaacacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattataatttaaaatctccggcaagtttcgctgggattcaaaaaattttaattgaggcgaaaaagattgacccgaaaattacgaccgatgacgtaaataaattcctagaaaaacagagaacatacacgattcacaagcccataaggaaaagattcccgagactgaagacaataccgagtggcttccacaccgattggcagtgtgatttatgcatttttgatcagctgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtc

SEQ ID NO: 64372 - DNA, 743 bp, Heterodera glycines
  Genomic contig location: Contig_ID=SeqID_7292; Location=517..1259; Strand=-
  SCN-specific regions: Sequence locations=1-276,339-377,411-411,468 -523,577-743
atgtggggcattgaatcgcgatacatttcggaagatgcattggccacggaatggtaagaaataatggtgctcgagagtctcgatcttgatttgagaaaagttctctgcttttttggtctcggtctcgggaaatttgcggtctccaatatcactagtaaggaatttggtggttaatcgagagtctcggttcttaatttgagaaatttctcatttttatagtggagacttagtctgaaaataggaatgaaatttgacaaatcaagagtctcggttcacattaaattttacaaaaaatattaaaaatcctattttatcttacatattatttttttttaaaagtttgttgaaaaaggcaaaaatcctcaggtttgttatctaaaattgaaatgaaaaatttttgaaggaaaaaccaataaaaatgaattttaataataacttttttgaaataattataaaaaatttttataggcaatttgaccaagacgacaaaaatgggagaatggaagaaaaataaacaaagatgaattataactattattttattcttttaaaaataatgttttttattgttattttgtcaaatgaagttattaaaaatcgaaattgaccaaattaaatggagttattggcattttttgtttcccgatgaaatttttttgaaacttacaattagcaggctaatgagcttaccttgacttataaacttttgaattatcccaagttgttagtttgaacgaaataaa

SEQ ID NO: 64373 - DNA, 508 bp, Heterodera glycines
  Genomic contig location: Contig_ID=SeqID_7293; Location=134..641; Strand=+
  SCN-specific regions: Sequence locations=1-90,118-214,239-508
atgtgtgatccctggcactgcggtgttggggcgcaacatagtcccgtctcgatcgcatgcgatggggcggagacagagcgtatgctcggagtcccgaaagatggtgaactattcctgagcaggatgaagccggaggaaactcttgtggaagtccgaagcgattgtgccgtgcaaatctgttgtctgacttgggtataggtacgaaagactaatggaaccatctagtaactggttcccttcgtagtttcccccagaatagctggagctagttacacagttatactcggtaaaaagcatgaatagaggaataaggataaaaaatatccttaacctattctccaattttaaatgggtatgtatccagggtatctttactatgattcctggcgttaaaagaaagaaccgcgataccgtagcaaaattttcaacctatacctaaaaaccgttaaggggggcaccggcggtggccaggtttttaacagatttttaccaaaaatttataaccaaa

SEQ ID NO: 64374 - DNA, 1194 bp, Heterodera glycines
  Genomic contig location: Contig_ID=SeqID_7293; Location=1193..2386; Strand=-
  SCN-specific regions: Sequence locations=1-174,316-334,364-605,628 -673,695-846,870-1194
  Gene Ontology: Biological process=reproduction
atgattgagttgaactttttcggcattgatgtcgacttggccctcgtgttaatccctaacatcgaagccatccctgacgaacctttggatgcaactgacgtcaaatcaatgatggaaattatggcattttcattaaatccgcacgaagggatgctcaaatcgctttccggtgagaaaaaataaaaaatttaaactaaaaataaatataaagatttaattatagcgatcattaaaagaattgtatctatattaattttcaaataatttcaaatatatataactaaataatttcaaaattgatattttaattttttagcgaacttttgagcaagcaaataatttttaaaattggagataattcaaattagtttcataatttaatttggcattttcagggtatttggcaaatattcaaattttggaattgatgaggaccaaaagcaacatgaaaaaatttcgaatggtgctgcggagtctcaaattttgggcaaaaagttttccgattatttgataaaattaaaaattgaatcgaattacaggtaattatatttatggcaactttgtcggctttttcaacggtgccgcgctttctattttggcggcaaaaattattttatggtatccaaatggttctgtgccatttatgtttgaaaaattgatgttcattctgatgaataggtgatttttaaataaaaaagacatgatcaaatatgttgctgttaacaaaaatgaagtaaaaattgccaaaaaatcactaaatccataaattaatggcattttaaaattttaatggaaaaacaaataaaatcatttacaaataattttttttcattgtttgtcattttaattcattttctttttaaaacttcctaatcatgcaataaaattctcgataaattgaattttatagaattttacgaaaaaatttcatatgctaaataaaaataaggcgtaatgccaataatcatactcaaatttctaaggaaatggccaatgccaattcaattgactgaagaattggaaaataacggatttgaatcgatgagttggaattcatcagataaatcaacggcactactaatgccaataatcacgccaagctgtttgacccaaaatgcttcacaaagtgtcaataaatcaacgttcaggataatacaaaacacgatcagagagagtaataataatacattttaa

SEQ ID NO: 64375 - DNA, 3802 bp, Heterodera glycines
  Genomic contig location: Contig_ID=SeqID_7293; Location=2713..6514; Strand=-
  SCN-specific regions: Sequence locations=1-660,682-834,856-1191,1213 -1254,1278-1711,1739-2208,2231-2394,2416-2464,2494-2928,2950 -2983,3031-3280,3313-3386,3408-3439,3496-3725,3769-3802
gatttgatgcaaatgaggaggccaaagaacgattaataaatttcatacaatttgaattgatcgaggattttatgacaattttgtattcaactgatcagaaagattttgatgaaaaaaacaaaaaattaaaagataaattggaaagagaagaagatgaaaagaagcaacgtgaagctgatttagctgatcagaacatggaacaactgattggagaggaggagagagtgaagaaattggggcaacagatggcagcgagacagacagagaagcggaaaaggaggctagagagtgaacaaaagagaaagttggagcggcagagacgcagactgttggtgccatcgtcacacggcacaataattgaccaatgcaacgatgaagcgctctttgataccccgtccaggtgcaaaccgttgtgccacttttagaccacgtttagccacagggatcttaggcctccaaatttggcgcttggggctgattacccaatattttgctcacgtgagttttaataacgagaatttcagactagaggccttttaggcttccaaatttgctttggggcaatttatcccatattttggtcacgacttatttaggcccaaaaatttcaacctttgatcaaatggtttccaaatttgcctcggcactgcttaaaccacatttttctcctttattaatccttttattttccggctcccgctctcaaaataatgataattaaaatccgtgttgcaggtacgacgaaagtccaaacctgagtccatcaagacactccgacagtccatcatggaacagcagcgagaatatgctgtttagccccttgaggcacaaagtttctaatagtttgaaaatttcgactagtaattcgccgcgtaattggagtaactcagtgcaaagtcctgtcagcaatgagaaatggcagaacagaatattggccgatgaatttcgaacagaattgtccaatttgccaagtgaattgtgccaattttgtagcaatactcaggatgggaagagggcccctcattttttcaaaaaataattgaactagaaattttggcactatttttcataaatgttgatcattgatcacaatcaataatttctttcatctaaattcatacataatagccaaatgattttgccaatttgcatcaattattcagataatgagctcccctatccataaattttggccaatatttaaaatggacgaaaaaatgtttgattcaaatagcgatcgtaaatattacgaaaatatatttaaaacttgaaaatttgagaagtcaaaattattaaaagtattgacccttcccattctgcgttttcacatattatttaaagaattaaaattggttttttagagttcatttccgatgaatttttacattttgcttatgcccaattccttacaaatcccacggaaatgcagcgtcggattttggacattggcatttttgtgaacgaaattttgcatcggacaaaaattgttgcaaaaatcaacaaaattctggcaattaaaagggcaaatgaggaagaacgatttaaattcaaacaattaaatgaaatggacacatcattgttcctggaggaacgactcaatgagaccaaaattttggcgattaaaacggagggtgattttgaaaaatttgcgcaccttttgtacggcattttgaagcgaattatttttgaaatggaaggcaaaaaaattgacataaaattggatgaggaggatgaggagatgaaaatggtcaggaaacaattgcaccggaacaaattagcacaagcaattgaaattggcacgccccacgggccaaaaagcgtaaaaagcatttggcaaagtatggataagaaactgcaaggcaaaatgttggcccaaatcactgggacaagcaaacagaacttggccgatcgattcattgagtattatttgaacgggtggagagcattgggcgagcagcagcgaattggtaagttgtgtcaaaatttttggcaattaattagcagtcaactgaaaaattgttggcataaagagaacagtactgagttctagaaacccaaaactgaaaatcccatatgttcgggaatatatcccaatatgctgaggaatgaaaccccaaatctcttatagcagagacaaaaagcgattcttatttgtaagattcattatcgatccatctccctaatattttgaatattttggcaacaattaaaaattacaaacaattattaaggcgtttttttttggcacaaaaaatcgcgaaataggcacctaaaaaggcagaaaaaaatcgcaaataggcattaaataggcacaaaaatccccgaataggcacaaacaggcaaataaaatgtttttattaacgcgtttttgttgaaaaacccataaaaattaatcaaaaaacttaattttggttatatttcaattgttttacagtttttttcgaacacagacagtttttaaaccaaaaattttatcaaaaaaaaaaaaattttggggatcaatttttgaaacttccaaaataggcaaagttaggcattataaaaatcatcgtagaagcttcaaacgaagtggaaaacgcgtgtttcgtgcttatttgagcgtattaagtgcgcagaaattttaggcatttgcctaaaaaacgaagccctaacaattatatcacgaaaaaaatcttggttcattcgaacttgactagaccaaactggccctgcctcggtaagatttatgacggacagtcggtgataggaatatcgttttggacgaaaatttccgacgaaatttgtcacggatggctgaacaattccaatataaaacagtaaaataatttctcaacatttttattaagacagaaaattgtataaagaatatgaaggcaaatttatggataaatgtaaaacaaatctgggcacaaatttcccacaaaatacacagcaaatttattttaaaagttctgaagaagaaaagcatgaagaatttgtaaactttttaaatttattttattttaaattaataaaaaaaaatgttattatgaagctggtcaatcttctgcgtgaaaatgggttccatgaagcgcagccaaccgaatcaatatccgcattgaatacactgaaatctctcatttcggcatgggttagtcgctcatattgctaattatctacttaactgattttctggtgagcagtacagtaaaacgtgttaattactgtaacagtaaagtttttaccgatcgggaagatcttgaaaaaccttaaaatttcaattttctttttttttgggaagctagaagtgaactaaaagaatgccaagaaaaggaatatctattgttagcctgaatttagccctaggtattaatcgaaaaattttcgaatttgtctttaatattaaaaggaaaataaataacatttttgctgaaatttttatcctgtagattaattaaaaatatttattttcaaatttttaaatttttgtctttttctttttttttattcctatttaatccctcctaattagtccaacgacaatgcgcgagtgttggagacgggttcccagttgttaggcgcacggacaacaaacgcggacattgacataatttgcgtaatgcgacaaacattagtaacccaaaaggaggaaatggacacattttttggcaaaaattattgcaatttaaacgaaagaatttgcgatgacaattcgttgtactgcctgttgtgcaaggcattatcgcttaattaatcaataattaattagttaatttaattgaaataatttttaaatgcctcgagtttatgtgcattaaataaa

SEQ ID NO: 64376 - DNA, 234 bp, Heterodera glycines
  Genomic contig location: Contig_ID=SeqID_34632; Location=68..301; Strand=+
  SCN-specific regions: Sequence locations=1-234
atgaaagatgaagaggaatatcaaaacaatcgtgttcggcctttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattag

SEQ ID NO: 64377 - DNA, 716 bp, Heterodera glycines
  Genomic contig location: Contig_ID=SeqID_34635; Location=1035..1750; Strand=+
  SCN-specific regions: Sequence locations=1-716
atggaccggaacagcacaaaatacaaagacgccgttgtggccaccggggcactcggaattggagttgcaattgcgactacccaatttggacttttggtcggttctgcagcgaccaatttgctgttggactgtctgatttcgacaaaaaacgccggcaaagatgcgatcaatcgtggcctttccgtggaacagtccatcgagaaacgcatttatgccgccatcgaggcaactcaagaaatagccaaggtttgcattggctcttcccacatttgtcaaacggttttcaaatatttccttcaatttttcccacttccaattagaacccttctgagaagttgactgcccatgcgaattccttccttgacattgcgaattcgctcagcgaaagcattttgggactgccgcgtgctgtggaggaccccgagtgggggctgaaggagcgcgtcacgtttctcgcgtcgcgtatcggtcaccgaatcagctcaaagaccaacgaacgcatcgtggaaccgctgctgcagcagatgtgtgtcctcacagagcagttgtcgaagtgcattgtcctcgtaagttgttggatttgttttattggacaatttttttctaattgggttaaaaattggctaaactttcctgccttttcaggtggactacgccaagcagcgccaggaatggacgttcaacaaagtgagccaattgtcgacatcggtcgttga

SEQ ID NO: 64378 - DNA, 1356 bp, Heterodera glycines
  Genomic contig location: Contig_ID=SeqID_7294; Location=80..1435; Strand=-
  SCN-specific regions: Sequence locations=1-1356
atgctggcggatcaacaaaaaatggtgcaggaccaatcacagcaaattgctcaattgattgcgatccgacaaaacgcaccaaatgcggcggcacagcccaatcaaggagcaaattcagtcccaatattgccggacatttcaccattcgagccaacggacgacaagagccgaatttcggaatggattgagcgcttcaaattcgcgttggattgcacagcaccaacggcggacgacgaagtcaaggtcaaatgtttgatgaataagctgagcgaatcggctttcagcgaatacagcagatcagttctgccgtcgtcggtcacagatttcagttttaaagtgacgaccgaaaagcttgagaagctatttgccaaggctcagtccatattcatcgaccgctacgagtgtttaaaagcggtgagaggagaaggcgaacaattcaggcagttcataaatcggcacagaaaattgctgaccgattttaaattcgatgagctgacaaaagagcaatttaattgcctcatgttattgatggcactcaaagcgcccaacgaagctgcattgcgacagcgaattctgacaaaattgtcagcagatggcgccaacatcagctatgatggagtggtggaagacttaatcagcttccaatccacaatttcagaagcaaaggcaatcgaagcgacaagttcttcgaggccagtgaattcgattcgacaaaattcaaagccaaacaattcaacgaacaaatacgtcaaggaaagtccaaagccaaataatttgccgaacaaattcaaagaaaggaccaacactgaggcaactacaatatgttggcgatgtggcttcggcgtgcatcgacctgacgaatgccgttacaaaacgagcaaatgccgcaagtgtgagtttgtcggccatttggacaaacaatgcgagcgtgtccaagagtggcgcaaacgccaaaatgccaaaaagaaaggaaacaaccgcgttggccaccttcgtattggaatgaccacgcatgccgtcaattccatttcgctgctaaaaacagcggttctgttcaacaagaagccagtcgaattccatctcgacacggggtcggacattgtcgtcattgatcaattgacgcacgaatatgttggacgaccaccgatcgaaaaatgtaacgaaattggcaaggctttcgacggcacaaaaatttcctttattggaaaaggattcggtacattcaaatttggcaaaattgaagtcgagcaaacattttatgttgccaaagcaggctcacttaatttgttgagctgcaaaatgatggacttatttgggcttttagacgaattaaagctaaggataagcaacccaaca

SEQ ID NO: 64379 - DNA, 492 bp, Heterodera glycines
  Genomic contig location: Contig_ID=SeqID_7294; Location=3129..3620; Strand=+
  SCN-specific regions: Sequence locations=1-3,25-317,339-352,376-492
atgaaattttatttgcttatttttgttcctattcgagaatttagtggctatttaatgcctatttcgtggtttttctgactaaaaaagaatccctaatcataatatttgatacagaattaataactcctgcaaatacaattattagttgattaataaagaaaaaatgagtattatgtagagtagagcgggaccgggaccaaaacacggacaactgagtacaactgagtaccgaggtcccggttttgaccagttttgaccgggaccgggaaattcccgtggtcccggactaatactcccggatattccacctttaaggacccctttccaggcagggccagactttgccgggtctaatgcaaacaaacagctgcacttcttaaaaattgactcgacaaattatagggactgtaaaagctgtgaaatttttatgaaagatatccttcatagatcgcgcaattttctattttgactcctataatacttacaaataca

SEQ ID NO: 64380 - DNA, 416 bp, Heterodera glycines
  Genomic contig location: Contig_ID=SeqID_7295; Location=338..753; Strand=+
  SCN-specific regions: Sequence locations=1-3,25-416
atgaaattttatttgcttatttttgttcctattcgagaatttagtggctatttaatgcctatttcgtggtttttctgactaaaaaagaatccctaatcataatatttgatacagaattaataactcctgcaaatacaattattagttgattaataaataaaaaatgagtattatggtccataaatgaaattttaaattttccaaaaattctattaatatggatatatattttttattgcatctgatttttttaaataaataccaatattattaattttcatccttgaatttttatgattttttgcggaccatgccaaaaactgacattcgcgcgctactttttggcgaatttaaaaaaaaaatcgattcaatgtacaaaattttagccttattattaaataaaaaatgaactcaca

SEQ ID NO: 64381 - DNA, 712 bp, Heterodera glycines
  Genomic contig location: Contig_ID=SeqID_34642; Location=448..1159; Strand=-
  SCN-specific regions: Sequence locations=1-245,270-532,596-651
atgacaaatacgcggaaagagtcaaaggcaatgaatggccacgggcgaactcaaaaaagcaaaggacgaccgacgggggaggagaagaagcagggacaagcgattgatcagcagaagagtcagtggaccgaccgatcagcatcaactgactgatcattttcatcatccagctgttgttgcccccggccgactgctgctgacacgttcgccccaaaaaagagaaagaactgatcaaagttattttaaaaagttaaaagttccaaaataaatgtttcatcgtgaaatgccaacaattctgatttccaagtaatttgctaactaaaaataatgtgtgtattaattaattttatttcgaaatttttgttttgtgcttctttcagtaataaaatcggctttatttcagtttacacgtctaattactaattattcttttatgctccaatccaacaaaattaatttttgattataacatttatccaaaagttgaaccttcacatatgtatttgttccttgaaaactatttactaaattcaatttaatatttataaatttaggttgccttccgttaaatattttattttcaatttattattaacctattttgttggataaatttaaaaaaaatcattggatcaaaactggaatagagccaaaaaaatcatttaatttattcttaaattttaatttttgtaagattttgtaaaaaaataaa

SEQ ID NO: 64382 - DNA, 327 bp, Heterodera glycines
  Genomic contig location: Contig_ID=SeqID_34649; Location=1..327; Strand=-
  SCN-specific regions: Sequence locations=1-1,24-160,190-327
aaaatctataaaaaatttaaaaatgagaattcatgcgagattttctggaaataagcttaatatggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacat

SEQ ID NO: 64383 - DNA, 3372 bp, Heterodera glycines
  Genomic contig location: Contig_ID=SeqID_7296; Location=1942..5313; Strand=+
  SCN-specific regions: Sequence locations=1-163,185-214,243-260,282 -392,414-421,497-524,548-905,934-1079,1101-1648,1675-1738,1772 -1791,1818-2100,2122-2382,2404-2414,2440-3102,3124-3245,3267-3372
atgactccagatgaaaattatggtaaatattgatcatagtcgccaaactcaatatggtttaaaaactgtctgaatcgatgttaaatgcttagaaatgtgcaggaaaaactgttatgcaaaaccaatttaaaaaatataccagagttgtataaaaaaatagacattttaaatctatgaaaaatttgtctatttctaattcttcactcggcgccggatttttttaatttaacatttaaaattttgtctttaacagactaagtttaaatttcttataaaaattaagttcataaacaagcgttgtataataccggttcataaatattagtttcgaatttattcctgtggcgccgagcattcgtaatcagaccgggaagagaaggattttatacatttttgttttcactaaaaaatattttcactcttttaattaaataattcgaatatatataataaataataattttcttaatttacaaatttaaaaaatagtaaaatagcttaaaacgctccatcttggaagtgaccttaatgattatagttttgttttgaagagcacaaaattgctaactaattgctaaacaatgaacaaataaattaattatcgacaacattgaattaataatgaatgaatcatttattcttaaatttactgtaaatcatgtgctaatgcacaagagtaaacaaaaatgctagtggcgtaagtttccatccatttgtatttacatctatatatatacatataattgtactatttaggggaacacttggcaatggcgtcagccggcaaaaagcacacattccttctcggacacaagcggttcagctcaagaacctacatggaggagcatgccgtttccgctgcgtcagcatgggaggttcatggtaaatagtgctagtgtttattgttttaattaattttgtttttaaaaaattgtaggtgaggtgtacgaggctgttcgccttgtgaaggaaaatttcacggaacaatcaactcgctggatgtgctttgcatgccagcgaaccgaccacacattccaccggtgtccgaacaaggtcttcgttcataattttttcaatattagctaatttttcctttaaaacaggcgattctggacgaatttaaaaaattcgttcacgaattcccacaggaccagcagaagtttcggctggtcctgtcggacaagattgccatggatggcaaaatgctctgcgaattagttccggggttcggtcagtttttttttcttgttttatttctcatttaaatttggcgatttttaggcgggaagatcgtgcgccgacgtgaacaagaggcggccgcaaaattgcgtcagcaagaagcggatgctgcgaaggagaaactgcgtcagcaacagcagcgggagcaccttcgctccttgggggttggttttgcctcacttaatgaaagaatttcttacagctggtagagataattctgtcagctgtaaagtatacttacatgtgcaatgtttttaaattttttttacagcgaatgcccgcagctctgctcacgttggaaacgggccattccatcgatcaccttgacgcaaagagcaacatcgtgaggatgttgatcgagctggctgaggaggaggaggaggagaaaacccaccattattttttttttgtttcattatttcattttattttgttcacctcccacggctgtcccccttgggacgggtggaggggtggtggccggcgggcggccgaatgttgagaaactttttaaaaatttcgatgcccaggcgcctcaatagcgaggcgtctctaacccaaacggccctctttagggctgtgagattgcaagagttaaatctgcccgccggccacaacctgatcattcactcatatatttgttttccctttgctttagccatagctaggagataggcaagtgtaagcatgcaaatcactgtttggcatatgtgttttaccatatgtttacaatgcttacactagcctgtctccagctaaagacccctgccgtttttccctcacttcgttgaggttttttacccggcgggtcttcttctcacccccacttcatcatttatttgttttttgttgtgtcaacaataaatttatttgtaaattagcttgcatgaattttttaaagtttcgaaaaactaatttttatatgacttttttgtacacaacgtagttttgggaacccttcaagcgatcttgaaggggctctctctcgaatgccaagcatacaccaaggcttggaaacgatcatacgagatcgcttccgtggccagcaaaagatgtccgtcggctggctcatgtgtcggtgacttttgcacaaaagtccgaccctccacagccatccgagagctcagggaaaccgaaacgttccccgggaacagtttctgcatcgacagcacggcattttggggaaaccaatgtctcctagcagccagttcatgtctcttctacaagtggtttgcaaaaccacgctcataagccatttacgaagtcatcggatgcaactcttgggagtttggcatccatattcaacttcgcctcgactctaccgctggaagaagtgcgacagtcgaaactgtgcttcttccaggccgtgtgctcaaatggcacaacatcagcatttcaacaataggagtgagccaagcaccggctcccctactgaacgctgacttcctgattgaagggcgaaatgtcgcccttgtccgtgagaaaatcacggactctttccattgtacagacttgaaagccgcccaagctttcaattgtactctgggaattgacgcatgcacgggctgtcttcccgatcacacagacgggacagtctcgtgccattgtcgcgtcgccaatctcgagggtctaatggaagaccctcagcggagacttccgctctcattccgccattacgaactgcggaatcacggaaggcgaatattcgccataaccggatatagtccggtccaaatgaacattcaaatggacagccttcaaatgtccttggaaatgcaccagagtttgtgtacaatcacaccaaagcacatctctggctgctacaaatgtgcgacgggagctcagttctcctactcgtgccacactgacattggccaaacattggccgatattcaatgcgaagatggttcgcatttcacgagcaaatgtggcccgaacataacggaccacactgtcgtgctcccattccagcatgccgaaataagcacgacatgccaagtcatgtgcttggctgggagaaccaaattctccttggtgggacaactccattatatcccactccgacaacagtcagaattcggagcccgagtctccgaaagcctcgaagaggccagcaactccaggctgggctga

SEQ ID NO: 64384 - DNA, 475 bp, Heterodera glycines
  Genomic contig location: Contig_ID=SeqID_34653; Location=152..626; Strand=+
  SCN-specific regions: Sequence locations=1-67,89-149,347-368,393-475
ttcgctgtcccgtaccagcagtccgtcacggttttatgaaaaattgacacgcggcgcgtcaattggaggcggcggaggcggcgatttgcgcacactgaagccgttgccgagcacaatgtcctacgacttaaagtgaaaatttaatatgcattttaaaattattattttaatttactttttattttttatattaaaatcgctaatttaatatttaatttgaaatttatttttaaaactttttatgatttattagtttaattaaaaaattatttatttttcttcaccgataaaattgtaaaatattattctttttaaatatatttttattttataaattttaatataactttctctacgatttaaaatcgtataaaataataattaattaaattcatttgcatattaaattttgcagaaatatcatgagaatgaccgagattaaaactgacattggatttgctcgcgcatttgtacg

SEQ ID NO: 64385 - DNA, 1085 bp, Heterodera glycines
  misc_feature (1054)..(1054): n is a, c, g, or t
  misc_feature (1060)..(1061): n is a, c, g, or t
  Genomic contig location: Contig_ID=SeqID_34654; Location=90..1174; Strand=+
  SCN-specific regions: Sequence locations=1-190,213-531,553-643,732 -1085
atgggagcaacatcgtcatcggcagaagtagcacaggcaacaactagttcgagcagtatgctgaggaacaaaaaaaagcaaaatcatagggaaaagcaacaaagcggaaaaagatgaaaaaaaaaacgaactttcaagtgacgacctaaaagcaaagcgggcgcataagcagcagaagaagcaatgggagaggaggaagagcacaggaaaaataagctcactaaaattaaaaccataaaccaaagcataatcatttgctaatgagaaggcctttggggcaatcagtcggaacaatcaaaagaatattaatggctcaatttgtcgcctaattatgaatattcgctttgttttttattatttattttctttcaaatcctttacatcatcttattttttttactttttgttattttttgttttgaagaattgctttaaacattgattaattcgcttttgtgttgtattaataccaacaatttatttaacttactgtaatatttatgtaccgtaacccgcccattttactaccgttttcctttgtctgtttgtgttgtgcgcctaattggtattaaccttttgttcagttgctattgtgaagtcgtgccccgcttctgtttaacataaatgggttcgttcgttttctttaattaattaccaaaattaacattttattatttttaattttaattatattaattattgacaattaactccactaactaattaattaaactatttttaacataaagtaaattgcaattttttctgcttattcattagcatttgcttctgtccgtccgctcgctttacccttttgccaaatattttttttgttttattttccattttttaggtttttccgtttcctccggcggtgcctttggtgcgtgccgtcgaattgccagcgctttcgctgcctcggccgccgccttcgccgagtccaccgccgcccgagccgacgccggtgcccgaattgccggtgccgaaaatggctgaacagctcgaacttgtggtggaagaccgcaccacacgcagccgacactgccaccaattncgaggnncgcagtgatggtaaagtgggaaaa

SEQ ID NO: 64386 - DNA, 312 bp, Heterodera glycines
  Genomic contig location: Contig_ID=SeqID_34654; Location=1..312; Strand=-
  SCN-specific regions: Sequence locations=1-11,34-312
tagtgagcttatttttcctgtgctcttcctcctctcccattgcttcttctgctgcttatgcgcccgctttgcttttaggtcgtcacttgaaagttcgttttttttttcatctttttccgctttgttgcttttccctatgattttgcttttttttgttcctcagcatactgctcgaactagttgttgcctgtgctacttctgccgatgacgatgttgctcccattttccaatttcgttgcggtgttcctggcagttttccgcttcttgtactacttgaattaattgtttccgttgttgtactgcttgaacgcg

SEQ ID NO: 64387 - DNA, 656 bp, Heterodera glycines
  Genomic contig location: Contig_ID=SeqID_34657; Location=10..665; Strand=-
  SCN-specific regions: Sequence locations=1-255,277-417,453-656
aaatcacaacttaatgcggatggccatgaaatttgctacgacgaattgctgggcaacgcaattgatgtgagaacatttaaatattattgtaatttttatgacaagacccatacgccaatcggcaaaaaaggcacataaagtgaaaattttgcattaaaaattcaatatttgtaactttgattctgtttaataggccacaaatgctgatataaatatataaaatccaggtcaatttgttcaatatttgcatacacaaaaatgtttttcaatttttattcattatctataaaacaaagtgatttttaagggatcgtacacttataatccaattcaatcaatttacgacaacgaagacatggccaaatttactcctaccaaaaattacgaaattggtaagttcaaagattttctgatatgattaaaaacatattattttattatcaatattattagttgctaattcatttaacagtctaattaagttgcaaactcacaatttattcaaaaaatttacagattatcttcgttccctcccaccgctggtgaccaatgggcttttcccacttttgaaatatgccgaacatttgctgaaattgacgcatccagaagtgattgagggcatcaaacggcctcatcacttggtgaaagagtttcgg

SEQ ID NO: 64388 - DNA, 147 bp, Heterodera glycines
  misc_feature (64)..(64): n is a, c, g, or t
  misc_feature (80)..(80): n is a, c, g, or t
  Genomic contig location: Contig_ID=SeqID_34658; Location=44..190; Strand=-
  SCN-specific regions: Sequence locations=45-147
atgggcaggacacgccaagtacctcaaacttgggtaattaaaccgaagaaagaagtgcagtggngaagaatgacgcctanaatgaaaggaatattcgatgctgtgcgaactctttgtgacccctctctgactctgccaatgcagcag

SEQ ID NO: 64389 - DNA, 80 bp, Heterodera glycines; identical to SEQ ID NO: 51817
  Genomic contig location: Contig_ID=SeqID_34658; Location=180..259; Strand=+
  SCN-specific regions: Sequence locations=69-80

SEQ ID NO: 64390 - DNA, 126 bp, Heterodera glycines; identical to SEQ ID NO: 54981
  Genomic contig location: Contig_ID=SeqID_34658; Location=646..771; Strand=+
  SCN-specific regions: Sequence locations=1-126

SEQ ID NO: 64391 - DNA, 787 bp, Heterodera glycines
  Genomic contig location: Contig_ID=SeqID_34660; Location=6..792; Strand=-
  SCN-specific regions: Sequence locations=1-299,321-787
  Gene Ontology: Mol. function=protein binding; Cellular component =endocytic vesicle; Biological process=synaptic vesicle endocytosis
gccaattattcgctgtcggacattgtgctgcaaccgtacgacgctttcaccaaaattcacaccgtaaaattgcaacacattctgtacaatgagcgcaatggtattcgctccggtcaaatctcgcacctcgtcgaaggctatttgaccaaatatggccttcctcttgagcacgcggctcacaatcagtgcacagtgctggctaagtttgggtcattgaacgaacggaccatcgccagtttcaccgacgcattagaaaatgtgctgttccattacccgaaaaagcgcgagacggcgccgacctacaaatatgacgaagtgcaggtgaaaaaaagagagaggagaacgatgcgagagtgaaagagcaatagtcgagaatgggtatgctggtcaagagtttacgacggaaaaaattggcactttgaaatgggagggacagagaataattagtcggcaatggacatttagtactttaaatattggcacatttgcattcagattaattgttacgacgagtgcgaggcttcggtggacatagatgacaatgtgagcgatcagcgcgcccgcgttcgtctgttttgcttggcctttctcagaggcacttccttcttggagatcggactgaacgaccggcgccgcgagggaaaagaggtggtgcgacgcaaagacattttgccaatgtacacggagcgatggattcgatttgaagcgcccgaatttcacgagacggtggacaaaggcgtctggggaggaggaccaggtgaagcggagagtcgccatgcgaccgacg

SEQ ID NO: 64392 - DNA, 292 bp, Heterodera glycines
  Genomic contig location: Contig_ID=SeqID_7297; Location=761..1052; Strand=+
  SCN-specific regions: Sequence locations=1-151,173-227,249-292
atggttaaccgaggatgggttccaaacgaaaacatcgaatccgaactgaagaagggcaagcaactgcgggagtccgagctgaaggatttgaacgcggtcgtcagaagtgctgagaaggtgggccaagtgttgcgttatgttaacccaaccatttgtttatcttttgttttttcttagatttagtgtttaaattcagggctctcctttcgtcaaaaacgacccggaaaagggaatttgggccttcaaggatttggaagaaatggcaaggcaaagcgacgccgtcccaattatt

SEQ ID NO: 64393 - DNA, 1057 bp, Heterodera glycines
  Genomic contig location: Contig_ID=SeqID_7298; Location=35..1091; Strand=-
  SCN-specific regions: Sequence locations=1-614,642-827,849-914,939 -1057
atgcccggctccatggacaaataccatcagtatgttccattctcagctcattcgaattgtggagtgaggaatcgcgcacttccttccttagccaagttcgtctttcgaaaaatccttttttattattttttttagtttttggattcctacgatattttggacgtgaattgttcagacttggtgcttaaattatgcgtgagtttaagggaaagtcgcaaaatttttttcgataaaattcagaaaattcgttggcataccgttcctccccaaatgctttcgcaatttactgactttttatgcgctttggccatcaaccatgtccaccatatcaattcagtgttcaattgcttcgtcgaccatttcttgccaattggcaatgcgaaaggtatgaaacaatgtttttaagacgacacacacaatttctttaaatctgcaggttttctagcccattgaaatttgctttccattttcccaactttaagatccttcaaattttgaggcgcatcgtccgccagcggtggtggacgaccatttccaagagtcgctgtacgccttggccaacctttccatccaaaacgttgtctcctgcaaccctttgtccgtcaaatttcacttctttttgatttgttttcctgtttttcaggacgacgcctcttctgctcaaatgttttgtgaaacgctttccgcacatcaaacagccgtctccgaaactgctcgcctttatgcgaaatgtgctccgttttgccgattggattagggacgaggaaatctctgccgaaatttggtcgcttatcgtcgagaaactcctgcacatcgatgtagtaatgtttttcttctcctatttattccgggtcattttaggctttatgttttgagcgggaggaagaagaacaacagccgactaattctaatcgtttgaaacagaaaaaattggacaacgaaaccgccagcgaagaaacaacaaatccgatgagggaaaaactgaacacattggtcgaattcattctcaattatttgggggacgccgaggccagcaaagtgacgcttatcaaagaag

SEQ ID NO: 64394 - DNA, 998 bp, Heterodera glycines
  Genomic contig location: Contig_ID=SeqID_7298; Location=2204..3201; Strand=-
  SCN-specific regions: Sequence locations=1-770,792-899,922-998
gtcgttcatccacggccttttcttctccttcaacaccatcaccaccattgggtccttttttcgaccgttccctcgcgattccttccctttttcagattgggcaatatccgtgtcaccaatcgtggtacttattgtgttcccttcccctcactttgtacttttttactttaccccctccccttttttcagtgtatctcgcggtaattaatcgctccccccgctttttccctcattttccccgtacttcctcaacagttggtcattctctacgtaattatcggacttgcagtgatcacaggtgggcaaagagtgccgtggcactgacagtcggccaattggcgctttctttcccacccttttgattagcttctcttgacttgtgctcctcaaccttgaaaaagaccttcacgaagttgcattactttgggcgtaaaatcagagaaatccatggcatccacggattaaggcaaagcaaaggaagggaaaagcaaaacacaactcaaaagccattttagtagggacatgcgggaagcaatgaagatcatttcagcaatgaaaaagatcaggtgggggagcaaagagacaatggcacttttgaaagaaaaattcactgactttccaatgccatcgcagaggcagcaaagagcgaattacgctggaggaccgtgagttattaacagctaattgattgttttgttaacggcattttgatttagttaaaaggtttttggaggttcaggagcatttgctcaggtagaagcgaactctgaccaaacaaaaaatggcatcactttttgcatcctttttaaggcagccttacgtgccatacgacgtgcacatcttcaaatggatcgaagatgcggtcggcattcccttttcatatgataaatcgcccgattggcattaatttccctttaaatgcttcaaaagcatcgccccccccctccgttcagtacatgcaatactgcttcaacaatgaggagtccgtctccctcggg

SEQ ID NO: 64395 - DNA, 1448 bp, Heterodera glycines
  Genomic contig location: Contig_ID=SeqID_7299; Location=92..1539; Strand=-
  SCN-specific regions: Sequence locations=1-215,237-294,317-533,573 -739,761-921,943-1357,1383-1448
atggagaaaagtggcggagattcggaattagagggaggaagccgaaccgaattggcacaatcagacaaagggattctgttggcattggcattggttttagtggatggcattatggtattagcattggccaatgattgttggcacggaaggattggaattggcatcggttagggaaaactttgactttccttagtgttggatttcctacctcggcagaggtaaataaaagaataaatttgggaattgcccaaaagaggcaaataaacgtgggaaaagcgaaatccaaggagaaggcatttccctttttcacttttaaattagtcggaaatttactcaccaaaaaagaaaaaataaataaataaatacagaaacgccgtctttggcaccaatccgaggagtgaaatggaacgacgagttcagaagaagatacgacgaatttgaggagggaatgagcggagaacaggtgcactaaagggtgggggcaaaacgaaaaaaagacggaaagtgccaaaatttaacggaatttcgcctgacgggaagggccaaaaaatggggggaaggcaaaaaagccctatttgtgccttttttgttgcagtcctccggtgagcacgagacagtactgcagaagacgatgaaggtcagtgagtgccgttcattggcttttcatctcccctggtactcattcgtccccttttcagtacctgaaaattcttttaccgcacggttagcacttcacaagtccattttatgatgccaaaagtgtgtgtgtttaatgccgacttttgcagttgggctcaacattttgctgttcacttacatttcgttgggtgccatcgttttcatctttttggaggcggacaacgaattggagcaacgacggagcaaactgtcccaaattttgcatatttatgaactgataatgaaggaaactgttgctatttgtcgctctgccggtgcgacttccctctccgcactgaacgggtcgatggtcggtgctgggacccaaattaggagagaaatgccgaggctcgccgactaattgatggccatttgttggcaaatggcatgttagaagacgtgctcctccctttgacattgcctcccccgggcgtttcccttttccaatttcacttctcaggtcgaacgtcgaatgcgtccccttctctcagtgctttcccggactcacgaatatgacgaaaggttcacggccgaggcgcaaatgtggagcgattcagagcacactttggccacaaaggtacggtgggaaaagaaaaggaaaacagaaaatttaattttaaaaaatgcctaattttgtacatccaaatgcccaattcgctgaccaatgcccatttttgccgcattttccccatttttccactcattcggactattttagtggactttcgccgcttccagtctctacgcactgactgtgatcacttccacag

SEQ ID NO: 64396 - DNA, 92 bp, Heterodera glycines
  Genomic contig location: Contig_ID=SeqID_34662; Location=470..561; Strand=+
  SCN-specific regions: Sequence locations=1-92
ggattatttttcaaaacacctcgtagactgggggataattggagactgcgggattaatagagactgggctataattagagcatatacggtat

SEQ ID NO: 64397 - DNA, 505 bp, Heterodera glycines
  Genomic contig location: Contig_ID=SeqID_34663; Location=67..571; Strand=-
  SCN-specific regions: Sequence locations=1-31,53-133,155-163,185 -295,317-397,419-427,449-505
cttaaattttttacaaccacttattgccaatctaatttcttgcagattgaaagccatccattgcctgccgatgctcggcacagcaaagcactaatagggtgtttgactgacttcaaaaaataattccttacccaaaagttttttacaaccacttattgcctatctaatttcttgcagattgaaagccatccattgcctgccggttctcggcacagcaaagcactaatagggtgtttgactcacttcaaaaaataattccttacccaaaagttttttacaaccatttattgcctatctaatttcttgcagattgaaagccatccattgcctgccggttctcggcacagcaaagcactaatagggtgtttgactcacttcaaaaaataattccttacccaaaagttttttacaaccacttattgccaatctaatttcttgcagattgaaagccatccattgcctgccggttctcggcacagcaaagcactaatagggtgtttgactc

SEQ ID NO: 64398 - DNA, 349 bp, Heterodera glycines
  Genomic contig location: Contig_ID=SeqID_34664; Location=758..1106; Strand=+
  SCN-specific regions: Sequence locations=1-108,294-349
  Gene Ontology: Mol. function=protein binding; Cellular component =axoneme; Biological process=N-linked glycosylation
atggaaaaaatttggtcaacaattgaaaaaggagaaacatcgaaaacagagaagaaaaatttgacaaaagaaacatcggaagaagtaaaaagtgacgaacgaattgacgaagaaaaaagtgatcagaaaattgaggaagaaaaaagtaaacagaaaatggaagagccaaaaagtgagggggaaaaaagtgatcagaaaattgaaaaagaaaatagtgatcagaaaattgaggaagaaaaaagcaagcagaaaatggaagagccaaaaagtgatcagaaaattgaaaaagaaaatagtgatcagaaaattgaggaagaaaaaagcaagcagaaaatggaagagccaaaaa

SEQ ID NO: 64399 - DNA, 576 bp, Heterodera glycines
  Genomic contig location: Contig_ID=SeqID_34666; Location=182..757; Strand=-
  SCN-specific regions: Sequence locations=1-524,566-576
atgcgcaagactttctttattgatgggataacagaaaagggagcggcattcgtgccagcctacggccgtcttcgccagccgtttaatataaatgtggcggcacatttttatgcccgacaccgtgtgaaactgcatcacccctacattccgtgcattgttgaacgctttgagtgtggggagaaccgtaactacccgatggaactgctcgaaattgtgaaagaaggacaacaaccgatcgggcaatggctgggcaacttgttcaaggagagggatgacattgcagcagctcgtcaaccctgtcggacaaaactttagttttgcgtgatgaagaagacactggacgcgatcaatgtagccagaaatctcctgagttttattggtaaatcaagctaatgttttttttttcgacttatttcactttgtttaaatcatgtttccttcttcacataaatatgacaattttaataatttaaaaagaaaagtggtaaaggttaatgggcgaccgtagctcaaatggtaagagcgcagcactcagtgctgaggctgcaggttcgaatcctgccggtcgttaataaa

SEQ ID NO: 64400 - DNA, 264 bp, Heterodera glycines
  misc_feature (260)..(260): n is a, c, g, or t
  Genomic contig location: Contig_ID=SeqID_34668; Location=1..264; Strand=-
  SCN-specific regions: Sequence locations=1-264
ttgaaaaaaacgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctnatag

SEQ ID NO: 64401 - DNA, 604 bp, Heterodera glycines
  Genomic contig location: Contig_ID=SeqID_34670; Location=152..755; Strand=+
  SCN-specific regions: Sequence locations=1-265,291-465,488-604
atgaattgcgtagcattaagcagaaaaagtattacatttttttgtgaacttctgtcccctccgctacctgtaaaattggatgatttggtaaagagaaagagacaaatcggtgaccaaatggccaaagtgcaaaagtaagtcaggagaaagtccaaagtcggctcggttggtcagaccaatcaaagcggtaaaacaccgcaaagctcagaaaacaacgaccgttttgcacgtcaccccaactcacgtcacaaaactcctcgaaggatattttcccatccccgtccttgtcatggaaaagaatggttttatcggcgatttgctgaagttgagtggagaggtgataaaaaccgcacggttttgggtaattttcaaaaagaatttttaatttcaggatccgaaaaatcatcataaaaaaattcaggattgagaaaataaaaccggcccaaaaggtttgggatcaaaaagatttaaatttgcaaaagaaaaaattgaatttccttcacctgtcacttttggtgacaggtggatgattgatgaccttccgcggcgctgcgcggcgcggagagggggagtgaaaaaaaatcgccagtgcggatttgaggaa

SEQ ID NO: 64402 - DNA, 204 bp, Heterodera glycines
  Genomic contig location: Contig_ID=SeqID_7300; Location=1879..2082; Strand=-
  SCN-specific regions: Sequence locations=1-204
ccactggacgatgaccaacactacaaaacgtttccgtacaacaaagcgactcaacgtgaagccgtccgactaatcaatgaagccaggcgtaaatcaagcagccaagtgaggaaaagtagcaaaccgacggccaacaaaatggacacattactcgagagcaacaaattcattgttgacgaagaaaatgaggaaaaggaagaatga

SEQ ID NO: 64403 - DNA, 1092 bp, Heterodera glycines
  Genomic contig location: Contig_ID=SeqID_7301; Location=1721..2812; Strand=-
  SCN-specific regions: Sequence locations=1-172,194-616,639-827,858 -1092
  Gene Ontology: Mol. function=sodium:hydrogen antiporter activity; Cellular component=integral to membrane; Biological process =embryogenesis and morphogenesis
atgagtgacaatttcactgatgaggtccaatcttcgtctatattcccgtcgttactcaatacttctcaagttccgtccgaatcgttcaacaattcgtcggtccaaaatgtgcatttggcaggtcattcccaccacggacacagagatcgcattgtgttcttcgaaatggtgtcaaatttataaattcaaaaacatgggcataatttaagcacttcgaagagcatcagacgcaacttacgtttgccttttggtttttcataacgattatcgctaaaattggtaacgtaacttgagaattaaacaatttgttttctgcttactttcagctttccatcggtttgaaaaaataaatcgcattttgcccgactcggcacttctgctcgttttgggaagtattttcggtggaattttgcatattatgtttcccgaacgtgtaattgactgaccaatacgatttttctcaatgatcaaaatgttcaggaaatttacctgaaaccggattggttctttctttaccttttgcccccaattgcgcttgaggctggctactttttgcccaacaaagaggcaagttaaggaagtcaacgaaatgttcgaaaaggaatttttatgtatcgtaccaaaaattaatggcggattttagtttttcaaaaatattgggactatcaccacatacgctgtggtcggaactctttggaatattgcagcgaccggtaaactgtcaaaattttggtaatatttggttctcccctcatacgaatcagttgtaacatttggcgtttctttttcgtttcgatattctatgattctccgataataatttcgtcaatttgttttttaatttaaaagtaagcatcaaattcaggtctcactctgtacgccttcaacagtttcttccacggcaacccctcccccatcgctctgtttctgttcgccactctcatctccgcggttgaccccgtggcggtcatttgcgtatttgaggagatccatgtcaaccaattgctgtacatttgtgtgtttggggagtcccttctgaatgatgccgttaccattgtgagaattcgtccctttttctcatttattctctaa

SEQ ID NO: 64404 - DNA, 314 bp, Heterodera glycines
  Genomic contig location: Contig_ID=SeqID_34672; Location=198..511; Strand=-
  SCN-specific regions: Sequence locations=1-314
catttcaatcactgggactcaatccaccaacattccgatcaacgggactcaatccaccagcatttcaatcactgggactcaatccaccaacattccaatcaacgggactcaatccaccagcatttcaatcactgggactcaatccaccaacattccaatcaccgggactcaatccaccagtatttcaatcactgggactcaatccaccaacattccaatcaacgggactcaatccaccagcatttcaatcactgggactcaacccaccagcatttcaatcaacgggactcaatccaccagcattcaatcactga

SEQ ID NO: 64405 - DNA, 677 bp, Heterodera glycines
  Genomic contig location: Contig_ID=SeqID_34673; Location=138..814; Strand=-
  SCN-specific regions: Sequence locations=1-515,538-602,663-677
atggacactgttgatcagagccgtgccatcgacaacttgccgccccgtgccaccggcgatcagtggcaatgcacggcacaatttggaaagaccggtgtgagcatgagcaatgcattgtttctgccgccgttggtcaaaggtgtgtaaacagacgtgaaaatattaaaattaattgtctaatgagttataagtagagaaattggattttaatcgatttttctacacaaaatcaatcgcaagaaagaatatccgattaaaacatcgattgagttggtctctaatttgaatgacattgagcctattttttttaatgtgcaagagtttaggatatttttaaactcaatttaagcaattttggagcaaaatagcccccttttttaacaattgacctttccagagtttttttcctaggaaaaacctaaaaaaatttatgaaaaattgaatttgaagaaaaaaaagtttagagtttttcccagaaaaaccttctaagaaagtgagaaacttaaaaaaattcagtttttgaaaacatttttgggggaagacaatacggggggagggtgggtgagctgtgctccctaaaaaagtataattttgtccgattcatttttaattaattaaaattaaaaaatggtaataatattttttcaaatttaattaatttactcgtcagcaataaa

SEQ ID NO: 64406 - DNA, 1347 bp, Heterodera glycines
  misc_feature (10)..(10): n is a, c, g, or t
  misc_feature (27)..(27): n is a, c, g, or t
  Genomic contig location: Contig_ID=SeqID_34676; Location=1..1347; Strand=-
  SCN-specific regions: Sequence locations=1-138,160-297,325-693,718 -1347
cgctcgctcntaattatacatttcccntattccttggtcagatcgattttctgtcgccttcgcttttttcgtacataaattcgggcacgggaattgaggtgaaccgagtgaaggaatgacttttgaattgttttaattgatccttccttagaatttgacaagccttccgaatatgatacaaaatatcgggggaccatttggctttagtgccaaagaccaacagctttggatggactttattatggaggcgtcgggagtggtggaaaatgccgagaaaattgaggcggtaagaaaagaaatgaacgagcgaatgaatgaatgaattctcatggcggtggacaatttcaggaaacgaatgtgacggccccgggggaaaacccattgaaaacggtgtgggaaaagcattacgacagggagcgatacgagcgcgagatacgcaccaaagagggcactccgttgtactttaccaaacaaaacataaggtcgaccattggggagatggaaaaagggaaaaagtgccaaagtgaatgaaaaacagtgccaaaaaaagtggcaatcgtttgtaatagtttagcattttcagcgatggctttggcccaaaagaagtgagcaaagtcgaagtgttcgaacaattgcataagttgatgggcagtgagcagatcaaagacatgaacaggacgggcttcgccctcctgtccaagcagcagttggatttgctgtacgggcccaactcggagttccacgacgagaaagtcaaactcgtggcttacaaattagtgaaccaaaagaagtgcttgagcttaaggtgctcaaacggttcctggcgttgaaccgatcgacgattcagcagcacattgaacgcgacattcattcgctcgcgcagataaaatcatttaaaatcacgcggaagtcagcgcccgcgaaggcgcagcaccacgcgcgatcaaagagagcggtgattctgtcgccgattagcttttccccgtttatcctcgtgagttgggcttggccttccaatccgatcatttgtcttcagaccttcctcgacaggagcccgatcatcctttctccaatcattttctctccgctgatccttgcccctgccgtcttgggccctgtgccgcccccccccgctccctttccaccttttatacgccccgttgttcaggtgatcctttccccgtgggctttcgtgccggtcatcctctcgccccgtctgctcgacccgttgattctatcgcctcccattctttctcccgttattttggtccgtcttttgcttcaccgtccccccccatcctccgcgtccctttcagtcccctctagcgctgcatccgatcattcttt

SEQ ID NO: 64407 - DNA, 678 bp, Heterodera glycines
  Genomic contig location: Contig_ID=SeqID_34678; Location=252..929; Strand=+
  SCN-specific regions: Sequence locations=1-180,204-217,240-299,321-678
atggttataagactgccgatttcacctggttctttgatgggctgaagaaagctggtggcagttttgacgttattggcatctcacattatccgagctcgtcaaattggaaaaccctagacgcacaggccgaaacaacactgaaaactatgatcagtcggtacggtagacgactgttttgtagtttaaaaaattctgagatttattggaggttcggttcaaatttttgtaatctaggatatttaaagtttgctctttaaaaatgggtaattcttaaaagagaaattcaaaactcccacagctttaaaaattttaacataaaattaggcaatttttcaaattttcataacaaattatcaaaaatatatgtaattttcagcggccctttttgttaggcctcaatatagccactttctaaaagccgaactttgccattttaacagatatggcaaaaaggtggtggtggccgagattggcttatcatggaacgagccaagtgccagcaaatccatgcttgacgacatgttcaagcgggtgaaagcattggggaacaacggcattggcattttctattgggagccgcaggcgtcgccaggctggaaccattaccagtggggcgcgttggacaattcgggcaaatttacggccgcaatggaatcattcaaaacaactgaagaatga

SEQ ID NO: 64408 - DNA, 648 bp, Heterodera glycines
  Genomic contig location: Contig_ID=SeqID_7304; Location=389..1036; Strand=+
  SCN-specific regions: Sequence locations=1-127,149-300,323-526,569-648
atgcaaactgctcgaaaaggagctgatcaagcaaatagccttttgtgaggagagaacgagtaaattccaatcggcgggcgactcgaaaaacacccttttatatgagggattgttacagcaatcaaaagtattttgaaatttaattgttaatttacgtgaaaaacaatttaagaatgatttgcagcgggttcaattggctgcgttgggacaaacacaactccctaagtgcgtttgactaaaatgacggtaaagttttggcattttatagcttcaaattgcccgaactgtccttacccattatccaattgaattcttcaatttctgacgacaaattgatgcttagaataaagaaagtcgagcacctgaaacttcccgaggttataattttccacaatttctggtataattttttgtagggttggaaaccatccgactgtgctttgtacgttttcttcaaatttccttttccccatggtacgcatcaaactggacgaactcccactatcaaagggacaaattctcccggtaatttttgttaaagaaatttttttataaattgatatttttagaatttacggatgtttttcaactggacataagtcgcaaaacaaagcaatttttgcgcatctgcaaaagacagcctcttaa

SEQ ID NO: 64409 - DNA, 614 bp, Heterodera glycines
  Genomic contig location: Contig_ID=SeqID_7306; Location=1190..1803; Strand=+
  SCN-specific regions: Sequence locations=1-323,345-416,438-614
atggcacagcttaattctgaattaatccgcgctaattgcgaagacagcggtttcattgatgaaattgagttgcgtctcatttccggtgccctgcaatttgttcatcccaattcgccgattccttttgagcgaattccactgcacaaaatcaaacatataattagctttgagaatggccgaggtgccgtaaatgtgcttctggtcgagaattttgcttattcatcggaccacaagcttggccttgttagcaagtgccatttatttgaaactcaacgcggcgatgatgaccgaggagtggcaatggttgaagaattttgccaaggatttaagcagaaatttggagaaattctggagaaactatcagccgagcaacaacaaaaacaatgattataattttttacatctttttgttgttgttttttattttataaataatactttatggattaagaaattaggtaataccatttatctgtgtataatcgtataacacacacacgtgatacattatatagttttttccgtgtttttattttcttttgagatgatgtccttctcttctacctccgaaaattcatttgacgaaggtctggcgaatacttcgtttgttgcta

SEQ ID NO: 64410 - DNA, 880 bp, Heterodera glycines
  Genomic contig location: Contig_ID=SeqID_7307; Location=398..1277; Strand=-
  SCN-specific regions: Sequence locations=1-324,346-880
atgccgtccctcgaaggtatttgtcggcggcacggaaatgggcggaggaggccatcggaaggcactctgttcagctccatttgctcgcgtggacagtcccggcaattctcgcagcttttgttctttggactgatcggattgatgcctctgagcttagcggactctgttccgttggcaatgcggatcaaagtgcgcttttgtggctttggactgtccctcggtcttcgtccgcactgctcggactttaccttatcctttccggcttctccgcaatgtgcaaagaacggaatcacttcagaaagcgggttggtgttgagagaaggcataaatcagacgaagaatgtttcaattgggaagaatcttttttaaagcgaattcattggcatcgcttttcatttgtttgtctttcggcagggcacagacacatccaaacttgaaaagttcatgttcaaaatgggtgtgttcgcccttttgttcgtgttcccctcgctgatcgcttccgcgtgcgatctccaccaattgtcagtgctcatccaatggcttccgcacaccgtcggctgtaagtcgcgcggaggcgccttctccggagagtgcgttcggcccgaacagccccccgggcaattacaggtcgttttccgatagtttaaagacgagttggcattccatccaaattatcttatttcacagctgctgggagcgacgatggaattgaccgcggggatggcctcggggttatggatgttgtcgccgaaaacactgaactcgtggaagagggcattgccttgtggaaggacagcggacaaaggcacagagaggagaaaggacgaaaccggcatgagaatggcggaaatggaaagagagcgacgggggacggacagaa

SEQ ID NO: 64411 - DNA, 556 bp, Heterodera glycines
  Genomic contig location: Contig_ID=SeqID_34682; Location=525..1080; Strand=-
  SCN-specific regions: Sequence locations=1-108,133-482,509-556
atggacatggactactccgtggacgtcaaggtgggcagaggataggattcgtagagtccaaaaatgggaaatccggtccgcgttcatcagtttctttttttcaaaaccaaatttaaaattctctttctactctcaaaaataatataattttttgggtgttgaatggttagtttgactaatttttacatatttcaaagccctctaatggctgttcagttttttttaactctgctaatgaacctttaaatagcaaaacattttttaaagggtttttacccgattttttcgcttcctaaattcttattttgaatcccatcatccttttccctccgtccgcagatggaagtgcacccggcacgcgagccaccgcccgtcaaatacgaggacacggaggacgaggcgcaggtggacaaggatgacgagcccgtgtcgacggacgactacacggagggcaccgactcggagacggaggactgaatgactgacggagggagggaggaactgctctaattgcaaatggggaccattgaatgatgaatgattgataactaataaa

SEQ ID NO: 64412 - DNA, 821 bp, Heterodera glycines
  misc_feature (448)..(448): n is a, c, g, or t
  Genomic contig location: Contig_ID=SeqID_34685; Location=119..939; Strand=-
  SCN-specific regions: Sequence locations=1-17,39-43,65-207,229 -371,393-507,529-661,688-770,813-821
aaacaaaaaaatcgattttttcaagtgtcagtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaagatccggnctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 64413 - DNA, 49 bp, Heterodera glycines
  Genomic contig location: Contig_ID=SeqID_34686; Location=353..401; Strand=-
  SCN-specific regions: Sequence locations=1-49
ggaagctattccggaaggattcggtctccccataaatctgggcgcatcg

SEQ ID NO: 64414 - DNA, 293 bp, Heterodera glycines
  Genomic contig location: Contig_ID=SeqID_34691; Location=1..293; Strand=-
  SCN-specific regions: Sequence locations=1-42,72-127,188-191,239-293
ggaatcgaaggtgttgtaagctttttttccttttttcacttgtaaatttatttaaattttcaatttttttagctttttttcgaaaaattttttgtctttttttcggcaggcactgcctctgacaatgttttttatttatttagaaaaataaatttttttttcttgttgatttattttaattatatttcatccttacattttttaataaacattttcaaactttcaccttattaatttaaggcgaattttgccttttttattaaaatctctttgtgaaaaggaaaaaaaatagg

SEQ ID NO: 64415 - DNA, 356 bp, Heterodera glycines
  Genomic contig location: Contig_ID=SeqID_34691; Location=374..729; Strand=-
  SCN-specific regions: Sequence locations=1-41,71-126,212-218,241 -245,276-356
ggaatcgaaggtgttgtaagcttttttccttttttcacttgtaaatttatttaaattttcaatttttttagctttttttcgaaaatttttttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccatacca

SEQ ID NO: 64416 - DNA, 349 bp, Heterodera glycines
  Genomic contig location: Contig_ID=SeqID_34691; Location=810..1158; Strand=-
  SCN-specific regions: Sequence locations=1-40,70-124,207-213,269-349
ggaatcgaaggtgttgtaagcttttttcctttttcacttgtaaatttatttaaattttcaatttttttagcttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcaaatttgcttttttaataaattctcttgtgaaaaggcaaaaaaataggctcttttaaatatgcctatttaaattactttcattgctttcctttcgcttacgaccatacca

SEQ ID NO: 64417 - DNA, 1698 bp, Heterodera glycines
  Genomic contig location: Contig_ID=SeqID_7308; Location=153..1850; Strand=-
  SCN-specific regions: Sequence locations=1-290,313-577,601-639,661 -844,882-1139,1161-1514,1536-1634,1656-1698
atggagtgcgcgctgttctcaaccggacgcgaccaaaccaacttgcgcgggtggacagcaacggcagcagaaacaatacgacaagaggcaacggcgtggcatccgaagcaatgggttagtttttatgacatccaatgtgtgaatcataattatgttgtttgtaagaaaaaatgtttaccatccaaaatttcccaactcaaaatgtcccaatttttcacaatttttaattggttggttttctacagaacaggacaaatcttcaccactaaaagttttccaaaaagacgctgaaaatttttaaaatttttttttcttctgatatcttataaaaacttttctcggattctttttcttgaaagaattcaaagtttgaaaattttttaaagtttttagcggcaaaattttgggtacaccagtactccatctgtccaaattagtaaattgtatttttttttcaggtccgtctctttcatatgcccaaattctgcggcctcctcaaaagcgcgctgcccgaacagaaccaacgaaattgtgttgctgcagcacatgaaattccactgtcgtcatcacaaggttcgtttttccccccattttcccctgatttaatgggtccgtatgtcataaatattgtccgacccaaaaaacttttaaatttaaatagttaaacgttaaaaaatttataggtaagaaaaagaagaaattttgaaattgctggcaaaattctgactggaaattcgggaattgtacctctgattccctaatattttgtttttgattaaaaaaactaatttaattaaatcttcctaatccattaggctttcgaatagactccaattatggcaagaaaattatttttttgattttctttttttttaattttaccaccggttttttttctaaaatctatcgccattttccagtgccaatttgtccgaccaaaactttgtaaaccgtcgggaatcgctatttgctgaccgagactgtccactgttgaccgacttcttcgtcgacctgttccgcctcgttgacaatccttccggcggatgaacgcgtcggaacagttttttttgaaaaaactcagacttttggtaatttttttttaattttctacgtattggcttcaaaattggataactattaaaggaatttatccccaaaaaaccgccgtgttgtccgcccatttgtccctccccaccaaaaaactgggaatgtgttggcaccgatttttttaaataaaagagcttgtaaattatgcctaattggtataccatgggaacaaacaatttttttttacaaaaagtgcattaaatttcgaatttctgagtgaaagaattgctgttgccgatgataattttttgccggtattttttccctaaattcagtggcgcatggggccgacgcaccaccacttttgtttgagcccttactgcagatgtgcaagtccaacatgaaccaggaagtggagctgctcagcaaattgtcagcagctgcatcacagcctgcggtgtaagtgcgaaaaatggaaaaaattttaatgggtcaatttttttgtaaaatttctcaatttttcctattatttttctcaacgaatttttttcacttttccagcaaaaaggagacgacgacaatccaccggctggagttcacgctgatcaccgcctatttcaaactgttcgaccctacgccgacttcagctaa

SEQ ID NO: 64418 - DNA, 1847 bp, Heterodera glycines
  Genomic contig location: Contig_ID=SeqID_7309; Location=15..1861; Strand=-
  SCN-specific regions: Sequence locations=1-81,104-285,315-370,393 -436,466-866,888-943,967-998,1020-1022,1044-1243,1265-1551,1574 -1734,1758-1847
  Gene Ontology: Mol. function=protein serine/threonine kinase activity; Cellular component=nucleus; Biological process=cell cycle
atgagcataagggcgttaaaacgacgaagtgtgcgctcgtcaactttctttgaaaaaggtagatattaaaagaaaagcaacttaaattatattaaaataattagtttgaatcttatttaaaacatagggtgggagatttgagttacaaaaaaaaacggtgcaccccaaaactccgccgaaaaataactccgccggccgaaactctgccgagacataactccgccgggcaaaaaaattttcaaatttagaaattttgcaagaaaaaatcagaatttttttaaaaacgaagagtaaaatattttcaaataattttcctctatttttttgaaagaacttagtttttcatcattaagttttgaaaaatcgctggaaatgttttaggaaaattttttggcggaatttcgtaaaaaaatttgcaatccaatagggtcgcccgccccctttggtttttaattaaattttaaatcctccatttaaacagcgtaaaagtttcatgccaaaattcaaaattagcgcgtaatggtttaattttcagatttggcagttctcctagaattctgcggccagcagccagcagatgttgtgtcctggcgcgacttcgaggcttctgcggggtaattgttttagtaataaaacagtttcaccaatctcccccagggcttgatacggtttagaaattagtaattacagcatttaaaattacgaatatggaaaccatgtcttcatacttttgaaaacaaaaaaattcttcaaaaaaagggggcagccatcggcagtattaccaatttttgattttttttaaattggaaaacttaaaatgagcaatattttcttttttttctttgttgcgcctcactgtaataccgaaaattaattattttcaatttttaacgctgcgtttggtttagttctttcaacggctggtcaaaaattggcgagggggcatttggagaagtctttaaaggaccccttgatggtgtttgcattgtgctgaaggtgttttgttttaatgttttgcctctttttcaagtgtttttcaaggttatcccgttcgctgtcaacgaggatcagtgtttgaagctcgtcaatggagaccatctaaagccagcaaaatttgtcttcaacgaattgttcatcaccaacgagctttcaaagctatccgaggccggcaatgactttgtcacgccatcgttcacacaattgcgcatgagcaaggtcgtcaaaggtatgtttaatggagtgcagttaacaactaatttgggcttatgggtgttttattttcttaatggagatacatctaaaagcaaatgtttttaaaagaaagtttgtcaaaccgtgctaagctcatttttccgttaaggatgtcttccgtccaaattgctgaaagcatgggatgactttaagaaggcaaagcctgaattggtggagaacgaccggccagacatttacgcccatgaagatctccatttcgcaatcatcggcctttcctatgggggaaaagatctggagaagtatacggttaggtttcaagaaaagaaaaaaactaaaatgaagttttttcatagataaaaaatggccgcgaatgttactccattttccatcaagtcgccttgtccctagcgatcgcagaagacgttctcgaattcgagcaccgggatctgcacgccgggaacattctcgtggagcagtgcccggtcgatgaaaaaattcggtaagcagcaaaagcaaaacagtggaaaataatgtttttgttaaaggtacctttatcgaggagaacaaatcgatgtcgtctctaatggagtgcgcgcctcaattatcgacttttcgatttcgcacttggaaaaaaa

SEQ ID NO: 64419 - DNA, 677 bp, Heterodera glycines
  Genomic contig location: Contig_ID=SeqID_34693; Location=665..1341; Strand=-
  SCN-specific regions: Sequence locations=1-31,53-178,245-292,315 -338,370-497,589-677
gctttcgaatgataccaccatttcgtatagatttggttaacaaagaaaaaagttatagtccacctactggactggcgctgaaacgcgtgggtcccgttttaatgttgacattttttcaatttaaaaatgactgaattaattttttaccaaaaataaaatttgtttatttcattgtgtgataaaaaaaaaatttaaagaaatttataggatttttttctataaaaaattaatattttcatttattcgcagagcttgtcaatgtggaacagaagccgaaaaaaattccaatatggaggagggtgagaaaaagagaattttctcattcgaccgatatcacctaataatttttaaatttttttttttaattttcagaaggattctgaactcttttcaaggccttgcacctttttggaggacacccgcttttatttgctctccaagcggcaaccaatccccgccgcattacgccgcaatggacttacatcggttggaaattgaaaaaaaaaaattttaattttcataaatttattttgattatttcttaaataaacataatttttattaattttttaaattttatttttttttcacagaaagctattgatgccattgtgaaggatttgttcggcaaagcaaaaagtggtgaagcaaagtcgccctcccccatggaccataag

SEQ ID NO: 64420 - DNA, 154 bp, Heterodera glycines
  Genomic contig location: Contig_ID=SeqID_34694; Location=336..489; Strand=+
  SCN-specific regions: Sequence locations=1-46,68-154
atgggaagcaacggcaatccggaggaggatttaattaacttaacagacaaattaaagaaaaaactcgcaaagcatggagaagacgaagaagaagaagccaaactgaaacgaagaaaatcgaaaaaagggattttcgatagaacaattcaaaaag

SEQ ID NO: 64421 - DNA, 86 bp, Heterodera glycines
  Genomic contig location: Contig_ID=SeqID_34694; Location=624..709; Strand=+
  SCN-specific regions: Sequence locations=1-86
gaagataaacgatcaggaaagtatttgcggtgaaattgtggctcaagaaagtggcgaaaacactgcaaatcaacagaatcagactc

SEQ ID NO: 64422 - DNA, 68 bp, Heterodera glycines
  Genomic contig location: Contig_ID=SeqID_34695; Location=297..364; Strand=-
  SCN-specific regions: Sequence locations=1-68
gacataaacatttatttgatttattttaccatattcacaatttgatcaaaatataggtggtcaaaagt

SEQ ID NO: 64423 - DNA, 64 bp, Heterodera glycines
  Genomic contig location: Contig_ID=SeqID_34700; Location=1020..1083; Strand=+
  SCN-specific regions: Sequence locations=1-64
agttactggcgttagcatcatagcggtgcttttccttgtctttttgatgcccttgcaaaatctg

SEQ ID NO: 64424 - DNA, 173 bp, Heterodera glycines
  Genomic contig location: Contig_ID=SeqID_34701; Location=243..415; Strand=-
  SCN-specific regions: Sequence locations=1-137,164-173
atgaatagagatcgacattttgaaaaaaagcctggatctgtaccagggttctgtgttggatctggatctgatttcctggacaaaaatccaagtccaggaaatcaaggctcctcgaacctggattcaggcttggacctggattttttgaaatttgttttaaaaagccaaacaat

SEQ ID NO: 64425 - DNA, 85 bp, Heterodera glycines
  Genomic contig location: Contig_ID=SeqID_7312; Location=163..247; Strand=-
  SCN-specific regions: Sequence locations=1-13,35-85
atgcatgccaaattcgtgcaaattgttgccattgcatgccaatggccagaagcgacgttgaccgatttgaatattctcaaataca

SEQ ID NO: 64426 - DNA, 432 bp, Heterodera glycines
  Genomic contig location: Contig_ID=SeqID_7312; Location=824..1255; Strand=+
  SCN-specific regions: Sequence locations=1-432
atggcccattcggccaagcagaaaatggtcaaacgcagcgcatacgcgaatttgggaccattttttgtggaattttatggaggaaaccatttcataaagcagttcatttggcaactttttcggggtcattttatgagtttgggtggtaatttaggagatgggcaaccaacttataacggcgatgaatgcacagccatattcttatctaataaatctaggcttaattatcggcaattcactttcttacctaatcgtggccggtttttggcgccagtgccctccaaaaaaaacttcgtatcccaaagtaattaaagatttggtttgcaacagtaatgtttaatccatttcagcaacatttaataatgtagaaggtcgaaccaaagagtctaatcaaaatcaaatagattaataatttctggcaccaatttacaa

SEQ ID NO: 64427 - DNA, 1017 bp, Heterodera glycines
  Genomic contig location: Contig_ID=SeqID_7312; Location=1307..2323; Strand=-
  SCN-specific regions: Sequence locations=1-33,306-307,367-588,926-1017
  Gene Ontology: Mol. function=protein binding; Cellular component =axoneme; Biological process=N-linked glycosylation
atgctgttagtggttcgattcccattgcttacgtttgttttctatttattattatttcaaattgttttatttttgtttttttattttatttttttaattaagtttattaaaataaaaaataataacaaaattatttttaattcataaaagattatttatttttagttaaattttaaaaaatataatcaaataaaaataaaaaaatgtttaatttaatttagtttgttaaaatagaataattaatgcttttttaattctaaaagaataatttttttaaattaaattttaaaattaatttaatataaccaaataaaaataacaataaaaaaataaaaatacaaagcttaataatttaaagagaaaaattttttgcaataagagacaacagatccgttagtcaagtagttagttctgccttgctttgattctgtgctgtcgaggattcttaattccgggtgtcttccatcttttattacttttaaattattacgttttaagtattttatttttctattgtttatcaaaaaagattagttagatgaagagtgaaataatcagacccctcctgcgatccataaaatttttaacagagaatggaagagaaagaggaacaaaaagtggaaggaaaagagggaaaggaacagaaagagagagagaaagtggaaggaagagaaaagggaagagagacaggaactgaaagaggtacagaaagaggaagagaaagtggaaaagaaagtggaagagaaaatggaagaggaacaaaaagtagaagagaaaaaggcagagaacgagaaatgggaagagaaagaggaagatgaacagagaatggaagagaaagaggaacaaaaagtggaaggaaaagagggagatgaacagagaatggaagagaaagaggaacaaaaagtggaaggaaaagagggagaggacagcggagcggtagaagccgatgaagattttattttaaaggattttcatgatgagtgcaccgaggaatttattttaaaatcgagcaattaa

SEQ ID NO: 64428 - DNA, 667 bp, Heterodera glycines
  Genomic contig location: Contig_ID=SeqID_7313; Location=461..1127; Strand=+
  SCN-specific regions: Sequence locations=1-440,462-495,524-667
atggcccattcggccaagcagaaaatggtcaaacgcagcgcatacgcgaatttgggaccattttttgtggaattttatggaggaaaccatttcataaagcagttcatttggcaactttttcggggtcattttatgagtttgggtggtaatttaggagatgggcaaccaacttataacggcgatgaatgcacagccatattcttatctaataaatctaggcttaattatcggcaattcattttcttatctaataaatctaggcttaattatcggcaattcattttcttatcaaataaatctaaccttaatttcgcatcgaaaagtaattaaagacacattttaataaaaaattcaacccagaaaacaaaaatgaaagccaaaaatatttggttatttaattgctggaattctttaaataagttccttggcgccactcatcattaaaaagtatttacttattttgatcaaaaattcaaatgtgcaaaaggacaaaggaataaaaattaattttaattaaaaaatagacgcatttctaacttatgttttatcattgttgatactgaaatggaaggacgcattgacaattgataacactgtatttttggttgaaagggaggaaaagcggattaaaagagagactgtcaagggatgcgcgataaatgcgtga

SEQ ID NO: 64429 - DNA, 876 bp, Heterodera glycines
  Genomic contig location: Contig_ID=SeqID_34702; Location=303..1178; Strand=-
  SCN-specific regions: Sequence locations=1-64,249-283,305-766,799 -829,851-876
  Gene Ontology: Mol. function=protein binding; Cellular component =axoneme; Biological process=N-linked glycosylation
atggaagagccaaaaagtgagggggaaaaaagtgatcagaaaattgaaaaagaaaatagtgatcagaaaattgaggaagaaaaaagcaagcagaaaatggaagagccaaaaagtgagggagaaaaaagtgatcagaaaatagaaaaagaaaatagtgatcagaaaattgaggaagaaaaaagcaagcagaaaatggaagagccaaaaagtgagggagaaaaaagtgatcagaaaatagaaaaagaaaaagttgatgagttaggaaattcagaaagtattgatgaaagtgttaataaaagtggagaagaagcatcaaatgttagccaaaaaacagaatatgacatacaaagtgaagaaatggacgaaaaatggaacaaaattgagagaaaaagaacagaaagccaaagaaaaaggcaaagccaaagacaaaagcaattaataagcgcaaaagtaatcaatgcaacactttcaggttaaatcagaaaaataattaagatcttaagttttttagaagatttagaattattacacaatttatgcaaattagtttttctaaatgaaaaatcctgaaaatatgtttttagtttgggttgaaaattcaggcgccatctttgtcgattttttcgtaatcatttaaaaaaaattctgtacaagtgcccttggcacttaaaaatcggaaaattttcagttaactgcttttagtgagagttctatagaatgataattattatttacgatatatttatgtaaaaaaaagtgtaaagcgaaatttaataattaatttatcatatataatatcagatttgtgtgaaaatgagccgcttgttcaaaaatataaaaatgaaattttgcataacatgcagccaaatgccatga

SEQ ID NO: 64430 - DNA, 726 bp, Heterodera glycines
  Genomic contig location: Contig_ID=SeqID_34707; Location=117..842; Strand=-
  SCN-specific regions: Sequence locations=1-33,57-424,446-726
atgccatcgaatgttcggcagagaatcgtcgtgttgtccttggcctggcactgtccaaaattcgttttccgctcatctctttttcggatttctccgaccatgttggtaggtcgtccgtcaacagatgcttcgtttttcaaatcattttaacaaaatgttttttttaaattcccattttttcagtgccttccggcgtgttgaccagtgacgagttggtcggcgttttcctgacccacgcccacgcggaccgtcgtgccaactccgagttgtaccccatccaatttcccacccaaaatcgcactccactcgttttaacggaggtcccggccgaggtggtcattccgccgatactcaattatgattatgttccttcgttgtcgttcaatggatggggcagcagccgccgcaggtacggtttaataattacataaattacattaaatcaatttaaaaaaagacgacggaaccgccgaaacaaatacactgtccgcgaactcgggttggatttcgaggtgccccaaatcagtgattgggctgcaccacccgttgatttggcaccgatactgcttaattactgatctgattgatcaaaaccaattcatatttattcattgtatgaaatttgcaaatttatttgcgtaaaaaacacgtacaccttttgacattgcataaaaacattacaatggaccattaatgatcgcttttttcaagttttcaaaaaataaa

SEQ ID NO: 64431 - DNA, 313 bp, Heterodera glycines
  Genomic contig location: Contig_ID=SeqID_34711; Location=643..955; Strand=+
  SCN-specific regions: Sequence locations=1-107,134-217,239-263,290-313
atggagaaggcctgcaaaatttggagagattatatcgatgttagtgcgctaggttcgatgaaactttttaaaatataagcctaaactttttggcctgtttaaaaaggaattaaaaatttttaaaaattttattcatctcccttttgatagaaaaagcatcagagagccttatttaactttaaattaacatttggtgcgtttcagagcagtttctgaaaaaatatttatgaattaattttgctaaaaaaataaaatagtgaagctttaaaaataataaaaattttaaattcagaatactggagtagcatcatag

SEQ ID NO: 64432 - DNA, 575 bp, Heterodera glycines
  misc_feature (20)..(20): n is a, c, g, or t
  Genomic contig location: Contig_ID=SeqID_34711; Location=1..575; Strand=+
  SCN-specific regions: Sequence locations=1-261,297-575
tgcaggtctacagggctatnagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 64433 - DNA, 1759 bp, Heterodera glycines
  Genomic contig location: Contig_ID=SeqID_7314; Location=524..2282; Strand=-
  SCN-specific regions: Sequence locations=1-1352,1375-1759
atgagcggttctgcgctgtgcccgtgggccgttaatgatttagtccgtgacggctcagatcggacagcaaaagcgatgggatgcggcggcacaaatggggagcaaaatgtgcgcgactgtgtcaagcgcgcggaattggaggatttggtcagtccaatccattcaagcaaatagggacaatcccagggagggatagaaggggtacgtatccccattcccaaatgggtaaacaaaaaatccaaaaaattgagagccattttaattttaaaatcacacggcgtgacggcgctttctttttacagatggatgccatccaaaagttggatctgatccgactcgacttggccatgacgcggttcaacccccgggtggacggcgaatttgtgccctccgccaatctgtcgctgctcattcgtacggcaccgccgaaacccacaattatgggctttacaccgcacgaggcactctttcttagtaagtttttgcaactctttcaattctcatgatgtttcactcagaggggggaagagagtgtacaaatttggcattggcattttgtttatccaattcccccaccttttttaagccactcatagtcctaactctctgctgaccttcaattctgcattaaccgtgacaaatctgaacacatttgggcacgaacaactcgtcaaatttatccaaaaaatcatccattctgaacaaattggacgaaatgccaatggcagagaggttgagaagcgcaaaagggcaattgtggaaaaactgatcaaattctatgccgacgaaacgccgacgaacgacacaatgcattggttgaagcagtacactttggtaggtcagaagggaaggccgaaaattatcagaatagccaaaagaaacactggcaaaaggggggcaattagcaacggattaattaagggcaattaatgataattcgtttcaagtttctctgacccccttttcagttcctttccgacgtccttttcattatgccaattttggccgaagctcggctgaagtccgccctcggatggcccgtctttctgcaccaatttgaccatttgaacaaaggccatgccaaactgttgccgttccgcgccgtggcacacactggtgaaggagggcgaatgccgcctgttaattgcatccgaaatttgcagccgaatacgcattcactttgggcgtgccattgctgggcaatttcgaattggacgaggatgacagaagagtacgcgcagagatggtacatgcctacggcagttttgtgaagaatgggtaagtcaacatgctcattacacctttttggcatttgagatgccataaaatacgtccagctgctgtgtttcacaattccacccggcttttttcaaattccattcttttctaattgttagccatttataatcgcatttttaataattgatctcgtctctcaattagtgtgccaaatatgctcaacggcgaaagggattggcccccactcggcacggaccgtggtcagcccgtccgattggtgcacattaaacggccgaacaccgtggcagaaacagggccaatggacgtggcacaaaaggagacattttggcggaggctttccacgttgaaaggatacacagaagttgcgggtttccccaaggaaatggcacaattagcgacagaattttaatttttatttcatttttcaatgaatttttgtacattttgtttttaatttcggctagttttgtattctgggaccaaaataatgtccaataaa

SEQ ID NO: 64434 - DNA, 1285 bp, Heterodera glycines
  Genomic contig location: Contig_ID=SeqID_7315; Location=192..1476; Strand=+
  SCN-specific regions: Sequence locations=1-705,727-1285
atgcttcaacgtctatttgttggcaagaatttcacctgtctgccgttgttcacttctcatcgcagttatccgggctcaaatttcactttccccatagattggtatgaaaataagtatgtgttactgcaccaacgcgcccgtgaaaaagtttcgcccgattttcacaagcaggttattattatgttaatggagcattttaatttcctgattattcatcactgttgcttataattccaatcttccgccttcttaagaccaccggccttaacggcctttacgtgaatgaaaatccgcacaaagaccttcgcttgctttaccaccgcattttgcgcgtgattggaatgatcccggacagcagtcagtaccggatggccgtcgaagaaattgtcaagcatcgcctttcgcttgttgaagcggttactatataaaatgtcgtggaaacgtgtttacggaggtttttaggtcgctgatcacgaatctgacatccatttcaaccttttcgaatcccggacccaaatttgaacaaaaaataggaaattcaaattttggtaaatttatgaacaaaagtgcgaatcttcaaaattttgattttcgactttttgttcgaattcgggtccgaaactcgagataggtcaaaatgagtgtcagattattgtcagcgaccctgaaaaccctcgtaaacatgtttccacgacttttcagaacaaaacaaaattttcccaaaaagtatgggaggcaccatcgatagtaatccaaaattctaaattacagaactttgtctaaattggatttatttctcaattgttaagcgattgttggattgttttgatgtttcaggaacccgacattcaacaattggagcagaaaatcggcatgggtcagattgaagaagtagttcaacaggttgtatccaaatttctttgttttggtgacacgactctatcaaatgaattgttaatacgctctttcttaaggccgagtatgaattggagtgtattcgtctgtttgttgcacataaatgttgggaaccgctggtggaaaaagcggatgaggcgcaatggcggtggccaattggaccaggcccataagggaatcaaatgaccgtgaaaatttgacgccttagaacgctgtattttttctcgttacaattattttaacgaattcacgtggagaatataaacagtataattatgggatgttaattaggataaaaaaagaaaaattttgtcattttaatattatgagcaccttatgtatcaactcgtacagttcttctgggctgcca

SEQ ID NO: 64435 - DNA, 77 bp, Heterodera glycines
  Genomic contig location: Contig_ID=SeqID_7315; Location=3303..3379; Strand=+
  SCN-specific regions: Sequence locations=1-77
atgccagtggttgtgttgcgtggcgtcgatgacgcgtaccctccgcagaaaaaagcgtttgcaatgctccgctggat

SEQ ID NO: 64436 - DNA, 1019 bp, Heterodera glycines
  Genomic contig location: Contig_ID=SeqID_34712; Location=298..1316; Strand=+
  SCN-specific regions: Sequence locations=1-180,202-238,311-371,394 -455,477-736,758-930,966-1019
atggccgtgggtgacacggagatccttacataattgttttttaagcataaaaaaatatttttttagtcggatgataaaaaaccaaaattaaaaaacattaattctcattaggtgctctttcccaattaatgatatgttgacaaaaaatctgcttacaatttgtgagcaaaactttcatgtgatttttgcatgagaatcccattttaataccaactgtttacgtcaaaataaaaaagccaaataaataattaacaaaaagtaaatatttaaataatattagatattggatgaaaaaaatatatatataaatcctttataattgacataaaattactttatttacccaccaactatgaaaaccatcttttttacatttattcttcttcttcttttgccaaattgctgcattgcaaaatcacttaacctttgcaccgtttatgacaaaatggaatcggaatatgaaataaaaattaatttaagtgcaattaaagtcagaggcaacgcagaatttaaagacacaaatttgcatcaaaatattcaaaacggagaatgtttgtggcgtttcggttccggacgacattgagacgaatttggttgaattcgtatttgacattggcattatgccattgcaaaacaatgtgtttaattcggagaaagggcaacaaagtgggaaaacaacgcgtgatgatgattacatttttgaagtaccaacagaccatgaccatggaaatgccatgaggagcagcagaacggtgccaattaccgtatacgaggcacacaaactgaacggaaagccaattgtgatcaatttgggcaaaattgatccatatggacagtttttgaatcggcgtttatttgttgagagaaaaaacgatttgggcagaaattaccacgcacttttgtatgcaattgcaacaaaaaatggtgaaacggaagaaaagaaagtttttgttggatttgcccaactggtgagggccaatggagaaacttccacttctgagcagcggcaggtgaattaa

SEQ ID NO: 64437 - DNA, 67 bp, Heterodera glycines
  Genomic contig location: Contig_ID=SeqID_34714; Location=563..629; Strand=-
  SCN-specific regions: Sequence locations=1-23,50-67
atggtaattaattctaaaatatctgaaaaagaatgcaactttttgggtagcgataaaccttttttaa

SEQ ID NO: 64438 - DNA, 845 bp, Heterodera glycines
  Genomic contig location: Contig_ID=SeqID_34715; Location=153..997; Strand=-
  SCN-specific regions: Sequence locations=1-474,496-845
atgcggcacgtgagcgtggaattgaccccgccgaatggacgtataagtgagttggcggcactaatgttttatgccaaattggcactaacgtttacaccaaaaatgaaattttgggagtctaaggaaacaatacaattctggtggagcagctcgttccaccccaattttccaaggaattcctcctctaatatattttttaatttcatacaattttccaaaaaaaattcggagggcgggggaaaaatgtcgacactcttgcaatgatatgcatagttgtaacggaatttaaacaaatttttctagaaacattgaggagatgcgcatacagttgtcaaaaactggcgtcaatttcgattggaatcgcgtgagtgccctcctttgtcactcgtccaattgtaccgaaactgcgatttctcccccctttcaattccaggagattttcacatgccgaccagattactttcgctggacccagtggatttttatccaactcttcaggcatggattcgtcaggaagacgctttccgaagtgaactgggacccagttgacggcactgtgttggccgatgaacaggtgacctaaagtgccgtacccagaagacccttattgcttcggcgaggggggggggcgagcgaccgttttttattgcgcttttcaaaaaaatttaaaaatagcttagtttttataggcaccgccggagaaagaaaattctgagaattttgacgaagtctttaaaattgtataattttaaaaaatccccattttttcccattcattttttcgttttcaatttctggttgcttcattctctaccaccgcaaattacaatttttttttcattaaa

SEQ ID NO: 64439 - DNA, 209 bp, Heterodera glycines
  Genomic contig location: Contig_ID=SeqID_34715; Location=1581..1789; Strand=+
  SCN-specific regions: Sequence locations=36-209
aaaaaagggggaggaaaaagagtgggaaagaaagtgtcgccgtcgtcgtctgtccgttttcttttccatccaagcaaacagatcacatatccacgaattaattcacaaaaacaaaaaaaagatgttcctccgcccctctagcgccagccaagccaagtcctcaccaactcacacagtaatcaggcatgcgcatacaatcgggtccactg

SEQ ID NO: 64440 - DNA, 542 bp, Heterodera glycines
  Genomic contig location: Contig_ID=SeqID_34718; Location=129..670; Strand=-
  SCN-specific regions: Sequence locations=1-149,183-542
atgcagaagttattctttccactagtgaatctttataaggataattgccttcaactgatgcacgaaaagctgaaaaatcaacaattggacacttgggcacaactaaaaaatgccattttgaaagaaaaagaagcgaggtaaaaatggggaaaataattattattaaaaaataataattttaagagagcaaaaaatgaatgaattaatgagccaaaaaacaaacaaaagtagcacaaagataatacaaaaactgtcaagaaaaagcatcaaaaaccattcgaagaaacaattggagacaaatttggaaaaagggagcgaatcgattgaaagtggccaattgccatcattttatggcaccgagcagaaaatgttgaggccgaaggaaagggtaaacaaaaatatatacaaagtattagatgtagaccaaaccctaattgttcagggaatcgactaccattacttctatcggtttgatgccaatgcgatcagttgccgccactgtccataccgccgaccggcgcaaaagaacttgaagccgacca

SEQ ID NO: 64441 - DNA, 1243 bp, Heterodera glycines
  Genomic contig location: Contig_ID=SeqID_932; Location=100..1342; Strand=-
  SCN-specific regions: Sequence locations=1-512,534-816,839-1027,1058 -1077,1099-1162,1190-1243
atgccgacagtatttaatcggtcgatacggtaagtgccaaattcaaatgcccaccgtttcccttccgcacaactcgcagtagcaccatagcaacctttttctgcttctgatcactttttgccgctgttttttctccatttactattacaaaaattcaaattttccaaaatctagtgatgttcgactgaatggcttcaattaaaaacacaaagcaaaaattccgagtttttctcaaattcattcgacatttatacagcgactcacaaattatatatacaatcagagagattccgaataaatccatccgccgcttttggccagcgattcgctctctgtgctgctgtcacatctgttgctgatcatttttctgaaaccaacctgaacttttttctgccaacttagcaacattttcacggcccttgtgccaactttggtctgaataccgcggctgttccacaaaaatttgttgtttttttccaaacttttgttattgctttatttgacattgtctgccatgaaatcagggcaacaaaaatcgatgtctaaacgaggggggagggggagggggttgccggtgaaggggaaaagaaggaaatttcagaaaagttggctatttttaaattaggtgcaaattgtatgagtagaaaaaacggacattggccacaggggtagtgatgtccgagagtctcggtctcgagtcccgaatcgagaaaagtctcgggtttttagcctcggtctcgggtttttaatctcggactcgattttcgagactcgagaccgagactgttttacacccctaatgattggcttttggtaaacttatatttttataaattttaggtcctattcaattttgttaacatatgtgtggtccagagggaggttggatcagttcccctccaagtagttattttttcttctcatttttcaaaaatattcttttttccgatgggaattcaatcacattttaacaattaaaatcgtaaaatattgtgtttttggactaaatctattaacaaaatgcactaaaattttaaaatttttcccttttcccaagagaaattttttttttaatttgaaaattgagtacactttgttacgaaaatagccaatattcaaaaatgtacccataaatttttgtattttcgttttgggggacgaattcgagtaaaatgtttaaaaatttcatttcacggggggatcttgaaatttctgtctaaaactctgggtttttttaaataaa

SEQ ID NO: 64442 - DNA, 1016 bp, Heterodera glycines
  Genomic contig location: Contig_ID=SeqID_932; Location=2713..3728; Strand=+
  SCN-specific regions: Sequence locations=1-73,110-252,275-324,346 -767,796-801,823-969,996-1016
atgaacggctctaaatctgacgaaactcgtgcgaaaattactgccgatgtggttgagcaaaaaataaaggtggtggacaaggaaaaacaacaaataaatgaaaacttatattttgcaggaatttcaacaaaaaaaacggcggaagaaaatgtaaattgtattcgaatttaattgattatttataaattgaaggccgagctgaaacgtcaaccatttgccacagaacagcgagtgctcaaactggacgtgaggaaattgttcataaatttaaaaggagcgaaaaaaagaataatttcgacaattatgaagaatgggggttggtcccatcttctcttttcttattttgggacaaaaacatgactcttgggcttttcggggtcactgatcacaaagcgggcacccatttcgacccattccgaacccctgatacgaactcgcacaagaagtcgaaaactcaacttcgaatttcatatttggtctaaaaatagttaaaatggttttttgaagcaacgataactttcgctttcgtttctatatgggaccgacccccattcttcattgttcgtgattgcgcaccacaatttcgtctcccttttacagaaagaactctggacgaaattgaaagagttgagaaaggacaccaaattggccatggaacaacaaaagttggcaaacgaattgcgcatttccaagttggaagcagaattggaacgacaaaaattcgaattcaaggaacgactcatgaagatggaaatcgaacgcgtaagttttattttaatttatttaaataattatgagaaaattgaatctaacaattgttttaacatttaaaatgatgtgaattaagttgaatgaacgactcatgaagaccggtggtacggtagcctatccccccttttccaactattacactttgttttttaggtgaaaaaaatgatgattgggtgattgaatgaaaatttgtgggagtatttttttaaattaattaattttttcatcgttttttccttttatta

SEQ ID NO: 64443 - DNA, 1596 bp, Heterodera glycines
  misc_feature (604)..(604): n is a, c, g, or t
  Genomic contig location: Contig_ID=SeqID_933; Location=1732..3327; Strand=+
  SCN-specific regions: Sequence locations=1-139,168-612,635-879,901 -1596
atgaccaacagctcactgaaaaatgtgctcacatttgctaattttatggacgatctttttttggactacaaaaagaacgacaaaatgggttagttgagttcaaaagttaaccaagaaaattttgacgaagaaactttagtttatttttttaaaattgaaaataatttgctcaatttttataaaattcttcgtggattaatcaatctgaaatttagcaggctgaaatcccttacgttgacatattttcctgcaaaatttcaagcattctgaaaccaaaaaaagaatatttaaaaattaacgtgccaaaatccttgatttttagtgccaaaaaaccacagccctactgataaaataacagaaaattttctatttcgcagattgctcatattttgtagatatttactccttctttaatggttgtaaaaagaattttaaatcgatttaatttgatcttttgttccagcattgaatacggtaataaatttgacacaatttttcagattccgtcacaaatgaggcaccgtatcccagggacggatactgtgagaagcaaaagcggacagtgtttaatgtcacatttgttaaatgggccgccgaacttgcncatttccatggcaaaagcagtgaagaagaatatccgaattttaaattggtctctaaggaattattccgctatgaattcgttggatttgatggctttttctattttgaccaattgcttggccagcaaatcgccaacaaattcaaaaacgaatttttttctccccaaaatccgatggcaaacgttgtgaagaaccaaattttgcaacttaccttatcattggctgcgcgaattctcctctgtgtgatgttagtggtgaattataaatttatgaaaatgaatgaaataaaataatttttctgtataaatacgtaaattttgggaaaatatcaaatcgaaaaaattattgaaacatttatttgatttaaaatttgctattttctattaaatgattcggaaaataaatttatctttcgaattattataagcttaatttttagaatttttccatttcaaattattcaaattggagatggccagcatttgtggactcaatttttaagtccaactcaaaattgggtagaatacgatacggaacaacagcaatatattggtaaacttttgaatttttatcgaaaaattatatagcaaaatttgagtttttcaagagatggattcacagataaaaatgcataaattgaatttaacgaggattttgcaaaaatttaggcaattaactccacccccacaataaaaatgcataattatttttagacaattttaaatttatcctcaaactttctgagtttaaattgacatattatgaaatgtttaacgtggtcgacacaataatgaacagagaaaatgaaaaaaatggtcgaagtcagacatcaccagcaagagcactttacacatttataaagctgcattttgcttcattactaccgccaccatcattagcattatcattagcaaacggagcgctgcggaccaatcagccagggtcgggggcttttaggtttatgatttttaatgaaaacatcagaattaattaa

SEQ ID NO: 64444 - DNA, 1511 bp, Heterodera glycines
  Genomic contig location: Contig_ID=SeqID_7316; Location=1300..2810; Strand=+
  SCN-specific regions: Sequence locations=1-239,261-269,291-709,731 -743,765-1511
atgaacaaaatttccttgctaaaattggcgtccgaaatattcggaataaaatccgaacaagttgccaagacaaataaagacgattggaaaaaattccagcaactcgaaaatgaggtaaaaatcctggaggaacgaggtgcgcgaatatacagcaccatgaatggaaagcggaaaccgcatataaataataaaaattgggttttgtcaatggacaaaccagacgatgttatttttggaggaacaaaatcaataaaagaattgaatagccaaattttaaaaattgaaaaattaccatggtcccaagctggaccaggaatagtagttgatgggaaattttacccgttaatgagcttagaaattgggggcatcatcgaccaatttgacatatttaatgaattttggaaaggcatcgaaagggccaacaaaacaccaaaaaatccagaaaatttggaccaaaattccgaagaggaaaaaataaatatttctgaaaattcagtaaaaaaatctgtagaaaattcagaaacaatccaatttgaaattattggagaaacaaatgaaattgaatttgagactatgtgccaaatttttaaggaagagcgaaatgtccatggtaaggactccgtcaaaagaggcgacgggcttttgaatttgaaggtaaaagggtcacaaccccaagttagaaaaatgtcccttaagggaattattaaatggacaattttggcaattttcatcctttttggccatgtcaaaggcatggacaacaccaaaaaattggatgagagcatcatcgacgaattaagcgatgatggtgccattgaagaaaaggacgaaaaatcacagatgcacatgagcatcctcaattgcccgcctacaaccagcaatgcgcctcaaattcaagccgaaatcggcacactcatacaaacccaaataagcgcaatggccgaaaattggctgcgatcggcttttcagcaagggccaatgaatgaagcaacaaataaaaaaggaaatggcggacaaaaaatggggaaaaaaagggcatttcctttttcccaatcaacggcagaatcaggcgaaagttggaggaaagttggaaaaacgggcgcatcacaatggcagcgaacccatgaactgactaccgccgcagcagatgccgtcgaggctttggccgaacatcttcgcgactacaatgttgccgtgtccattctcctggtcacaattgccgccggacttgccgagatgaacaatcactacaagggcaacttcaaagggaacagaaagtgaattgtcggccgccggagtgtcgctaatttcatccttagcgacgaaaatttaaaattttatgattcatctgtttaaaataatttcacgccaaattcataacctttgtgattttaagcctttttattagtcagcattgtttacatttaaatttctgtcagcccgcctatgtaaaattgccgtatttaaaccattgcaaaatcaccattttttatcgttcaaatcgttcatta

SEQ ID NO: 64445 - DNA, 171 bp, Heterodera glycines
  Genomic contig location: Contig_ID=SeqID_34724; Location=114..284; Strand=-
  SCN-specific regions: Sequence locations=1-127,149-171
atgttctacgcaccttcaaagtttggcttttaccatgcttttattgcctccctttctgttattattgtttctgaacttggcgacaaaacatggtttatcgcagcggtatgtttccaaatgcaaaacatttaaaatctcaaaaattactaattttagccaaaaattcaataa

SEQ ID NO: 64446 - DNA, 77 bp, Heterodera glycines
  Genomic contig location: Contig_ID=SeqID_34724; Location=870..946; Strand=+
  SCN-specific regions: Sequence locations=1-77
atgggccaagctctaagtgaaccgatcacaaccaaaaacagcgcctcttgttccaatgatcgctattttgtcggcgg

SEQ ID NO: 64447 - DNA, 596 bp, Heterodera glycines
  Genomic contig location: Contig_ID=SeqID_34725; Location=387..982; Strand=-
  SCN-specific regions: Sequence locations=1-39,61-87,128-385,407-596
atgaaaaggagggttagcttctgatttatgcagtaaaaaagttccacaaatttttggttggacggcatttttcactgcaaaccggatcccaaacctttgttggccatttttggcaacaaaaagggggataaaagcttgcaccacaaatcgattgcagcgctgggccatcatacttttagggtacgacttcaacatcgaatacaaaagcacgtcagaatttggacatgccgatgttttgtaccgactgatcgcaaaaacgccacttccggacgatgaacgaattgtggcaagtattagcactgctggaagttttgtgctgaacgccatcgaaaaagggctcccgattgtcaatgaggatctgatcagagccgctgatcaggatcagacaattcagaaggtcaaaaagttcgtcaaaactcaatggcccaacaacccccccggaaaatgacccgaagagcaaaaaaaaaagtcttcggattccccgctccgaaattttttctggctacgggcttgcggtcaactggaaaaaataagcactggtaagaataggggtttgagtgaaaattagtgaaggaaattgatgaaaatttaataaa

SEQ ID NO: 64448 - DNA, 238 bp, Heterodera glycines
  Genomic contig location: Contig_ID=SeqID_34725; Location=1..238; Strand=+
  SCN-specific regions: Sequence locations=1-88,111-138,164-238
actttagaagaagaaaaaagtatgggaaggcacaaccaccaggccaccgacgctcacattggctttacattctttgaaaatgatattgaaaaggcaaaaaggaaaagcttcatatctcggccagaagcttcatttagcaaaaataaaaaaaaaatttataatacaaagggggggggtaatctacctaccctgaaagtttcattcggaagtcccatggtcacttgggtacctctccttt

SEQ ID NO: 64449 - DNA, 304 bp, Heterodera glycines; identical to SEQ ID NO: 53844
  Genomic contig location: Contig_ID=SeqID_34726; Location=172..475; Strand=+
  SCN-specific regions: Sequence locations=1-304

SEQ ID NO: 64450 - DNA, 277 bp, Heterodera glycines
  Genomic contig location: Contig_ID=SeqID_34727; Location=398..674; Strand=-
  SCN-specific regions: Sequence locations=1-40,139-156,178-185,212-277
tttgaaaattttcattaatttattagctttaacttttgggttttattaaataaaaacctaaataaaaatttaattatttaatattttcacttgaaataaattaaaatttgattttttttttaattttttgaatttttagaaattcccgattggtcccggttcccggtcccggtcccgaacaaaaatcgaggtcccggtcccggtcccggcttctcaggtcccggcaagtcccggtcccggttttgcccaaaattcccggtcccgctctactctagtt

SEQ ID NO: 64451 - DNA, 80 bp, Heterodera glycines
  Genomic contig location: Contig_ID=SeqID_34728; Location=300..379; Strand=-
  SCN-specific regions: Sequence locations=1-21,69-80
gtcctgcccataatatctgttgcatggaataaattttggaactgcgctgcctaacggcggtgcttaaagtgcgctaaaaa

SEQ ID NO: 64452 - DNA, 387 bp, Heterodera glycines; identical to SEQ ID NO: 52041
  Genomic contig location: Contig_ID=SeqID_34730; Location=97..483; Strand=+
  SCN-specific regions: Sequence locations=1-82,116-138,160-387

SEQ ID NO: 64453 - DNA, 453 bp, Heterodera glycines
  Genomic contig location: Contig_ID=SeqID_7317; Location=256..708; Strand=+
  SCN-specific regions: Sequence locations=1-28,50-358,382-453
  Gene Ontology: Mol. function=protein binding; Cellular component =nuclear speck; Biological process=protein amino acid phosphorylation
atggcctcctattggcgtctgaaaagcattgaggagtacgagttggaaatgtccacgaaaagcaaagagacacgtcgctatgtgttcaactgtttggacgacattggccaagtgcaccttccgtccgacttggacgacatcgaccgaatgtgcgagcggagtgaccggcttgaatttgtcgacattctgaagcaaatgctgagcatggaccaggtacagcttgaactccttattggactcaaacattgaccatcacaattctcaacctttttaatttaaggaccgtcgtctgacaccgacccgcgggttgcaacacaaatttgtaaaaatgacgcatatgatcgagatggggcgcactaaatactgccaggtaatgaacggttaattgtaggcaacatttgcaatttagtcacataatttggtatgaatgtgttttctcccatcttgacatga

SEQ ID NO: 64454 - DNA, 99 bp, Heterodera glycines
  Genomic contig location: Contig_ID=SeqID_7318; Location=3440..3538; Strand=+
  SCN-specific regions: Sequence locations=1-28,51-69,91-99
agattccaaccattttatcataaataatagaattaactttaaattcatccgacttttgaatatgcgcatttttggtgggcgttaaacggggtaattgac

SEQ ID NO: 64455 - DNA, 1738 bp, Heterodera glycines
  Genomic contig location: Contig_ID=SeqID_7318; Location=1316..3053; Strand=-
  SCN-specific regions: Sequence locations=1-275,297-545,567-971,994 -1047,1080-1143,1167-1467,1490-1506,1529-1738
  Gene Ontology: Mol. function=mannose binding lectin; Cellular component=integral to membrane; Biological process=ER to Golgi transport
atgttcacaattagaaagacatctcttctccgtctgtgcctttttgcttctttaatcactcatccgttttctgttctttctgacccaacagccgatgccatcgacggcatttcggtggcagaaatgcgtggatttctcaaacgggagcatactttcgtaaagccatatcaatgtaagttttttttcgtcattgatacctttctaattggcggatggctaaaaaaaatatgttaaaatacagtatatttttcttttttccagatgctgatagtgaccttcccttctgggacattattggcaatgccattttaactccgcagtatatccgtcttacatccgatttgcagagtctcagtggtggattgtggaataaaatggcatgttctatcttcagtaaaaataaaaaatattcttaaaattagcccaacaccgcgcgagactgggaatttatagtgagtttccgagtgcacggatcgactggctctttgttcggaggtgcgattgctgtcctttcttttaatgtttgtattttcagatggaatggccatttggtatgttcaagacccggatacgcttggccctgttttcggctccaaagattatttccgaggacttggcattttcattgacacttacagcaatcacaacggacctcatcaagtaaaactcgtgaaatcagaagcaaaatattttaactaattgagcattcgcatccgtacatttcggccatggtttccaatggctcgcttcattatgaccatgacgtggatggaactcacacgcaattgggcggagaacacaatggtaaaactggctattacactttgaattgtttgtttttgctgattaggttgtgaagcaaagattcggaacaaagaccacgacacgcaagtgttggtccgttacgtggcggacactctttcggtaatggaccatattttgtccttttgttgctaaatcctctggctagtccatcccaacattgtttacaaaaggtgttcacagacattactggggattcgcaatggcatcgctgtttcactgttgaccatgttattttgcccacaaattactatttcggaattacagcagctactggagaactttcaggtaagaaacggtggcgcttgataaaaaaactcgcctttttaatttttgttaaaaaccaaaaggtgtacgcttttagtttgcaaaattgttctgtcataataaatcttgaaaagtccttcccgtggaattttcggggtcgttagtcacgaacatgatattattttgtcaaatcgctaacccggattaaaaaataagttgaattcaaatttttcgattttatttttttgttcggcatccgaaattggttgaaacagatgtcagattcttgattagtgacctggaaaatccacgggaaggaataattttcacggttaaaatactttaccaaacaatttgccaaccaaaagggtctccctttggttttaataaaattaaaattcacaactagcgccgaagcagtcaaaatgtttgttacttaatacatacaaaaatagacattttttatcaataggacaaaaaacgaaagttcacctttgagatagatttaggtaactgggaaaaatgctcgtctcctttagataatcatgacgtattgagcatccgaatgtttgagcaagagttcgcccgagtggagaagccatttgagagtgccaaccgtgactcggtggaacccttcgcagaaaagtaa

SEQ ID NO: 64456 - DNA, 629 bp, Heterodera glycines
  Genomic contig location: Contig_ID=SeqID_34732; Location=97..725; Strand=+
  SCN-specific regions: Sequence locations=1-417,440-629
atggccaaactgcgcaacttgtgctggtcggtttcagcaatgaccacaaattggtgccgaaggaaacggcggtgggttcagtggcaaatgagcaaagcaaaagacaaattggcacaatttagccaaaattggcggatttgtggattgatcaattaaataccagaccaggcattatacagatgcccaaaaaacccagaagataggtccaaatacagatcagtagtgttttttacaatctgtgcctcgttaattggtcattaattaatctttcagtggttcggtttctacaccgacaacgacacacaaacgatagtgccaatggagcagactgaactttacaagcaggtcattcactcatcactcactcaccgatcaatgaatcaatcggaatatgaaacacaattaaaccgatcaaaaactgatcagaaaagcattgatttactttttaggatcgcattggactgaaaacgctgaacgagtcgaaccgtctccattttctgactttcaacggcgaacatctccaaatacccaccgatgtatgcgtatgagggggtttttagaaggaaaacaaaatacgaaaatgaaacacgaaaccaattaaaaatacaaaaagaaagaaaatacataaa

SEQ ID NO: 64457 - DNA, 145 bp, Heterodera glycines
  Genomic contig location: Contig_ID=SeqID_34733; Location=469..613; Strand=+
  SCN-specific regions: Sequence locations=1-98,120-145
  Gene Ontology: Mol. function=GTP binding; Biological process=tubulin folding
atggtgatgctaacagtgctaaaaaaggcaaggagaaaggagcaagaaatgcgagtgctcattctcggcctggacaactcgggcaaaacgacttttttgaagagaatcagtggagaagaaattggtgaaatcgcaccaacctttg

SEQ ID NO: 64458 - DNA, 659 bp, Heterodera glycines
  Genomic contig location: Contig_ID=SeqID_34735; Location=164..822; Strand=-
  SCN-specific regions: Sequence locations=1-346,368-499,526-608,651-659
aaaaataaatcgatttttttcaagtgtccgttttggggtactcaaacaatttatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 64459 - DNA, 1013 bp, Heterodera glycines
  Genomic contig location: Contig_ID=SeqID_34738; Location=100..1112; Strand=+
  SCN-specific regions: Sequence locations=1-98,122-149,172-349,391-1013
atggaagaaacaatttggcattcgatatatgagaataacggagaaagaaaaaatgaaaatttattggcaaataaaaaaagaaaaaccaaaagtgagtgataatgaaattgctaaaattgtgaacacttcaaatgcgaatatttgtaattggaagaaacaatttggagaagaaatgtttgagaattgaaaacggatgattttttaagaaaattagtgacaaagaaattgctaaaacattgaaaattcgtcaaaatagcctccgaaaatggaagaaacagtttggaagagaagaaaaataagaaaaaatatttgaaaattgattagaggaagaaaagtttagaaattttttgaaaaatattagatttttcattaaatctgaatccaatttgtaaatcgcattaatttgctgattattattttagtgatcgtcgtcaaagttttataaaatcagttccttcatctatgggagacaacattgagcaatgagtcgatcaggttgcttgatcagtcagtccttaacaccatgggaaattttctttcgactgagaataactgaaaacgataaagtatttgcaataagaaagttggttgagggagaaaattttcaatttttttgaaaaatattaggcatttcttaaaatccgaacagaatttgttaatttaataattgttagctaatcaaaatataatgtgaaacctgaaaaagtgtgacaagtaaagtctaaaaatattgaaagtttatcgacagggattgtgactggacaattcgacagtggacaatccgacagaggtggacaatcggacagagatggacaattggacaatggacaatccgaaagagatggacaatcggacagagatggacaattggacaatggacaatccaacagagatggacaatcggacagaggcggaccaatcggacagagatggacaattggacaatggaccaatccgacagagatggacaatcggacagagatggacaattggacaatggacaattcggacag

SEQ ID NO: 64460 - DNA, 1015 bp, Heterodera glycines
  Genomic contig location: Contig_ID=SeqID_7320; Location=816..1830; Strand=+
  SCN-specific regions: Sequence locations=1-37,60-77,99-193,273 -349,372-396,418-453,476-612,639-643,665-1015
atgcgcgcgaaatttgcgacgattgaaacggggaaaaaggaaacaatgacattttttaagttaggtgaaatttagacaaaaaaaattaaaaataaaaagccagactgttcatgaagtagcaccatttatggttggccttgtttctaagaattgtgtgtatttattttaagtaactcggagaaatttcattttgttaatttttataacaaaatttcgtaaatattttttcaaaaattcgtattttttacaaaaattacaataaaaaaaattaacaatttacctgccattactgctggtgatcaatttttgatcatttctctgttcattggaggcatcgatcactttttggtttcttttattatttatttctttaactttaatggagaaagctttttgaaataggcaatttttaacaaattaatcaacctctgctcctaaggctttttttcctccgattaaatggcattttaaaaatgttgacaagccaaaattccgttcggcatattcccagaattaaatggggaaaattaattctcgaatgaaaaaccacctgctgctaagaatgtgtgtgcgctgctgcactatttgtttgacaggtgccaaattaaaacgaaaatattttttaattaatttttaaagcggtaaaaatgattaatgggaaaaattgtcaattttgaattccgattatggaacaacatctgtcgtaaattatacaatatttatttgtttaattcgaatagtcttaaagcaaaactcaaaaccattgccaaattctgatcagaaatggctcgaggaaaaatgatcagacttttgtattccaagatatgacggcttgaaagattccggatcaagacgggatgttagaattcgaaccggactggatttctgggttaaaaatcctgttttcaggactcctggtccgagccaactttcaaaaacatactcggatcggaatcaggaatccggaaaaaccctgacaagacccggtcttgtttcggcctcaagacgacaatga

SEQ ID NO: 64461 - DNA, 3147 bp, Heterodera glycines
  Genomic contig location: Contig_ID=SeqID_7321; Location=628..3774; Strand=+
  SCN-specific regions: Sequence locations=1-30,52-128,159-290,312 -524,695-747,770-793,847-914,937-964,996-1112,1140-1367,1531 -1580,1602-1632,1655-1819,1842-2055,2080-3054,3076-3147
atgccaaagatggacgagaagggcaattattggaaaatctgtacagtaagtgaatgggtaattaattaatgattgctaatttgtaagcaaaaatgtgaatactgtaaatgaccgaatgatgacggaagttaattaataattattatgataataaatttggggaaaaagtgagtaaaattttaaaaatgcaaaaagtttaataattttttaagtgcgcttttacgtcaaatttttgctgttttcatgtaaaagtgctttttgtttttgtttttctaagttttgttttaaagtgcgtcagaattggcatttcaaaaaattgaactgaaaaaaattgcttaactttttgtggaaagaatatcaaaatagaaagcataatccgaatggataaaagctgcattaaaactgcaaaaagtgggcttcttaaattatgctcaaaatgcactgaaaatggaaaatatgtgtagtttggactgaaaaaaataataataaacaagttatggatggtatcatagcaaaaacatagcaaaataaaaataaaaatctaaaacctaaaaagtaataaaaattatatatttttttatttttttataaaatttttaaattattcattttaaactttttgaaaaaaaaattctataaaatgcttaattttttttaattttatcatcaaaaatcattagatttatttttataaggtttccttctacgttatgccattaatttcaaatatttaaaacctgatcaacgaaattaaatttaaatcaaaatttgaaaaaaaattctctttgtccccttataaataaaaatatttgttttaatagaaacaaaaatatttctttaaaatatgcaaaagacaaacaaaaattatgatgaatatgtaaatttttgttagcagtgaaggaataatgaccaccaaaaaatttaaataataaatatgcaaaaataatgagacaataaaatactaaataaaaataataataataataataattatacattttctgtttatttgatccggacagtggccaattcggaggacgaacaaaggcttaatctgttggccaaacaaatatataacaaataatcggcactgattttatgcctattgtctcccattatttttgttattatttatttcttttgtgggttacagtagctaagcgggggcactctgttgtttatttgaacaaatttggcggcgagtcataatgccaaaagtcacaaaactatttttgttatgtgaaaataggcaaaaaaaaaattggggcagatgagaaaacaattacaaagcttaggtatgttataaaaagtgtgataattcctctgctgacagcagcagagaacgcattgtttaataaaaaaaaataaatttattacaaattatttaattaattattaaatagaattaattttataaaaaatagttttatttaattatttatttagttactaatttggaataattgtttttattaattttattttttatattatttaaatttttataaaattacttttatcaattaattttaaagaatttttattcttttatcattagccttataaattagtttctaagcttgttttatttatttacattcataagttcaaaaagatatttttttaattggcaatttaaaaaatttaaatttttgctttaaattggcaaaatgttccgctgtcccttcctcctcattgtcctcaatttggccattgcgctcctctgttttttgctgcgccttttgccctcaacttcggcacaacgcctggaccgctgtttcgacggcacaaattttgtcccaagtgggttaaacggaggtcaagattatcggtatcatttcaatataacatttcatggcacgtttaatccccagaaatattttcctaaaaaattatgaatattgatgaatatcttttgaatttatggcttctattccagaatatattcttaatatggaataacggtaattacaatatgacatgtaaaagacgaaattatattactagggggatacggtagattcggtttttggcgctatttgaataagtagaatgttttaaaatttcaaatttttctaacttaaaagtcacgaaaacgacaatttatctgtgtctgtgaatatgctacgattaagcgatttcctaacctcctaacagtatcccgcacatatggagttacggtagtgtgtgggatggattacggtggcagcgccgtatttctttcgtccaggcgctcagagctgcacggacgaggccgacccgttgaccacccagagtcccaccgtcactgcaatgccaatttgtgaagcattttttgataccgaaccgaccgcaacggatgtgacggctgacacgcacccttgctatatgccgggtaaaatttccgaattttaatttttggtttttgaatatttttttagacaataagccaatggccagcaaatgccgacgccgatgcaaaacttgctgcttgttgccaaaatatggcagctgtgaaggtacaacaaaatgccttcttatacatacgcggcacagtagggatgcttgagagcgagcattttccgaggctcgaaaataccgagacttttctcgagtcgagaccgatacgctccagcatcactactgcacaatagtcctattggtttgattattaatgttcgttgatcgaaaatttcccgtgactctcgagcatcactcactactaatgatgcctatttaactaattataagctctttttagctaatgatagaaatcaacattgaatataatgcaataatttcaaaaaatgaagaaaatccctcagatggcacaacctcttccaatctcctggattagtatgtaatcgcaattttttgtgccattttttaagaccaacagtcggcacaggcgaccactccccaagtgccgtgcaatccgtccctttgttcggtggagaaatttgcggtcaaagtgtgcccgcgcacgtgcggacgatgcgtggactatttgcgcagcatggagcaaaccaaatattgcgacgatacggagaatgttgacaactgtatggtgctgaaggtggccgggggaatgaggacgaatttgaaaatagtggcaatggcatttagccaaaaaaaaaactcaaaatttgaatgctggcaatgacaata

SEQ ID NO: 64462 - DNA, 315 bp, Heterodera glycines
  Genomic contig location: Contig_ID=SeqID_34742; Location=73..387; Strand=+
  SCN-specific regions: Sequence locations=1-55,92-100,123-129,152-315
atgtttcaaaaggaagcgacggaaaatgcaaatggcaaaattggtgcaaaaagtagggaaaaatatatttttgaaaaacaaacaatctttaaagaattcgtcaaaatgaaaaatgcaattttaattcactttaatttttaaaataattttagcttctgctgaaaaggatggccctgtgctgctcactgacgtcgatgctgaagcgtttaaagtgatgttgcgcttcatttattcggatgatttgagcgaattgaatgggcaaaacgcaaccgaagtgctttatgcgggtgaataattaaatttaatttggtttaa

SEQ ID NO: 64463 - DNA, 972 bp, Heterodera glycines
  Genomic contig location: Contig_ID=SeqID_34746; Location=1..972; Strand=-
  SCN-specific regions: Sequence locations=1-85,132-272,294-316,363 -530,553-596,638-972
acgattttcatgagcatcgatgcaacagagaatgttatgcatagaataataattaaaaacagtagtgacagcaataagaaaattcaaaaattttattcaataaagaaattattttaaaaaatgataaaattgataatagtttgaaaataaagatgttaaattgagttattttagagatttttattaaggcaaaaagtctagaaccttcaaaattagaactttcagcctaaaagcaaaaatagatattacaataataagtttttcaaatgatccaataaaaaatattattttcttaccaattaccatattttaatggatttttaaaaataaattttgaagaaaaataattttatttttttattctatttgtgaaaaattcttttttgaattcaaataaataagaagatgagaaaaaaattggtatttaataattttccagaataagatttcgagaaaacataataacatcgaaatccagggaccatgacatgtacgggcttcgtccagcacatcgcttctttcaacagcacccagcagtgaacgactgtttggccaatctgttggccagtggccgtattacaattaccgtatgaaattaattataatattattattaataataataaaaatagaaatatttaataggacgacatttccaccattggcgaacactcaatttgtgtaaaagatggacgtgaattcagtgcagatgtgatcattttgtgcaccggatacaatttcggatttccattcattaggccggcagaattaattcccatcagagtaaacattttaatagagttttaatgctgaaaatatgaataatattgctccggggcttcgggtataacaactccgcctagttgtccaaattgaatgcaatttgatatcattcaatagcactaaatattctaaattagcttgaaaaattagaaaagcgtttaaacagtttttgaacttacattttttggt

SEQ ID NO: 64464 - DNA, 427 bp, Heterodera glycines
  Genomic contig location: Contig_ID=SeqID_34748; Location=1..427; Strand=+
  SCN-specific regions: Sequence locations=1-152,174-301,325-427
  Gene Ontology: Biological process=tyrosine catabolism
cgtctctgaagcagcggctgagcgacgcgggcgtggactttaaggaggacttggagaaactgagggagctgaagattctggtcgattttgacgagcagggctatttgctccaaatattttcaaaggtaaatttatgaaaggggaaaacccgaaaatgaataatgaagcctaactgatcaattagttgattaattaagccatgccaagaccgccccacccttttcctggaaatcatccaacggcacaaccaccaggcaagtgggcacaatgccaatgtcgtcggcgttaggttgccaatgccaaaatgaccaattccccccagggctttggcgccggcaacttcaaagcgttattcgaaagcatcgaggcggaacagaacgaacgtggcaatttgttctacaaagacgtggcggtgggaggagaaaaa

SEQ ID NO: 64465 - DNA, 773 bp, Heterodera glycines
  Genomic contig location: Contig_ID=SeqID_34749; Location=9..781; Strand=+
  SCN-specific regions: Sequence locations=1-664,686-773
atggccgagggaaaacactcagtcaacgacaaaaacggcacttccgttttgcagaaaagcgacactcgcaccgattgcatcgatttgcgatgtgacggtcccatcgatcagtgcacggaaatgctagcgggaaaggtaaatgggaaatgaactgttagaaagcgttttaatgaatgttgtttttctttacagatatttgacctttccttttggaacggtgccgaacaatttttggctcaacccgcccctttggggggttacgaaatgtaatttttgctcttttggctgctaatgacgaaaattcagagttcggaatgcgctttctcagcacattcgccacctgctgggcgagtccgtcccctccgatcaacttttgctcgtgccaaatgcgtccgtcgctttggagctgttcgtccgctgctgctgttcacccggcggtgatttcctttggctggcttttcttcaccctcccacagatgtcgtcctttgtccaattccctttgccgatgaattcctgtcggaggaattccgttcaaattcctccattgactttgttacggtcaatttcccggtacattttggcccttctactgatcagaggcgcttcctatgatttccagtggaattcgtctcttttgaactgtgccgaattacaacagacaacggaagggctggggaaggtgggccgtgtcattggtccgttggctgatcagccgaatcagaggacgaaaatcattgaaaggaggcggaacaaaatgagagaaactctttaa

SEQ ID NO: 64466 - DNA, 996 bp, Heterodera glycines; identical to SEQ ID NO: 34751
  Genomic contig location: Contig_ID=SeqID_34751; Location=1..996; Strand=+
  SCN-specific regions: Sequence locations=1-106,136-417,441-852,877-996
  Gene Ontology: Mol. function=transmembrane receptor activity; Cellular component=plasma membrane; Biological process=cell surface receptor linked signal transduction

SEQ ID NO: 64467 - DNA, 350 bp, Heterodera glycines
  Genomic contig location: Contig_ID=SeqID_7322; Location=214..563; Strand=+
  SCN-specific regions: Sequence locations=1-350
atggcgtgcacaacggagagcaacggaatcagctacagcatgttcaagactgcctattgcctctatgtcttccaaatgaccaacgcgcaggaggactcgccaggatttgagctgatcaaagagggctgtactgcagtgaacatccgattcactgaagcagtacccaacgagggagttacattgattgcgtacggagaggcagacgggctcattcttattgatcgtaaccgttagatcactagtgacctcacagtatgagtcagaattattcctctgaaaacattctgatggacacgcctccgagggacgggatagtgatgtgctttcccgatgttatcgagaagtcgcca

SEQ ID NO: 64468 - DNA, 572 bp, Heterodera glycines
  Genomic contig location: Contig_ID=SeqID_7322; Location=1037..1608; Strand=-
  SCN-specific regions: Sequence locations=1-572
atgaccgtcacatccaacaccgaattccgactcatcgaatgtgtgccaatccttgaggaagttgctcgtgaatttggctgtattacgccactaccaaaccttgggtatgtttctttcgttttacaacactaactccagcatacagtagccatcgtgactatcgtgtaagcggatgtatgatgattcgcacgctgacatcgttgaatcgactctacattttcgatgctgaagactgtattgaggttaatggaaaatatgtttcatattttattgctattttaggtgaagggtttcttaaggcaagaggacggcacgagccaaaaagtggtcaacgaatattatgaaaaatatgatggactaaatggatttgctgaatttattcggaattgggcctttacttttttctgtttccatgcctttgatgatgatgacacatctgatgaagactaatttcgttaatatttattctatgctctttgttacaaaccgataaacaaatccatcagggttatttgaacgattcaaaatttgcataatattttcgaaacccaatccgacggacataaaataaa

SEQ ID NO: 64469 - DNA, 327 bp, Heterodera glycines
  Genomic contig location: Contig_ID=SeqID_7322; Location=1709..2035; Strand=-
  SCN-specific regions: Sequence locations=1-171,193-195,217-327
atggacgaagaactgaacaaaaaggaggagccgttcactctcgccgaatgttgcacagcatttgatctggttgcggttatgttcgactgcaaaattccggtgccgtacgaggaggagcagaagcgttacgttttcgagcaccaggacaagccgcgtttcatctacatcagcgaagaaggagaccaaattgagttcaagggaattgtcaagcagtttggatacgtcctaagcgttgagactatctacttcgacaaagaaaagggaattgatgaattctataacttcctccgtaacaatgtcatgtgtttcttcagtgttgattcataa

SEQ ID NO: 64470 - DNA, 1230 bp, Heterodera glycines
  Genomic contig location: Contig_ID=SeqID_7323; Location=1014..2243; Strand=-
  SCN-specific regions: Sequence locations=1-138,160-418,442-907,929 -966,999-1230
  Gene Ontology: Mol. function=3'-5' exodeoxyribonuclease activity; Cellular component=nucleus; Biological process=nuclear organization and biogenesis
atggccgactttgccgcagtttctgtccaaattgatgccgtcctgctgtcggcactcattgagcgaccgttgcgcaccgaactcccgcacatttgccacttgtcggacgtcggcgcaatgtttccgaacatcattctgaccaacctcatcgaggaggtgtgcatggcgtgcattcacaacgtgccggaagcgaagtgcaaatgcccgctgcagtgggtgtggcgaggcgaaattggtcagtctcatcaattagcgcgctaattacccccataaataagtgcactcagtcgcttaacagtgggcgtcagccgaggcggtccggaggggagggggggggagtatttggatggcatttgaggggcatactgtagtcatgggctaattgtaagtttatcctttttttaattttaaatgatgccctcaaaatgaatgtgtacatttgcaggattttgtcggaatgcgttcaaacggttgcatgacacggaagaagttcagcagcagcggcggatgaccgccaccaccaccatttgccatcgcaaaaacccttctctttacgtggacactgatgagcccacatttcgctacaaatacaaacaaatgcggcggaaggtgtgctgcagcgggtggaaaaaaaattattgggaaaatttaaagaattttggcacaccattccaatcactgtttggagttactatagtctaccacccacaaaaaaaatgaataaaattgatgccattcgttctctcatggcctgtaatgctaaggaaaaatactcctgaggtgcggaaatggcaaaaaaaaaatggtttttgaaccggtttaaaattcggaaaattgaacaaaatggagcacttctataaaatggtcaaaaccggacaaatttggtatcattcgacagctattgatgagtaacgtttaaaaatgggtcggggtcggtttagtacgagcgcaagtttttggctataacttttttctttgccaacaaaatccaacatttttagtatcgttcgatagccctaagtgtcctctattaatctgaaaaattgcgaaaaattttgttaagcttcaagaaagttatggtcagaaaaattcaaaaaaccagattttcaaacttttttggctcaaactttttttaaacttaacaaaattttttgaaattttgcaggctaatagagcatccgaagggctctcgaatgatatcaagaaagttggatttggataacaaataaa

SEQ ID NO: 64471 - DNA, 219 bp, Heterodera glycines
  misc_feature (91)..(91): n is a, c, g, or t
  Genomic contig location: Contig_ID=SeqID_34752; Location=455..673; Strand=-
  SCN-specific regions: Sequence locations=1-65,90-219
aaaaaataggaaattttgatcatttataaactgtttttcactgaaaattagccaatttataggtaaaattttgaaaaattttatgggaatntaatccaattcttaggggtgtaaaagtcgcatttcgcgccaaaaagcgaaatgcgaaatgcgaaacgccaaaaaatgcgaataatgcgaaaggcgaaatgcgaaaagcgaaacctaggcacatccctg

SEQ ID NO: 64472 - DNA, 77 bp, Heterodera glycines; identical to SEQ ID NO: 58904
  Genomic contig location: Contig_ID=SeqID_34753; Location=378..454; Strand=+
  SCN-specific regions: Sequence locations=1-77

SEQ ID NO: 64473 - DNA, 670 bp, Heterodera glycines
  Genomic contig location: Contig_ID=SeqID_34755; Location=6..675; Strand=+
  SCN-specific regions: Sequence locations=1-300,322-670
atgttgcactttccattaaattttttccagccaaagactgtttcgccgccgaaattcaaaccgattggcgaactgtcggactatcaacagcaaatcaacggatcgaaaggcatgcagggtttgtctattccttttactacttgtgtactatttttcttgaatttcagaattttcaaacattcgattggccactcctccgcctcaaccgtcgccaatgcttcacaatgttccgttacctccagcgatcagtgtcaacgatatgatggtggaccgcaattacattgcaaaggtgcgttgccacttttattaatgtttatattagtaaatgtctcatttttcgcttttcggacacacaaattttcactcgctatccattaaaggggatacgaattacagaggagcgggatggttggcagggttagacgcaatcgcgttatggattacagaaattacgaaaacccagtcacgttgagccctgttgtacccgttgcacatgtttcattcggtttcaaaaccctattccgtttcatttctctgatttcattagtccgaccattttaaacaattttgtattccaattttttccaacgttctcagggagtctcttcgccgaagttcaaaccgattggcgaactgtcggattaccagcaacaaatcaatggatcgcaag

SEQ ID NO: 64474 - DNA, 418 bp, Heterodera glycines; identical to SEQ ID NO: 53014
  Genomic contig location: Contig_ID=SeqID_34759; Location=303..720; Strand=+
  SCN-specific regions: Sequence locations=1-2,30-32,155-206,236 -236,320-325,358-418

SEQ ID NO: 64475 - DNA, 935 bp, Heterodera glycines
  Genomic contig location: Contig_ID=SeqID_34759; Location=1..935; Strand=-
  SCN-specific regions: Sequence locations=1-276,309-314,398-398,428 -479,602-604,632-639,715-786,854-935
aaaaagctcgtagtggatctgtgctagcgtccggtgcacactttgtgtgttactggttggttggctttctgccggtctttccccggcgttggctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaatt

SEQ ID NO: 64476 - DNA, 3771 bp, Heterodera glycines
  Genomic contig location: Contig_ID=SeqID_7324; Location=30..3800; Strand=-
  SCN-specific regions: Sequence locations=1-14,182-354,376-436,458 -531,553-664,696-913,935-941,963-973,995-1005,1031-1034,1080 -1194,1224-1366,1408-1639,1661-1825,1848-2666,2688-3096,3118-3771
atgaaaatagcattggggaaggaggagagacggaagagaaagagaggaaaaggaaaaattcgaagcaaggagggggagaaagaggaggaaaaggatgaaaatagcattggggaaggaggagagacggaagagaaagagaggaaaaggaaaaattcgacggaaggaggaggagagaatgaagctgaaaagagagagtaacagcagcaaatcgacactttttaattttgccggtcctaataatgctaatggatgtcgtaaatccccgtcaaaatcctgaaaactacacaattttcgaaagaaaaatgcattcattcgattacataggcaaaaaatttatgttgtggcgtgggttttgcaggagcacagcttgttccccaaatcccattaacgatttaaaaaaatcattaaatttctcagggaatttccggcaaatttcaaacaatttattacaaatagagattcttagaccccctaagaatcggtcggggccgttttcgcgtgagtagctgtttaggactgaaattggtcggatttgtgcaaaacatccatgtttcgaatccgaacccgcattcggacaaatttcttaactttttaatttttttatttcttgcggctaatatcttctacagtaatttgtcagtttggtcggatgtgcgtcaaacggaaaaaataattaaaattttataaaaatataacaaaaatcaaagaatttattcaaaaaaagaggtgttcctaaacatatgaccatgacttcttcaaaagaattgaacaaaaaaaagttttgcctatttcactttacgaggatttttttccaaaaaataaccatttgaaaaatttttatttacatattggggtttttgtacatattttgggatattttagttaaaaaatgacaattctagaataaaatctgataaaaacttgtgctgctccatttttcctaggtcaatgacttcttttaaagaatttttttaatagcctcaaacaacaacaaaaaattgactctaatttttaaaattaaaaaaattaacggtagttttaatatttgccaaaaattgcgcaaaattttccaacagttgcagcctctattgtccgtcccatgtaaagcacttttaaagtggcatagattttaccggtgctagggcgttccacaaaaaagctcagtgtgggcgttccacaaaaactcagtgatcgataaaattaaataaataaatttaattattcaattcacaaaacacggtgccgtccggttaacactaatgtacggcgggacgcgtcatttcaaattttttaatttttcaatttttgacatcacttctcgccaattttctccatttgtagtaggcatagcctgacgccattgtactttttttttaatttattatataataaagtttttatttttatctcatttttgccgttttcccaactctttcgcctgcagcagtttgtgcctgtctttttgggtcatacattattcagtttatactttcgaatgataccaaaaaggtagggtttatcgaacatgaacaaagttattgtataaaaacccgggattgacaattgattggactcataaaggtcgattggactcataaactgcactagagcaaaatccgttccctaatcatgacacataaacaaaaagatacaaaaacattcatcaatcccttttcatgtctataaaaatgtttgttttttcactttgtctcgcatttgaaaaaaaaataaaaatttctaacgcaattaattattctgctctttgttgtgtgatatcattcggaactcggccaaaattgtgttaattgccacaaaaatgaaccgacggtaagcaatttgaaaagtcacacaaattcatcattagggatcggattcttagttttttaactattttttctgcggctttaactcgacgagaaatgcacgaaaaacacattctttttcgaaaatttttcatttttagtgccactattcatcactaggaatcactattttggagcttcgccactaaaaaaaactatttcggaagttagccactaaaataattttttgccactattttggcgtttcgtcattatttttgccactattttggcattttttggaaaatttcccaaaaaatgcaataaaaacgaaaaatacaccccaagaatcgacctaaaaatttttcaaaaatacacccctaagaatcgacctaaaaattttcaaaaatacatccctaagaattggaaaaatttcacaaaaattcttcccccaaatttttttttcttgttcaatattttctaagaaaatattttgtaactgcaatcagtgaataaaatctttaattccggattttattttccgagatttctttattctatgcaaagatttccgtttttattgcatttttgttaacaaattttgggcaaaacgccaaaataggcaaaaataggctctttcaaaattttttaggctttttaggcgctaaaaataaaagcctagaaaataggcactaataactcgaaaagtagcttaacaacacccgaaaaaaacatgtttttcgtgcgtttcaggccacggggagctcaggaaaaaaataggcttttgcctaaaaattgcatccctagttatgtatgattttccattttaatcgtttagatagtttgactttttcataactagggatggtaaaaatatgtatataaaatcgcgaaatatggccataaaatatggactaaaaatcgcttttgaagtcattttaaggtcatttagagtcagcaaaaaagtcatttgacttaaattcccatccctagtcataattttgcaaaatattctcctctttggtggtcctcctctgttgcgttcccttttgcttcctcttccaatcggtcattttatgccaaaatgtttccgccccttccgtttttgtcaatgatctttcgtttcccatttaaacattgtccaaccccatttaaggcaaaaaaattcaaaaattgttttaataaaatgtgattttcgtgtttctttcatcaagtacaatccgtaaaaaataggaaaaatctaaaaaaatcagggctctctctattcatatgcaaaaaatattcaccaattcccttttcatgactataaaaatcttttgttttccgctttgactctcattaaaaaaataaagtttccaacgaattattattctgttcttttgtttgacatcattcggaactcgtccaaaattgtgctaattgctgccaaaaatgaaccgacggtaatgaattttaaaagtcacaaattcgtcgtttatttgactaaactgttttctataatttcagttggatttgcaacgacgtttggatggacattttccccagttttgaccatcctcaactcggcctcaaattggcacttctttcgccacgtttcgatgcgttggtggacaaacatttcgatggcaaaagcgaattgacaatttggagacaaatcaaaattcgcaaggacaaaggaccaggaccgaagctgtttgtattgttcaatgacaaatttgtggaatttccgttgcccgacgaccgtccgttgcccagcaaaattcgctttaagcgtctttatattgagtaattcaaaatctgagctatgacaataaaagcattcatcccatttttaggtacatcgatcactccgtcatcgcttttcttcgttccaatcaccaaattttcgacaaaagaggcatcgatttacagttgtggattccattatcatacaccacggatggccagcggatttgggatattttgacac

SEQ ID NO: 64477 - DNA, 138 bp, Heterodera glycines; identical to SEQ ID NO: 50950
  Genomic contig location: Contig_ID=SeqID_34764; Location=705..842; Strand=+
  SCN-specific regions: Sequence locations=1-138

SEQ ID NO: 64478 - DNA, 679 bp, Heterodera glycines
  Genomic contig location: Contig_ID=SeqID_34764; Location=25..703; Strand=-
  SCN-specific regions: Sequence locations=1-60,82-679
tgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaccaattatggggagcaaaaatccaacgcagaattaaagtccaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcgggaggactgccccgaaaac

SEQ ID NO: 64479 - DNA, 291 bp, Heterodera glycines
  Genomic contig location: Contig_ID=SeqID_34770; Location=948..1238; Strand=-
  SCN-specific regions: Sequence locations=1-79,101-124,173-268
atgacgatgaatggttccgataatagagtagagcggtaaacaggtacctaacgtatttaatattacttgaaaacagatctttaaaatatgcaattttactaaaaatatagacaattataaataaattatagaattagaaatgttcaaaaaatttaagataaaaaatgaccatttaccggtaccgactgaaaatgttgtttgttaccggtaccggtttttccagtaccggtgattaccggtaacggctaatgaaaaaccaataccgctcataaaattatttaaattaataaa

SEQ ID NO: 64480 - DNA, 544 bp, Heterodera glycines
  Genomic contig location: Contig_ID=SeqID_7325; Location=2184..2727; Strand=+
  SCN-specific regions: Sequence locations=1-54,78-78,114-186,211-544
cacattctcaatcaacacaaatgcttaactaataaaaaataaatcttctttttggtccattgccatagccaacgcttcatctcccaaattccatcggcggtgccattctccgtccgtctccccccccccccctccggtgctgcttttcctctgctcttccgctgatctcactccctccccaccgtttggtcctcaattatttctcattagtgccattttatgcttattccttcttctctccgcttcatcatccgctgtcattcttcagctgctgctgagtgttttttgccttcgttttcgtcccttttacaattgtataattctttcaattgagcaactttggcattatttcctcctccttgtttgttagcatttgaattagccgaggttcactcggttctcagccagcagaatggccaactccagtggccatgacccaatcgcgcggtggctcactcggctaaggcctcgttcgcgcatcgctttggtcattttcggcgctgtgatgatccacctcagcatcggcacttaccacaccttcggt

SEQ ID NO: 64481 - DNA, 1530 bp, Heterodera glycines
  Genomic contig location: Contig_ID=SeqID_7325; Location=1..1530; Strand=+
  SCN-specific regions: Sequence locations=1-216,238-453,477-587,609 -810,832-1420,1442-1530
ggcatcaaaaaaaaattaaataaaatgcccaacaaactttttctcaaatgcttttgcctttattcggttcagagtacggcacaaatggaccggaggttcgtctactgtctgttcgcgctctctttttttgccaacttttgcatttatgccccctgggcattcaaaaaaatcatttaccaggcaagcaattgatctgattgatgttgaatatctgatgttgccttttggctttgtgccgttcagattccccccggtgttctcagatgccccttggtaatttgcgaccgcaacatggacaccccctggttccgcatctacgaatgggtccgcgagttcctcacgcgtcttttgcccttcgttctcatagcctacttcaacgtgaacattctgatcacttacaggtgatgaccgataaggtcgagccaatcttttgtgatttgttatgtttgaggaccaacaaaaaagaccgtctctcattgtccagccaatcgtttcatcggaaggccgtggtcgagaaaagcgaaaaggtccaacccatcgctgagacaagagcctaatgaatctgatcagttgcaggaggagaagcggctgttcactgtgctgttcgccattaccgtcattttctttctgtgcacaatccccgcggttggccaaagcctattccgttgttgcttcacttttgcaccgctttttcatctttccaggccccggtgaccattttcatctccgatcggcagagccaatcgctgccatttcaggtgggtgaaattgcgtatttacaattggcatttagtggacacaaaacaacccttttaaatcccattttgattttgaccaacagatattccgttccgcctcgaatttgttggaaatcaccaaattcgctcttaatttttacttatattgtctcataaacccaggttcatctcactttgcttttctctaattgtcatttttgcgaattgttaagacattcggagggtttgcctcagagtgttgaaatgcaacggttggacttcgttgtacgaaagagtgagcagcggacacacgctgaggaccattccgagcatgccgaacagcaggtgaaggagcaattaatgggcgacggacgaaacgctaatgaccatcgatcaatttttggtcgggaagcaacaaaaccattttgacaatacggaatgggtctgatcggagttcgcgcgggagcagaaaaagtcggaacagtcatttggccacggaagagagtcaaaggacggacccaccggcggaggggacgaccgatcagtgccaaagtccgatcggctacactgaacggcagacaaaccattcgaaccattcgtcagggcagagaatggccagtcggacaacgccgagacggagcagtgcccgcaacacaacggacagtcatcggacgaccatttgcagcaacaaagacagcagtcattggcacgcgcaattgtgaacggagcgaatggagaaaaaaatgaaaaaagaaaatggaaaggaatttgtacattttgaggagcaataatt

SEQ ID NO: 64482 - DNA, 2614 bp, Heterodera glycines
  Genomic contig location: Contig_ID=SeqID_7325; Location=2784..5397; Strand=+
  SCN-specific regions: Sequence locations=1-407,450-571,594-934,957 -1372,1394-1478,1500-1551,1573-1948,1971-2064,2088-2168,2191-2614
atgctcccttacatggcctcgtacatgcgaaatttcaccgacccatcagtcaaaattgagcatctcatttgggtcccaactttccaaggtttggtttgccagaaagcgcaaaatgaagtgccccttttgctgggcaggctgttttccgttggcaatggtaatcggcgggtttctgtcccaaagggttgggcctcggctggccgctgccattggctgctacacaatgtggtgagtcaatgaatgggtgctttcttctgctgctcattaatagggttgagcgctaccggtaccggccggtaattaccggtttttttggtaccggtaccgaccttctgattttcattatttctcgcttgggttcaattccccactgggataaaatatttttcatatttactttaccattcattattttaaataaaattttaatttaaaaaaaaattttttttctttcattttaaacagcctagaaatcgaaaaagtaaccaaagactgggtcattttttgacaaattctgtaaattaaaaattttcccggcggcgcctatcggcaccgccggcccccctttcttccccaaaagtcttggaaaaaacgcgccgcgaaaaaagcggtgttgaaagcaaaaaaaaaaaaaaagataaatcaatttacatggcggacccagacccccttgtcttgcaaaaaaactgaattttagtgttctttatcctgaatttgaaaaagaagcctggtcaattaccggtttttaccggtaccggtgtaaaaagttggtacctaccggtttttgcattaccggtcagtaccggtaccggttttttttacaattaccgattaccgctcaactctactcattaatcccttagttttcaatttaatttttgcacagtctctaatccaattaagcaaatcatttgcatcgaaattagaatttgtcaaaaataataatttatttatttggttaaaaatggcttttccccaatgcttttggcctgtcttttcccttccgtccgtctgtccctttacttttcattcattctttggccccaattttcagtttgggtgtgctcctctcctcatggacaatccgccattcctattacggctttctgttcacctacggactgatgtttggccttggccagggaatcgctgtcagaaaatgccattatgccaaaactagtccctaattgttcagtatgtgatcgcagtctcttgcgtgatcaattgggcccccaaaatggtcggcctcggctcgggcatcgtcgccgccggctttggcatttcgtcctccatttttgcaccaattcaaacgcgcattgtgaacccgaacaatgtggcggccaataaggacggatatttcaacgatcagcatttgctgtgaatggcattttcatcaattggtgccaactttgctcgcttaggtcgcgtgttcccggattgttcgtcactttggccaccgcttatttcttcatgcaatgtattgggctgttattcatttgcgacccgcctgatgaggtccgttctccgtcgttcgtttcgaatcgtttcttaattacccctaattaccccttctctctttgtcgccacttaattaaccgatgcatttgtctcgtcccgtccttgtcctcctcattaaataattactgcaaatggcttaacctgctggttcgtccgctctttcagtttgtccgtcgctttttgtccccaattcgacctctctgatcgacatggcatggctctccaagaagcgcagtcattggttagctgccaatcggtccccgctgctttcctccgggtgggccaccgccaaaatgggactccaacggatggaacgcttcgggcgttatcaatacgctcggtttgtcagtagagcaacgaattttcaaaaacaaacaaacaaaaaacagactggcaacagccgctgaacaggaggaggacagtgacgaagagcaaaagcagaaaaaggcaaagaatggcacggagaaagaagcttttcctccccaaatgctaaccaaaaaccgaaaaaaaagacctaggaaagaaaggaaaagcactttataacacggaaaaagaaaatgccaactttagagtgaaagtgggagcaatgaacagcaacggcatttgaccaattcctttccgactcctccgaacgaatcggacgaaacggcagaagaggaggacgacgacttggacattggcaagcaggtcaaccgacaggggacacggcacagccgacggactgacactgacagaaaagtgccgaacttttcaggggcctccgatttcgctgagcacgcggcaaatgctccgttcgtccaccttttattttctgttcatttcgctgttctgctgctctttttatgggaatttcttctacaatttgtacaaagtcataaataataatgacacaattaattaattttcatttaatttttcagactttcggcgaaactttcatcgaagacgacttttttctggcctttgctttcagtttgggtatattaagagggtaactaattttagcttcattttttgcttccgcttgtcaggctctgtggccaatgcgattgctcgcgtcggctggggacttcttacggataggacgagtttccag

SEQ ID NO: 64483 - DNA, 279 bp, Heterodera glycines; identical to SEQ ID NO: 58736
  Genomic contig location: Contig_ID=SeqID_34772; Location=201..479; Strand=+
  SCN-specific regions: Sequence locations=1-153,196-279

SEQ ID NO: 64484 - DNA, 288 bp, Heterodera glycines
  misc_feature (238)..(238): n is a, c, g, or t
  Genomic contig location: Contig_ID=SeqID_34772; Location=1..288; Strand=-
  SCN-specific regions: Sequence locations=1-86,116-249,283-288
gctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccanaaaaaaatccgaaatatttaaaaatctataaaaaatttaaaaatgagaat

SEQ ID NO: 64485 - DNA, 1278 bp, Heterodera glycines
  Genomic contig location: Contig_ID=SeqID_34774; Location=69..1346; Strand=-
  SCN-specific regions: Sequence locations=1-185,207-676,698-704,733 -791,813-845,871-1065,1087-1194,1232-1278
atgggtacggcacaatgtgcccatccatgcacatctgtcccggttttgtctccagcagatcctgccgtgcaacgcaactcattagctctccgttcttatcccgggccccagtccctttttccggtaagttgaacaaagcgcagtcatcgggttccaaacaacaccgcaattattatgtgaatccagcaactaaaacagcaggagaatgtacaagcagcattaacccttcgagtaatccatcacgaatcctgctctaggattttagcatggaggctttttgactaaacttttagaagttatttttcggaccatctcacagaaattatgggtatcacctcaagtttcatagcagcgatttatcgggtggaaactaatataggagttcggcatttccccccaaaaaaccaaaaaaaaaatttgacctgtaaagaagttattaagaaaaaatcacaaaaattttgacttttttgcaattttcagttagaacttttttagtaagcgactaatcgctaagcaattgcttagaaatagcttctaaacatgttcagctttcgaatgataccaagattgttagatttgatcgacaacaaaaaaagttatagtccaaaaacaagggctggcgccgaaacggcggcgccgaaacgatacagaccctgccgcggagggactagggtcgtttatggagatgaagatttagataggtgaattattaatatgaattttattttttatcccattagtttgatgtttattttatgaaaggaattccgtttgtttagttcttcttcaagtcgacaacttgaagttttttaatccaaaattattcattcgcccaaattatctttgatcttttgttttctattatcctgcaaaattacaaaaaattcactaagtttaaaaaaattatgacttgagaaactcaaaaaagcaagttttcttgaacatattttgtcataaatttcttgaaactttttgttatgattttgccaaaatgacagttttaagagaataaggatttttagggccgttggaaattttttacatacgttttacattattttaaagatactcaccaacaaatttcaaattttggattaatttttgacgataatcaatttttaatcgtagatttttgtatataaatatttataaaacgatattgcattttttgaaaattattgtttattttttccgttataaattaaaaattttattatattaaaatattattgtggcaaaaaaattttttttcgagaaattgacttgcaaaaaaataaa

SEQ ID NO: 64486 - DNA, 1137 bp, Heterodera glycines
  Genomic contig location: Contig_ID=SeqID_7326; Location=129..1265; Strand=+
  SCN-specific regions: Sequence locations=1-617,658-1137
atgtccgcttcaacctcacaagcgccaactccgctgccaaccaccagccacgcatccgtcgctggcccatggcagcgcggaggctcagtgaagtcgcgcaactcgttgaagctgttgaaacgcaaaatttttggtggcaccggctcgaaaaatcgcgaaaatggcggttgcgatgtggcggaaacgacaatttcggtactttttttgatcaaattgtgtcggaatcaattcgagtttcagctattacaatttatcaaatcctttctaattaagactgctccgacggatgaaaacattgtgtggacagctccgtcatcaccacaaattggtcgcacattcaacggtgttaccggcatgccaagacgtcgaaattcagcaagacttcgtgaattgcagcgcctgcttcgggcataccatgaacaacgaagaagtgaatggacatcgacgccaagcagtccaaggatccatcaacgacaacaaatgccaatgaaagaagcaccatcaccagtgggatatcatgatcagaattttgatcaccatggaaccaattatcccgttcatataccagtagcaaagctgagttactgtcgtggtgaactcggccctgaacgccctctaattcttcaatcacattctgtggatcagcagcagcaacaaaatttgcctgggccaaatgtgctaagacggaaaatcaatttgtcagagttggaattggcactgttaaacggtgccaatacatcatgcccatcaagcttgttcacaaattccagccaaacagcttcatcattgcagcaaccactgccaacatcggcaactgttgttgtgcacactcagccaccaggacacgcaactgctgagcaagctgcgacaacagttgttgaggaaaagcatgcttatcgagcaaccaattttcagcatgaacaacagcatcaacaaattatttcgttatcaaagcacctacagtaccagggtgctaccacagtaacttcaacaacacacttttcgtccgctgttgggtctccccagaagcagcagatggatttcctaattaaaaaggctaattaccaaccaccgattgatctgccactgataagcccatcaccatatgaacaaatcatttcatatgtggcaccccct

SEQ ID NO: 64487 - DNA, 1349 bp, Heterodera glycines
  Genomic contig location: Contig_ID=SeqID_7327; Location=38..1386; Strand=+
  SCN-specific regions: Sequence locations=1-258,304-550,572-905,927 -936,959-1216,1238-1349
atggcatctgaaaagccgaacaacaagcagaagaaaaagaaaaagcggcgaaacaaaagtgaccaaatgccaaaaacgcaccatggcattgttggacagtacgcggaaattcaaaatcaacaaatttctggcaatcaaatggcttcttctcccaaattggccaagccacaacagcaacagaatgccaagacttatccaaaaagcggttcttcaaatattttatcgctcggatttaatcagttagttcaacgccattttcaacaaagccaactaccaccaaaacaacagcagcaacaacaacaaaatgctgtcgttgaaccaatgctcaagtcggccaggtcggagcctcgtcttacggcacgggccaaccggcgcgagcattggctgctgatgagccgcccagaaatccctggctcatcatttctatctccaaccccgtcaattgccgctttagagcatttggaccgtgttcgtgatcggattagtgagacaaagtcagggattaggggtgctaaactttcgagagtcttgaactcgaaaacatttggagatatgtgacagccgtgtttgagtcgcgcggtgggcttggccccgtgttgagcgatgtgcaggccgagttggagcactggttgggcgacacgtcccttctattggccatcgcctgtgaggtacattggtcagtgccggagcggttcagaagccgacagctggaaattgagtaagttttgctgttttatggtactttattggttttaaacattaataggggtaacaataaaaaaacaatttaatacaattcggatgccgagaatcccgaacatcgatttttaaaattaaactacattacttaattagcaaagctctaattacacatccgagtttaatgccagaagaataaattttggttaaataatttttaattttaactaaaatctgtattttcaatttttcaaattaaattccatcggtctgcagcaaaatgccattattactactgctgtgatcaaaaatattggcccttaaggcttaagcaatgcttacacgcggtgctacgcgtgaacaaccgccgcgtgctgagcctgaacgataatgacaatgacgaggaaacagcggcggtaaccgcgaaagttagccccgcggacagtccgtttttgatgccacggcacgggccacggcaccgttcattctcaacccattcgctgaacaatcgttccatcggcggcggcagcggcgggcgtccgtttcccattgcgttggcacgatccaaaacggaggagtcatgcattcgagatgccgagctggacgcattccagggtcttgaatgctttacagatgaagcgccaccataa

SEQ ID NO: 64488 - DNA, 2137 bp, Heterodera glycines
  misc_feature (37)..(37): n is a, c, g, or t
  misc_feature (1984)..(1984): n is a, c, g, or t
  misc_feature (2013)..(2013): n is a, c, g, or t
  Genomic contig location: Contig_ID=SeqID_7328; Location=67..2203; Strand=+
  SCN-specific regions: Sequence locations=1-142,164-659,684-748,770 -988,1013-1136,1169-1447,1469-1594,1627-1893,1926-1970,2029-2137
gactattcatcaaaaatgactattttatcggtagacnatggcttgtgggcaaaattcaagcgattgacgaggatttgcttccatgtaaccgcattttttacacagttttgccaagtaaatgaatataatttaattaattccgaaaaaattccaattaattaattacagaaaaatccgacataattaaggttcagacaaaacatcacaaatcagcattgatcaagaaaccggtgaactgtttgcacacaatttgactggcttaaaccatccaatcaaattttgcgtttttgcaaggtaattaaggattaattaggagggtgggggggggtcattatttcgtaattgagccgctgtttagtacgttcaagccaaattcaacacatcttgctataatatctcgacatggtattcccgaaaatttccgttcaattttacatcttcaaattgtaccaaatccgtcaaatattgctgagcatcatcatctcccacaacaaatgccgttgggcataattcgagcaaacaattcacattccttgctggaacatcagtttttgcgccaacaaattcccatagaatttgatggaatggcacttgggaatggttggattttttaaaagattcaaagatttttatatattttattttggggggcattttagtaatttaaatattttattttttaagggcattacaattcattaccaaataaagtaaattcatctgtaacatatcccaaattgtcattcgattccatcaaatttttgccatacggtcaaagtgatcagcaccaaaaaatcggtacattcgatgtgatcagacaattggtcggaattgactccgccaatgccaaattgcgcttcaatccggcatttgttgaagcatttgagaacggactgtacaaatttggcatttctgttcaggatgccattggcaataaagcaattgtttaccgaaatgtaaaattcggaaatatttattaattaatttgaagaaaatttgttttgaattttcaagattcatcttttggacgacaaatttcgcttacgttttcgctttaatgaatcgcttcatacaattggagccaatctgacaacatttattgggtgagtaaaaatttttcgattttaaattgcgacttaaaattaaaaaaatttttttttttttttttggtttttttggcattgaatttcgggaccaattcttgatattcttcatgaaataatctctgatcacatttttcatttgatccatctataaataaaatttaagaaagcttgaaaaacgacttcaaggcgattacaggattatgccatcattaccaatacgagacgaggaaaatccgggacaaaagtaagaaattctggcacaattaaaagcaaattcgaattcatgccaaattgaagtttcgtcatgtgtttccatttgtggtcaccaacaaataatggtagtggtgatgcaattgttgaatttgcggaaagtgaacggttattgtccacaaatgtacaaaattcgaaagccaatgaacaattgcatagcttatactcagaatacaaagtgatcaacattgaggtaatgttttttggagttaaatgccatttaaaaataaaattaataataaaatatttacagtttatgaaaattgaggtgatttttttccaagatcggaatccaaatcccatttcgggatttgaatactgtgatcctatcccgggctgatacgaagcaagcctgatccggacttttttcaaaattcctggctctataaatcaaccagagagtagattttcagcgcaaaaattagacttagccacgccctaggttagcaccaaaaaactaagcaaatgcttcaacgtcagcccgagatttttttttgacaatactttttatttggagaaatgtgttttttaacaaaatgaaaatataaatttcgaacaattcaaagactaagtttgtgaatggctcttcgggtcaattttatttttanatctttttttaatgaattataatttttanaatttatttaaaaatgatgctttttcagtcatgtgctgctgctgattcgtcgacatcatcggtactgctcaattccgattcttttggctcgtcgatggtgcagccaaatgccaaagcagtgctc

SEQ ID NO: 64489 - DNA, 351 bp, Heterodera glycines
  misc_feature (78)..(78): n is a, c, g, or t
  Genomic contig location: Contig_ID=SeqID_7329; Location=30..380; Strand=+
  SCN-specific regions: Sequence locations=1-23,46-207,234-317,342-351
atggtatttcccttaactaaaaattaatctttaaatttcaaaaaatttcccaacattcagcttcatacaactccaccngacaatccgtatagtgtttatgcgaaaagcaacaataaattgacgccttcttccatgtttgctatgcccgaatttattcatccaaaaacattacggtaatatacggctatttactgtattgtaaatcagaataatttattttttaaatatatttagaagtgatgaattggaatattgaagatgtttattcagagaaatgcctattcctataacttttctctgtttggattcgcaatttctaatttttttattattttttttttgtcaaatata

SEQ ID NO: 64490 - DNA, 1284 bp, Heterodera glycines
  Genomic contig location: Contig_ID=SeqID_7329; Location=1392..2675; Strand=+
  SCN-specific regions: Sequence locations=1-112,222-242,283-316,344 -452,474-494,579-710,737-1258
atgatttgctttcattcacttttatctcttctaatgctcttcattgccatgctattattgaccatgcaaaacagagcagttgactcattcctgttgagccaccgaaatttggtaattaattttaattaaaaaaaattaattgaaaaaaagaatcggattatatataataaaataaaaaaatgtatatacagataaaaaattttaacattaaaattttttttcaaataccttaaggcaaaatgattttttttaattcattaaaaaatttctttaaaaaattatcaaacaacgattttttcaatctgtaaaagattagttattttttcacatttattttataaagtacgcctttttaattatgagaaaggcaaaccgaataaaaagaatgtagcattgtcatttcccattattatttgcgtgcgtgaatgcttaatcctctcatgagctaatccattttataagtacaacataagatataaatccctctcttgacgtataaaatattgatttgaaaaaattttgaaaataaattatgcaactaataaaaatattttgacattaaaataaaacaaattttagttggttcctttcgcgtccaccaaaatggccatggccaacaatgtggccaaattggacaccacaaacaataacaacattggcgttcgtcggcggcaccattttgtcagcctttttatgatgaaagcattgccaaaatctggtgatggagatgatgatgaacgacaaattggtgccaagaatgtgctgtttcaaaatgatggcaaccacctgctgctgcaaccgtcggctaatgatggtgccattgccccgcagcgagtgcactcgcgccggaaacgattgcacatgttatccaccttgcgacgcgttggcacaccgcgccggtcaactgaactgcttaaacggcttgtggttgaacaccagcagcagaaacaacggcatgtgccactgaaacggattttgtcattcgatcttctctggatgttcaagagggatttctgagattcaaataccaattttttttttaatttcaaaagcaattaattttaatttgtaatgtgtaatgtaacaaatgtcacatgtacagtgtatcactgaattgtttttatactgtaaaaaactgatatgaaacaacaacgacttaattaatgaaggatttgctaggaagttgttgttggcaaaaacaatatttttttaatccatgtttattgcaccaaggcactaaaattttttgtcgaaaaacattatttaaaaatataaataataata

SEQ ID NO: 64491 - DNA, 56 bp, Heterodera glycines; identical to SEQ ID NO: 52733
  Genomic contig location: Contig_ID=SeqID_34783; Location=598..653; Strand=+
  SCN-specific regions: Sequence locations=1-56

SEQ ID NO: 64492 - DNA, 536 bp, Heterodera glycines
  Genomic contig location: Contig_ID=SeqID_34787; Location=761..1296; Strand=+
  SCN-specific regions: Sequence locations=1-435,461-478,500-536
atgtccttgcaaatcggcatacccgtccttggaaaccgacttcggacgataccatccctgagtttggttaatggatttgagagaataaattggatgaacgaaatgagtaaaaatggacgaaacgaacgaaagaatggtggggcacatttggagggggggggggggatggcattggccacttgacaccaaccccaccaaaaattggtggcacaaaaagagaaggcgtgggtggaacaatagcatagaaaaattatatgaatttgtaatgattagagtgtggattttagttattaaatttttttttctgcaacattattttgatgagatatgcacgaaaagcatatttttagtccgaaaatgttttattttaaattcgtcactaggatattatgtacgtcactattttggcgtttcgtcactattttgaattttttgagaatttcttttcaaagaaaaaacattcccgaaggattaaactttcattaatttattttttaatccaaaaaacacctacacctaaattcttcaaacacaga

SEQ ID NO: 64493 - DNA, 462 bp, Heterodera glycines
  Genomic contig location: Contig_ID=SeqID_34791; Location=115..576; Strand=+
  SCN-specific regions: Sequence locations=1-132,159-288,317-433,460-462
tttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcatatttaaaaagcaattaaaaattttta

SEQ ID NO: 64494 - DNA, 2748 bp, Heterodera glycines
  Genomic contig location: Contig_ID=SeqID_7331; Location=487..3234; Strand=-
  SCN-specific regions: Sequence locations=1-252,277-615,637-1039,1067 -1415,1439-2054,2076-2748
atgcacaatttgtcatttgaattgcgctcggaagacgtgcttaaggggcacgattggcactgcagagacagcgagactgaagtgttcgaccgaattgtgaagcaaatccaagtcaaagtgagcagaggcaaaatatttgcaaataattatgatttgaaatggaattcagagaagggtcgacgtggaggaacacttccggcaaattgtcgtgtacaaaaggaaaagggcggaggaagaagagacggacgaagcggaagaaagggaggaaggggagaaagggcaacgccacggggagggcgcccgggggcaggagctgactcttgagcaaatactcgacccatcggaccagttaagcattcggcttaagctgttcattttctgtccgttctcagaccaaccacaaccactgctgccccctcgcctcgttcttctctgcttacttcttctcccgacgttatcagttacagtatgctgcagccatttttgcctgaccgtactgatcaacagcggaatactgtggcagcagaaccggtgcagacgaaagtgttgataaatgcgggaggacggaaggtgtacaatttgggagtggagttttcaagtgagtttattgctgggtaattaatttattaattaattgtggttaaatgggcttaaagagcaattttggcagaatttgtgccaagttttccgcccgctctcagcaccgaacttttgagcgtcgcttctccgctcgacccgcggggaagcgcccccctccaaagagtgcgcaaccgatcccctctaaacacatttaatggggaggagagaagcgagagggctgtacgaagttcgggaacagtggaaaaaggtagaagctgatccaccccccccccctaaaaattctttctcagaataccgacaaaagcgtcgcggacaaattcccgacccatcagaacgaccccttcaggggtacagtctgcccaacctgctcaaggagctcgcgttgctcacttacgaactgaaatcgttgaggacgatgatgacggttggggtgggcgacggagagagaggggagggggaggaaaagccaacgacggaaagcattgaatggacggaacagagggagcagcttctgggcaattgtaagcaaaacaaaggagcgaaaaaacaattggaaataatgacagtgctcgccgaattgttgaccttttctgactgcgaatttcggctcagagaatgcgcttttggcgaatttggaaggccaaaagaaaaatcggaacgcaatttaatgtgagcactaattgagggaaagaaatggcaattaacaaatgaattggctcatttggcttcagtttgaccactttggccacttcgctgctttgtgagcaaagagcgtctgaggaatttgttcgttttacgcttttcctttcaaactgtgcttttcttttctccctttttcggtttgtgggcccatcgcttttttggctcgcgaagttcattctgtgctgaatgggacggacggtggcaaagggacggagacgcaattcggcgccatgggcggcggaatgcacgcccaatttgttggttgcacccgtcccatgcccttatgacggattttgctcagaatgatccctccgaacaaaggcttttcctcgagactctttttgtccaaacggtcatggactgttctgcttatgcgtgtgcagcagtaagccttttcagccaattaggccaatcagcgaaatgcaattgagcggtagtccccgtttgcgaaggagtcgtggaagcatctccactcctccttctaccggtctgtggatctcgacaagcgatacgacgtccgtctgatcgccgccttggcttatatgtccaccgccgccactcggtttgtcctccctttcatttgttgttgtgatcctccgtcccttacagttccatcatgcgctctcggcttgccacttcgactttgcgagacgacaaagcgccctttggggatttgttgagggatttgcaaagaaagggccgactgatggccttttggagcaaagtcttcataaagtacgttttggtcagcaaatggtcaattaatgtccattaactaattgtaagagttcgaatgtgttggccaatgctttggctctgctcgcttacactcgcgagcattcagtgtaccgttattggaagaacgaattcgacttcgaagcgctgagcaattggttggtcgaacagcaggacagccgaaggcaatacgaaaacgcattggtcggcccattaggacaaatggtccaatttgtcgcccattcattcgttaaaggacactttcttcgcctcccgcgcccttttccaattcgcttcagtgaacgccgctcgccacgttcggttggcacttctcggctctgtccaagtgagtgccaataataataatagtcccgtgcattgattgcttcagggcaatttttcgattccatccgcgccttcgttgtcacggcaattcaatgagaacgaattgcccttttcactgagtgtcactccgtcggcgagccgaatgcaaattgagaccaaaggcgatgcaaggtgagctgattgatgggtggacgaagcttaagcaaatctttcttccttttaaggcttcttctcggagtgcgtgtcctcgtggaaaaaaggcgtcggtcgagaagagaaccaagcgatgctgagccggtcactcttgaccttgtgcagttgagaacgcagaccaatttcattcagcagacggtcacaatcaagtga

SEQ ID NO: 64495 - DNA, 59 bp, Heterodera glycines
  Genomic contig location: Contig_ID=SeqID_34793; Location=60..118; Strand=+
  SCN-specific regions: Sequence locations=1-59
caggttatcactcagctgaaactcgagaatcagactctcagggcgttgttccacggatt

SEQ ID NO: 64496 - DNA, 890 bp, Heterodera glycines
  misc_feature (97)..(97): n is a, c, g, or t
  Genomic contig location: Contig_ID=SeqID_34793; Location=529..1418; Strand=-
  SCN-specific regions: Sequence locations=1-226,250-890
  Gene Ontology: Mol. function=fructose-bisphosphatase activity; Cellular component=cytosol; Biological process=gluconeogenesis
aggcaaaggggcagaatgccaaatcactttctcaactgatcaaaaaatcttaaggacggaaaatggtagctgcggggtacggtaagaaaaccatccnaacgcactttcattcattgttcacaaccgcaccaaagccattgtacgggtcggccactatggtggtgctgtcgaccccgggccgtgtcgatgggttcactttggacccggtcagtgtcgtccaattggcccacccctatcaatcactaattacaaatcctaattaaattacgaatccctttttttttgctccattcagagcattggcgaatttattctcacaaatccggcgatgcgagtgccgaagaagggcaaaatttacagtataaatgagggatatgccaagaaatggtccaaaggtcggtgatttggtcggacaatttactggggaaagggaatgaataacctcaagggatcaccgaatacatccgatcgcgcaaattccccgaagagggcaaatcggcgtacggacagcgctatgtcgggtcgatggtaattcagaattggcgtaatattctggcgaaatgtgcgttttttgaggtagccgatgttcaccgcactttgttgtacggcggcattttcatgtatcccgcgaccacaggtgggaaaagcgacgaatgagaagcccatttgaagcaaacgattggacagatgcgccaaatgggaaacttcgcctcctttacgaatgcaatccgatggcatttgtcatggaaaacgccggggggaaggcccactcggggaaatgcccgattttggacatacagccgaagtccatccaccaaagagcgcccatctttttgggctcgaaggaagacgtggaggaattgctggaatacatccgaaaacacgaccaa

SEQ ID NO: 64497 - DNA, 91 bp, Heterodera glycines
  Genomic contig location: Contig_ID=SeqID_34795; Location=391..481; Strand=+
  SCN-specific regions: Sequence locations=1-91
aacccgtgcggaaatatacgtgcaaggaagtcttctgctcgccattgaagcctctgtacggcactggggccaacactttatgtgtcgctaa

SEQ ID NO: 64498 - DNA, 753 bp, Heterodera glycines
  Genomic contig location: Contig_ID=SeqID_34802; Location=482..1234; Strand=+
  SCN-specific regions: Sequence locations=1-45,85-477,499-753
  Gene Ontology: Mol. function=aspartic-type endopeptidase activity; Cellular component=lysosome; Biological process=digestion
acccaatatttcggcaccattctgatcggtttccccccgcagcaattccaagtgctcttcgacacaggctcctccaacctggtgaggatggcattgccctgttggcattatgctgctaacggtcactcccttttcagtgggtcccctgcaaagggtgcaatgactcggcatgctcaacacatcgccaattcagctgccacaattcagtcggctgtcaaatggccggccaaaactttgacattgtctacggcaccggctcggcttcgggtgttctgctgcaggacatcgtttgtgtaagaataaaagttagcgattattttggcaccgtaaaagaataattttatgtgagtttggcaatttgagtgtcaatttgtgcacaaatacaactcaaaagtttggctgttcaatgagtgaacctggagacgttttttcggtaaaactaaaagttatttcatgtccaaaccaccctttgagcaaagaatgccgccttcgatggcattttggggatggcgtggaattcaatttcgactgacgcggcggtgcaaccgttggcccaaatatttgaaaatgaagattgcgatgagaaagtgttcgccttttggttggttgcgaaggaatcgaatcgccaaaagcctgaataccaatgaccccatcaaaggctgaacaaagatgactttggggacgacccgcgaggggcgaaaggcggacaaatgacatgtgtgcacagacaaaagccgatataaggtacgaaca

SEQ ID NO: 64499 - DNA, 776 bp, Heterodera glycines
  misc_feature (26)..(26): n is a, c, g, or t
  misc_feature (130)..(130): n is a, c, g, or t
  Genomic contig location: Contig_ID=SeqID_34804; Location=74..849; Strand=-
  SCN-specific regions: Sequence locations=1-615,637-776
  Gene Ontology: Mol. function=protein tyrosine kinase activity; Cellular component=extrinsic to plasma membrane; Biological process =regulation of cell shape
catcgctttaggtccgcgttttgtcntacaacaaaagcaggggagtggtgcgaagtgcagttggtccgtcgttgtgcctctgccaagttggccagtccaagtgtccagtccaacttggccacttgctcgnccacgctcggctcctcctcctcctcgttggcctcctcctccagccaatacggacagatcggatgggtgccaagcctttacattgccccggcaaattctttggacaaacacaggtttttggtcatggatggccacgccacgggttgacttttccaatctcagctggtaccacggcaaagtcacccgggcggaggccgagcagttactcggctcgggcattaacggctcatttttggtgagggaatcggagacgaaccccggccaattttccatctctctgcgacacgaaggttcaaatgaaagtgcataaagagaaggcaaaggcattaaaattaaaaacaaataaaaattcgaccgtttctttcgccttcccctacagtaccttcctttattaggtcgtgtctaccattaccgtatcagtttcgatgccaattttcgggtttgatcatttcccatcacttcgtttaccctgccaatggcatttcccctcccacctcgttcagctgtttatcactgaaagtgccaaattcaaatcccttggtgagctcgtccaccaccactccatgtccgcctccggcttaatctgttcgtcttcctattttctcttttgtcacttccttaaaaggcactttaatgtatccggtgaa

SEQ ID NO: 64500 - DNA, 262 bp, Heterodera glycines
  misc_feature (168)..(168): n is a, c, g, or t
  Genomic contig location: Contig_ID=SeqID_34808; Location=407..668; Strand=+
  SCN-specific regions: Sequence locations=1-45,72-262
gtaattacttaaggtgcaaatgaccatttccatttttccgcgtatttgtccctcttttcctccttttctccggcattttccttcttcgtccgctaattcgctcgcttttcgtcgccacttttctctgaccggcccccgtcacagctttttcttcgattatttcactanagttcgattttgaagttataaaaaaggaaaagtcgctaaacgagtgaatccaaaggatttagcaccccaagggacatgcccctctccgcgacta

SEQ ID NO: 64501 - DNA, 915 bp, Heterodera glycines
  Genomic contig location: Contig_ID=SeqID_34810; Location=3..917; Strand=+
  SCN-specific regions: Sequence locations=1-20,42-275,297-552,574 -807,829-915
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 64502 - DNA, 1181 bp, Heterodera glycines
  Genomic contig location: Contig_ID=SeqID_7337; Location=2028..3208; Strand=-
  SCN-specific regions: Sequence locations=1-315,337-746,768-774,797 -1048,1071-1181
atgaccgaagccaaaaacgagaaacagtcagttgtgatgccgccttttactctgagcacggggacaacgacggcggcgtctgtgtcctccatcgaggaggacgatgcggacgagtacggcatgttggacgagtacatggcgaacgtcgagaaacagcgcaaaattgcgcccattggaagcgaagccaatcatttgggcaatggtagtaaaaagcgaccgaacacattgaagtgcgttgtgcgcagaaagattttctcttccatttaaattaatttgttcctttcagactctcatgcccaaagccaatttctgtgatcaacaacgggaacattcccaacggattgtctgccgcatatgagccgatcagtccgggcgaaatccttcgtgacgaccaacagaattttgggaacaacaataacgacgaccgcaagaaggggagcatgacagacacaggggacgtgccctaccagttcaacgtggacaaattcatctccgacattttgccgcagccaaccgcccagcaacaatcgttgttgtacaactcggacttgtcctccaacaaccgctttttcaccccgctggcacaacagccgctcaccgctgactcgccgctgtttacgcccattgtgccgtccattgaccattatggcgtcaaagatccgtggtattatggcaaagtcaacgacatctcatcggcccatccgctgcagcagccgctgatggacagcactaacccatgggcatatccctgagaagtttcttctgatcagatgcaaaagaaatgcccccattgaatgtgtggaactttggttttctctgccccttttttaggcttttcagttttagatgtgtgtttcccccccctccttcaaatagttatttgttcaaatatgcgtagttgttagagatgtaccctccggggatggtgtttccgttttttggcaaaaatgccccggcatttccatctctgaaccattgcgcatattcgtatcattttcatcgttctcacaatcagtgtgcttccgtcaccaaccaaccaaccttcccatttattttgttgttttctgttagatgctacccattccacaagagcagtgcgtttagattatcttatttatttgtaaccctccaacggtcacacaatcattccattcattccctcgtcttgcatagagaataaa

SEQ ID NO: 64503 - DNA, 597 bp, Heterodera glycines
  Genomic contig location: Contig_ID=SeqID_34813; Location=227..823; Strand=-
  SCN-specific regions: Sequence locations=1-128,182-264,290-455,509-597
atgatcagaaaggccccccaaactttgcgagggaaactccccgggtaaaaggacttaactttacactgaaatggagcgcggagctagctggggtttaaaaattttttcaaaaaatcaaaagtctttcgtttttattttaattatttattatttttgcaaaattaattcataattattttttcagaaagtgctctgaaacgcaccaaattttatttacaagctattttaggcactctgatgctttttctatcaaaaagggagatgaataaatttttaaaaatttttaattcctttttaaacaggccaaaaagtttaggcttaactttttttttcagaaactgatcagaagcgcaccaaactttgcagggaaactccccggtaaaggactaacttacactgaaatgagcgccgagctagctgggtttaaaaattttttcgaaaatcagagtctttcgtttttatttaattatttattattttttgcaaaattaattcataattattttttcagaaagtgctctgaaacgcaccaaattttatttacaagctattttaggcactctgatgctttttctatcaaaaagggagatgaataaa

SEQ ID NO: 64504 - DNA, 323 bp, Heterodera glycines
  misc_feature (45)..(45): n is a, c, g, or t
  Genomic contig location: Contig_ID=SeqID_34814; Location=529..851; Strand=-
  SCN-specific regions: Sequence locations=1-88,113-255,280-323
atttataagcatttgaagggttctcagcagtttccctgcaaaatntggtgagcttctgatcagtctagaacgttgggtgatcaaatgcaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaatgcaaaaaataatttaaaaaaaataatgctggtgtggtaagtgtgaagaactgtgttcctccaggcaaaaa

SEQ ID NO: 64505 - DNA, 1203 bp, Heterodera glycines
  Genomic contig location: Contig_ID=SeqID_34818; Location=168..1370; Strand=+
  SCN-specific regions: Sequence locations=1-17,39-692,714-1203
atgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtaacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggacttaaggggccttcttatcaatag

SEQ ID NO: 64506 - DNA, 4284 bp, Heterodera glycines
  Genomic contig location: Contig_ID=SeqID_87; Location=1867..6150; Strand=-
  SCN-specific regions: Sequence locations=1-549,571-574,596-1460,1482 -1513,1535-2921,2943-3018,3040-4284
atgtcgcggtacaataatttgctccaatttgcgagtgtttcggctggcaataagccaagtcctgcaggcggaccgatggcagtaattctcaatggagaattccatcgccgtataagcagcatgcaggctggcacaacccagattcctggcttcggtcagttatacattctggatccagtcgaagccatggagcagcgacgaaaaaatcccacctttactggtgaaaaaatcacaaacgatgaagagtttgtgcagggtcatcagcttaatgaggcgacccttgaaattttggaacaagttatccaagaaaatcacccagctgcgtcggcttacaagcaggctcgggaacagctccaagagttgttaaaacaacaaaggactgaagaactccgattcttcagaatgactttgctggatgagcgctctgctccgggtggtatgaaagacccaaagttgcatccccaccagataatcaccccctcaacgggtgaagggatgttcgcgattcatgcggatcccactggtgccccggcaccaaaaggaatatgggttgaaaacaagcaaggacagttgaacgaaattgccccgtttagtccatggactgatagcttgacctatccattaattaagcctaagggcgacgatggatacaaatttggaattccatatgctaaacccgcacaaaggaagcggaaaagcgataattctgatgatatgtttgacacagaagcaatgtccgatgatgacatgtgcgagaccgagtcaattgcattttctgataccggatctgaaacatcgacgcagtcagtgaccagtcgctatgacaaatcaaaaagatttgtctccctgcgcgattattgcaaatatcatctcgcaataagggatgaaaatttggagtggcaataccatcacattctttcatgtggcggtggtcttggacagcgctgggtcttagaccaagcgtccaaaattgactggcaaattgccacttttttgcgccgtccagacatggacctgcgcgtaagtacaccaaaaaatttgctgcagtacttggtgaaccaatacaacaagcagcaagctcggcaaaaccccaatgcacaacaaaagagtgttgatgacattggcagcgttgttcgcctttctgagagaaatgtaaattctcttcagtattggaaaaaaatgtatgaagactgcaacaccatttttgcgcgttgccatgacgcaaaaaaggcgcggctctttatcacattcacgaataaccgtgagtggccagagttcaaggagaacatttacaaaaatggtcaaatgttcactgaccgtttcgacatgtggatgcgtgtgtggtccagcaaaattgctgttttccaccaggagctctatgaaaagagtttcttcggaacaatccttggctcaggcgagtcaatggagttccaagggcgtggtggcccacacgcacacattgtagcccagactgacctggacgtagtcccagaagtcatccaggaatacatatgggctcatattccacctttgccagacaaagatgatgactccccaattgcacaaatgcatcgcgaagtacgagattatatgcatatgcaactgcacagatgcagtgatagttggtgcggtccacgtgaccccaactttgggcggtgtaaaaaaggcttcccagccccgtactcgaaatgtacgattctgcacccggacaggcccgcgttgtattaccggcctagcccaaccgatggtggtgccaaaattgaggtgaacggcttaatatacgacaactcacaggtcgtgccgtacaatccatacattttgctgcgttaccgagtacaccacaatgtgttattcgcttatggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgcaatttgcaaaactctcacatcacgttgttcagttgtccattcatttgccaaaccagcagcccgttgtatacagggccttccaactggtgagtaaagctgaggaaattcagcgcggcgaactcccagagacgccatgctctgcctattggaagcaatggcaaaacgaatggcagcatgttccttcgctcaaggacatgctttttgaaaaagtcccagagcaatttcgatgggcaaaagaccgatgggtcctgtataaaaggaagcctacaaagaggcccccaattggtcgtgttgttcctgtccctccaacggaccgggaaagatttgcactttatgctttgatgcgtcactttcccggtgatccggaccacttaaaactggtaaatgggcagcagtacaacactttcacagaggccgctttacagcacgggcttcttgaagatgaccaaatttggcacaaaacgctcggcgaggcagccttacatcgctggccggaccagatgagatggctcttcgtgagcatcctcgtctttgggcagccgagcaatgccctagaactgtggaacaagtacaaagaccaaatgtacaacccacagggcatcaccagtgcggctatacgtcaagcacgcgagcagcaagcattagccgacattgattggcgattgcacttctttaacttaagctgcgtgcattgtggcctcccagatccaccaaattcaaaagccaaaaatatcaatctggcaattgaagaatatttctatggtgatgatggtctgaatatgccgcctggccagccaaaacaaaggccacaacaaaacaccccacctccactcaacagcgaccagcaaaaggtctttgatgctgtagtgagagcaatacagtcggacccaaaggaccagactgtgcctcgccgtttcttcattttcggcgatggaggtacaggaaaaacattcctgtttggccaaattatcaagcgcttgcgcaagcccccatacacctacaaagtgcttgccacggcatccactgggtgtgcggctattttgctgccttatgggaaaacagcccattccactttccgtctgggtagagaagtgtcattagacaaactcccaagcattcccttggagagcttctttgctcgacggatacgtgaggcccaactcatcatcattgatgagatcaccatgcttcacaacacggtgatagaggtcatcgaccgagtgtgcaaagaaatggcaattccccagcacaaggacctcctcttcggaggaaaaacggtcatattcagcggtgactttaaacagtcgctgccggtcgtgcctcacgaaggcctaactgcacaagttacggcctgctttcaaacctctccactgttttgtcaattcactacaatgaaattgacaataaaccagaggttgggccaagggcagcaagcctacttgcaaatgtgccgccaaataggcctcggggagaccggagaatacttctggattcctccgcagtttctcgtaaagagcagggaagagttgatagactttgtctatcccgacttccaaaaactccttggaaatgacaaggaactgctcaatcggctgatcctcgcacctcacattgacacgtgcgatgagatcaacgaaattatgatggcgaacgtgcctggtcaagtgcgagaatatttgtccacggacaagcctcttgacgagcggccactggacatcgatgaaatcgagtccgaagtggcagcgttgaaccgacgcacagactctgggatgcctccccaccgtctgcgactcaaggtcggaagcgtcgttgtcctccttataaacaaaagtgataaggaaggattgatcaacggcacgcgcatcgttcttgaagaacttggcgacgatcgtctggtcggtcgcgtcattaacagcaacgctgttggtggccaagttaagttcttcatcgaaagaacacgcaatgtctacgaggacaaaacgcctggcggcttaaaatatgagcgtttgcagtttcccatcaaacctgccttcgccatgaccattctcaaaggtcaaggccaaacaatcagcacggtcggaattgacctcgaaagggatgtattttcccacggtcaattgtacactgcattttcaagagcaacggacgggagcaacgtccgagtgtacgctcccagaagggagaccgatgcacaagacagagtcaaagtgctgaatattgttgcaacgaaaatgctcaatttgcaataa

SEQ ID NO: 64507 - DNA, 2830 bp, Heterodera glycines
  Genomic contig location: Contig_ID=SeqID_88; Location=73..2902; Strand=-
  SCN-specific regions: Sequence locations=1-150,173-994,1016-1737,1760- 2185,2207-2497,2519-2616,2638-2830
atgccttcaaaacaacacgctaaaagaaagaaggagcaagagcggtaccaaaggcagatggagcaatctgtcagcccaggtcgctcacccgtccctgacggaagtgcagatgagaatggggtggcatcacacccgggcaccacaacgcccaatattagtgctttgcaattaagcacaccggcttcttccattggaagtaaaagaaggggaagacccccaaaagccggagcggagtcaattatgacttcgcaacacagtgtgtcatctgctgatacacaagtcactttggccactcaaaatgttgagtcgtcgcctagcagcaaaaaatggaaggtcggcgaagttgaccgatccatgtctgctattggagcaattgcttcaacacctgtttccaggcaaaaaagccgtggagggcggccgaccaaaaagagaggcggcccaggcaggggccaaacaaattattcaatgagcaatggctcctcaatgaaccacggctctgaagataccacattattggtcgttttgccagctttgcctgaaaacatgaacttcagcacagtgtcaattaattttgccacatcgcgaaattttgcctgtaaaatttggaaatgggcagcaattggcctttacgaacgtgatggcgaaacagcgcttgccccgagctctggcccaagatacattgagacctgttggaatgatctgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattgggctctcattgtccatgatgtgcaatttggcactcattttgccgattctttgcctaccccatatggcaggttggatccgcaactgacggataaaattaaaaagatcatttgtgacattttgccgtcgacagtgttgaccgggattcttaatgccgaaaatctcacggtacaacacgatggaaatagctgcgggtacttcgtttgcctgtatgctgaatcctggcttatgaacaatcgaacatttgttctaccaagtttattcataaattatgaaaagaagcgtattttgtggcacattaacgagctgtatggctctgataatgtgccatatcatccaagggaaggggtgccaactccttgcccaattgtctatcgacatacggatgaagcgcagtcgacatccaaggccgctgagtcaatggaagttgatgataaaaatgacataatgatcatcgaaccacagacaagtggacaggctgctaatgccattctcacccaagcccaagtggatggtgaaaaccaagtcgacacgcttggtttggtttcggagtcttgtgttccgcaagagccaattgctcaggctgacgatgcaatatttgtcagaccgaagacgcctccgaggcgatcaacgcgcataggcagacggcaatccacttcgattagccgttctccttctcccgcaccgagacgcagctcatcagcaaatgctgttgagaaagtcacagcatttacgaagcgttgctaccttgtccacaagggttggtgctgtgctgccgcagcagcaaaacattttccggaatactccgattcaggtaaacttggcgaaaaaaagtgcgctcattgtggggcactgctcttcccgcatgaggacagcagccattgctgtcgacagggaagggttgttttgccaaagcttaacccgcacccaaaagagcttgaagagctcatcgtgtgcgacaaacaaccccgccaagggaaggagtttgttcggaatatgtcgcgttacaacaatttgctccaatttgcgagtgtttcggcaggaaataagccttgccctgcaggcggacccatggcagtaattctaaacggagaattccatcgccgcataagcagcatgcaggctggcacgacccagattcctggcttcggtcagttatacattctggatccagtcgaagccatggagcagcgacgaaaaaatcccaccttcacgggagagaaaatcacaaacgataaagagtttgtgcagggtcatcagcttaatgatgagacccttgaaattttggaacaaatgatccaagaaaatcacccggctgcatctgcttacaagcaggctcgagaacagctccaagagttgttaagacaacaaaggacggaagagctccgttttttcagaatgactttgttgaatgagcgctctgctccgggtggtatgaaagaccctaaattgcatccccaccagataatcaccccctcaacgggtgaaggtatgttcgcaatacacgcggatcccacaggtgccccggcaccaaaagggatatgggtcgaaaacaagcaagggcagttaaacgaaatagccccgttcagtccatggactgatagcttgacttatccattaattaagcctaagggcgatgatggatatcaaattggtattccatatgccaaacccgcacaaaaaaagcggagaagcgatcaatgtgtcgatcaaatgtttgacactgatgcaatgtccgacgatggctgttgcgagactgagtcaattgctgcatcagatgctgagtcggtcgaatcgaccgaatcattgattgatcgcattgataagacgagaaaattcatttctctgcgagattactgcaagtaccatctcgcaataagggatgaaaatttggagtggcaatatcaccacattctgtcatgtggcg

SEQ ID NO: 64508 - DNA, 157 bp, Heterodera glycines
  Genomic contig location: Contig_ID=SeqID_88; Location=8920..9076; Strand=-
  SCN-specific regions: Sequence locations=1-157
gccataaaatattgcagatttttttctctttactcaacaatttgcgatttaataattaaagacgctaaaaaatggcacaccagcaagcgataacgaagaagcgtaaagctatgcaagacggaattttcaaggccgaattaaacaactttctcatgaa

SEQ ID NO: 64509 - DNA, 3367 bp, Heterodera glycines
  Genomic contig location: Contig_ID=SeqID_88; Location=3952..7318; Strand=-
  SCN-specific regions: Sequence locations=1-770,792-863,885-921,944 -1445,1467-1825,1849-2463,2486-2822,2863-2937,2981-2983,3005 -3170,3201-3367
atgggctcggacgaatggtgcacagaacgcaattggcgccaattttgtgcaatttcatggctggaacagctaaacacattggacttgagccaaacgaatttaagcatttgccggtgagaatttttttttaatttctggaaaaaaattttagcgtttttttttaatttttgaaaaaaacttgtaattcagcattaatgttgaaaaaaccgctgtgaaatttctttcctttagggtttttaaaaaaattctcatgtttgagatggtgtgcgttattgatttactcaacttttacgtctattgaaaaattgatttttaccctttgtttgtgtaagtaataaaaacacagtctgataatgccttacttagctttttttttgcaaaaaattttttgtttaaaatatccatattcattttttggcttttttcatgcaatttttttcacttttttcagctttgtatgcaacgatatttctgatggatattttccccattttggaacgttctcaactcgaactcaaattggcactgatttcgcccctttctatgcgctggtcgacaaacatttcgatggcgaaagtggattaagtcgtaagttttattttctttccaaattgaccattaaaatattttctaagctctacaatttttggttggcacttaaaaaaagtgaaatttttttgaggaattttctatttggcttatgtttcagagcatcgtaaataaaaaacgaaaatatttttttaaatcagaaattttttttgggaaatttgcaattttaaatttagatttttgcgctctttttactcaattaagcaccctattgagattttatgtgcttaaaattatttgatagattgagcaatttaataaattgtaacatttttgtttgaaattaagagaaaatcaaattttttgagtaattttgcaatttgatttattttcagggttgcttttgccaaattaagccatttttctaagcgcaaatttacttatttactaaagtattctttcacaatttcagctgggtgtgccacgaagtttcgatggacgttttgccttttttgaccatgcttaacttggcctcaaattggcattgatttcgccccgtttcgattagctggtggacaaacatttcggtggcaaaacggatttcggcaagtttttttagggttattgaatattttttaaggagtttgtgcccaaacggggcctacatttcaaaattgctctaaaaataaaaattttccaaatttggcaaattttaatttatttttgtaaatgaatatggcacttctttcgccatgtttcgaactttggtggacaaacatttcgatggtaaaaagtgattgttttttatggtttttgttgttttttaatgattttgtgcaaaaaagaagcctccaatttcaaacacttttgcctaaaagcaaaattcggtttttttgtaaatgtgaactattttagtgtttttgctttttttttgtaattttatattcttaagattttcagcaaccgccaaaatgtttggatggacattttcccactgttgaccgtcctcaactcggtttaaaattggcactgctttcgcccgtttcgatgttttagtggacaaatattttgatggcaaaaaaagtgattttttagggtttttaattaaggattttgtgcgaaaaggggcctccaatttcaaacgaattttgcttaaaagcaaaattcggttttttttgttgtaaaagtgaaccttttttttagggtttttgcttatttgctgattttttatgttagaaaatcacatacatttttaccaactccagctagacagatttatttacctttttcatgtaaaaatagtaactttttaagggttttcgttaatcatatttttgtattttataaaatatttcgttactttttcagcacataagcaacaacgtttggatggaaattttcctttttttgaccatgctcaactcggcctcaaattggcactgctttcgcccgtttcgattagctggtggacaaatattttgatgaaaaagcaaaatgactgtgggccacaaatcgaaaggactaacttaaatgtggtaagtatttaaagttttctcggttctaaaaatggcccgaaaaataaaaaaaattcaaaattcgtaattttttttgatttttttttgtgtcaggtttttttagtgtcttattgttacgtatttttggatttaatgatttttaagctgggccttacatttatatttttccattatagtcataaatttctttgtttggcaattacatggcataaaaaaattttttggaaattttgtatgtttttgcatttttaatagaaaaatttttgtttcgtgtaaaattgctcagagtttcggtcaacaaatttttgtccaaccctattgcttccctttccgctaaattattaattttcataatttcagttggtgttcagcgatgtttggatgggcattttcccactttttgaccgtcctcaactcggcctcaaattggcactgatttcgccccgtttcgatgttttagtggacaaacatttcgatggacaaacgcgaattttttcaaatttcggtaagtcttttgtttttgctttttttgtaagtgattggttttttttgtttacttaattgaagtcgtaagtttcatttttttcataaaattgaaccttatgaatttaaaattggtctctaaaatcgcagaatttttaagtttctgtggcaaaatcataaattatttaagaaaaaaatcaattacaattagcagaaaccttgcttgattttaaattatcacgtaattatagaaactttaatttttagaaagtttttcattttaaaagataatttagcaatttgttagtggaaaacccccataaagccagaaagacaaatatatttttactttttttcatttaaaagtaccatttttttttatgtttttgttaatcattttttaaaatttttttggattttaggagtttttcccttttttggcattgctcaacttggcttaaattagcaatgctttcgctcggtttcgatgcgttggtgaacaaacatttcaatggcaaaagcggattgctgcgcaagttttttttcacgaattaaccggttaaatatttttatgctctaattttttggatgcattcggcaattaaaaaattgaaattttcaaaattgtatcttcaaacatgaaaatcaattattgtgaatttttgaaaatctcaacattgttgcggtgatgctgtttcaatcccgcaaactttttgtgagattaaaacaattctctcaggaaattgctgtatttggccggttaaaatcaaattcatcgatttgaccatgatttgaataaa

SEQ ID NO: 64510 - DNA, 367 bp, Heterodera glycines
  Genomic contig location: Contig_ID=SeqID_934; Location=213..579; Strand=-
  SCN-specific regions: Sequence locations=1-245,267-268,297-343,365-367
atgtatagagaaaatgcgagaatatccaatagtactaagaatgtaaaattggttgcctttaggcaaagttatgccgtgttttctcgaaaaattcgctaaaatggcggattttacgaaacgacttagcaccacgaaaatgtgtgctcgagtgccgcggggccaagcagtgatcagcggaatgaatgaatggattattatttgagaaatgatcaaccgatccttttttggatttgctaattgaaacaggaatttatttatgcttgctttctttttaaaaattctttaaattaaaaattcgattattttgcagttaacgaatgagagagaggtagagttcggacttttgaaaaaattccggaaaaaataa

SEQ ID NO: 64511 - DNA, 842 bp, Heterodera glycines
  Genomic contig location: Contig_ID=SeqID_935; Location=430..1271; Strand=+
  SCN-specific regions: Sequence locations=1-53,75-121,143-178,212 -503,525-821
gtttacatcgcccgctgaaaaaaagaaaaaattttcctccgccgaccattgcctaatttcatctgccaaaattggtgaaaatcagcaacaatcgttgggttcatcatttgagacaacatttggagaagaacagaaaaagaaaatgaatgatcgaattttgaagaggaaaatgtgagacaaatttaaataattaattaataaaaaattttatggttagggttaatcccttcggactcaatcctaaaaggctcccccaccggtgtactcaaagccaaaaaaacgtaatgagggtacctttttggattttcattcaaaaattatttcccaaccatgaaaaaatgggttaattaatggccgtacatacaagattaatttcttagcatttctgttctgctacaggccaaaactatggaaaacccgaaacatatgctttgtatgtaatcgcgcagggaggggggtaaaaaggccataattacgtacccataaactaattaacaaaatttcattctttcagttggatttgcagcgatgttttgatggacattctgcccttttttgaccactttaaactcggcctcaaattggcactgatttctgaccgtttcgacattttagtggacacacattttgatggcaaatcagaattgacaatttggaggccaatcacaattcgcaagggccctgagccagacttatttgactgtggttccaactctgtgccgtttccgtcgcctgatgacagtccgctgcaactttttgtgaagggcaaatctgagggatttccattgccgcaccgtccgctgcccagcaaaatgcactttaaatgccttcaaattaagtaa

SEQ ID NO: 64512 - DNA, 341 bp, Heterodera glycines
  Genomic contig location: Contig_ID=SeqID_936; Location=103..443; Strand=-
  SCN-specific regions: Sequence locations=1-146,180-341
atggataccgccgtactcgtgatcagcaaccccgaaaacctaagaaaaggtgagttttttatatgaaattccgaggaaaaaattttagaaaaaattttcaaaaaaacttactaattcatcataaatttcaaacaaaaaaaaatcgcttaaaaaatttttaaatattatatttttaaaatgttttcccggcaaaattttgacgggcgaaattttgtcttgtttccaggtgaagcaaactcgcaatgcgataaatcgcgagatttttttttcaacgaatttccatgtcttaaccaaaatcacatcagtgcatgctaataagataatgtagaatcaagaataaa

SEQ ID NO: 64513 - DNA, 719 bp, Heterodera glycines
  Genomic contig location: Contig_ID=SeqID_936; Location=531..1249; Strand=+
  SCN-specific regions: Sequence locations=1-154,197-698
atggtcctggattcggaattagtcgaaatggatgccggatccgtggtctgtgacctcaaaacccttagaaatatgtttccatgacttttgtaaatataaaaaaattttcgaaaaatttatgggggacaacctataatagagccaaatttctaagattattttcttaaagtttttaaatttgaaaattaaaaaaaaagtctcggccggctaaatttcgttcgtctcactgttcaggcatttctccgtgccaccactttggccgcttacactgttcaattttcattggctgatacaacgccaattgtgccatttgaattggtgaacgaacggacccaagaaaagctgacattgatgtacatcataattgaacatgcggattataatggctggcagctgaagcgatgcccaattagtgaaaaggcggcggatcaatgggaagacgaaattttggacgatttgaatggtgtgagcattgatttgcatgagcactttgacattgggtgagcaacgacggcattttttgcaacttttgtcaaatccaattcaaaaattatggcactcattttaggcaattgtctcctccaccagcaacagcaacagaagaagaagaagaagcggaccaaagcaattgaaaggtcggcgggagacaatgaccaacccgaaagatatcccttagaattttttatctggtagctgaaaaattttaaaaactttaatta

SEQ ID NO: 64514 - DNA, 813 bp, Heterodera glycines
  Genomic contig location: Contig_ID=SeqID_937; Location=257..1069; Strand=+
  SCN-specific regions: Sequence locations=1-813
atgaggttaccctggttgtctgcgcctgctgcctcatttgaagctaatgtccagccaatttgggatgtttttgcccgcgaaatttggcccatttttgcgccaaacattcgccacttgctcttgaccgttcgcgatcatttggacaatttgcgtcgctgcacttcgccaacaattctcaccgatctcatcaatttgaattcaatctgttctttttgtctgcgccctgatggaattgccgattttgatgggccaaatttaaatgctggccaagcgttggccaaatggttgcacattccgcgcactgatggccaaccgaagcgattgcgtttttgcaaagatttggaggaacaacataatttcgattgggtcaacagtttcaaagaggtggccataataattatttttgcgaaaatttgccatttgatttgatcaatttggctttttgtttaggcatttctccgtgccaccactttggccgccgcttacattgttcaatttccattggctcctacaacgccaattgtgccattcgaattggtgaatgaacggacccaagaaaagctgacactgatgaacgtgatcagaattggaagtgttaatggttggcagctgaagcgatgcccaattagtgaaaaggcggcgcttcaatgggaattccatattttggacgatttgaataatttgagcatttatttgcataatcacaatcaaattgggtgagcgacgacggcacttttgctgcttatcgaatattttgaatctctgctgatggatggatttgataattaatgttcttttttttctttaaaatga

SEQ ID NO: 64515 - DNA, 335 bp, Heterodera glycines
  Genomic contig location: Contig_ID=SeqID_937; Location=1632..1966; Strand=+
  SCN-specific regions: Sequence locations=1-267,293-335
atgggttttccaaaggcaggccaagatcccggcgcaggattttgttgggttccaccagtccgttttttaaaagaaaatgatggaaaagcgaattttgaggaggaaaatgtgagacaaatgataattaattaatgtgaattttatgattaaggttaaatgattttcggactcaaatctaaaaaaagatcccaccggtgtactgtatttggggggggggggataccctcttgagattgaacttggaaaacatcattacatcaaccgttgaaaaaaaataaaataatttattaaactcattgaaaatttttttaacaaattttcagttggatttgtaa

SEQ ID NO: 64516 - DNA, 371 bp, Heterodera glycines
  Genomic contig location: Contig_ID=SeqID_938; Location=741..1111; Strand=+
  SCN-specific regions: Sequence locations=1-41,63-371
atgttcccaaataagcgcaaatgttctttcaatcccgattgggaaaagcaatatacttttgtcaaaagaagccgaaaagggaatggatttttttattgtgctttttgccaaaaagacatcaatgtcgagtcgatgggagtttcggccataaagtcgcacacggaaaacaaagaacataagcaaattaaagaggaacggcgtaaaagcacaacaattgagaattttgttcgatccaaatcgacgcttaattcaattgaccttcaagttgcaacggctgagggtcatttttaatcttttttaagtgtaaaaatttgtttttaggcacttttgcttaccatgtgtgtaattttaaccatttttcattgcatata

SEQ ID NO: 64517 - DNA, 563 bp, Heterodera glycines
  Genomic contig location: Contig_ID=SeqID_938; Location=2015..2577; Strand=-
  SCN-specific regions: Sequence locations=1-227,249-268,290-331,354 -356,378-539,561-563
atgaaagcaaaatcacaagggattgaacagaaagttcacgaatttttgagtgactgcccttgcatattcaaccatttattgatgaaaaaatggtgtgttcattggtgtgatgaattgacgtgcgcttaattgacagctggcgaggatggcattgattttgtcacgttgccgtggcctggagaaggaaacaatgcataaagggggggggggagacatttaagaatggaaaggatgaaaacgacaaagacaaaacgccgggaaatggtaattaatgaacgagccaaagaaaatttagaaaggaaacgattgaacggacatgcccataaaaggagttttttacactttttgtaaatgaaatttgagtttacctaatcacaaaattctaaaatctgaatctcaaaatgccttttcctcatttcctttttccctttcgcttttttaccattttttaaggtgcgttgtctctttcaatctgtgcccgtatgattttggcaaccgaatgcaagtgcacaacaatggaaaatgcacaaaatatgcataaaaatagaaaaatatacattaaa

SEQ ID NO: 64518 - DNA, 964 bp, Heterodera glycines
  Genomic contig location: Contig_ID=SeqID_938; Location=2745..3708; Strand=-
  SCN-specific regions: Sequence locations=1-89,141-363,396-494,545 -648,670-683,715-733,765-801,836-870,944-964
atgcgcatgaacaccggcacagcgtacaatgccaaatggtcattgagacgggcggacagttggtcaatgagtgcctggcataacgttagaattaaaaaaaaacaaaaattgtttttataataatctatctaataaatattgccctccaccaatgttagtacgatcattcccgccgtccatctcggccaggcacttccacaccgtacatagtcacgtcaagaatggcaaccaacggctgctagacgcccttcacctttaatttaaaaaagatttttcttgtttcttttttttataatatttttctgttattcaaagcaaattcagtgtggacaactcatttggagttgaagcaaatcaggtaaaatcaaacaattaaaaaatatatagaaaatattagcttaaaggatagagaacacgttgtcaccggccgattggcaattcttaattagttcttctgcgtgtcaccctcgttcacatagccttcaaaatgggcgaaattattaatgaataaattatataaaaaaaatataaattagaaaaaaaacttccaattcacataacagaaatgctatgctgcccacagacagaaagaagaacaatttatttacgtctgctgatgaatgcctttctttatccctatttttcgctatttttctacgtttctccctcgccatcccaactcttctctctctctctctcactctctctctctctaaatttttcattacagtcacggtcaaaacaagcaaaacaagaaacgaaaaaccattttactcagttgaacgtacaataaaaataaaggaaacaatgaataaaataagttattgttaattattgggaaagtattaaaatgtttaaggtgaaaaaattaagtaaagcaacggaaaaaatggagaaaaagaaaaggacaaaaaagaaaagagaaagtgcaaagaaagaaaaactaaactggaaatggaaataa

SEQ ID NO: 64519 - DNA, 889 bp, Heterodera glycines
  misc_feature (688)..(688): n is a, c, g, or t
  Genomic contig location: Contig_ID=SeqID_7340; Location=448..1336; Strand=-
  SCN-specific regions: Sequence locations=1-376,413-644,666-752,774 -775,801-889
atgcccaccggatggaaatgtgccgacaaggccaccccaaattttggatccgccgcttccgaacagaaattgcaaggattttttagagtgagacttcaatggcacatacataaatgacaaatctcagtcattgataatttgttttgattatatgtggattttaaaaatctcaaaatatcgtcccttttaaaagctaatctttttgcaaacattttttatttttactcaatttattttctataatatagcccccccccccctaaattagacccactctcttaaataaagctctcatttagaaaggggctgaaaaatcaagcacccagtggcttaattttagtaaatttacttaaaaataaaatgttttcgtcgacagattttaaaaatattttttttaatttttagtttttttgcgttttatttaaaaattgtcataagatataagcctttagtgattttgttgttttaagaagaagcggaatcaaaaaaaaaaaataaaccaagatatacagttgttcaccatggaagcgaaatgttttatgtgggtcaaactgtataagtacccgccatttatataaataccgttttgcctataattatgcctttttacctttcatttttaggtcagttcgtttggtggcaccgatgagcagcagcaacaacaattccagtgtggggggaagggcancacccgaggccgcgaagcggccgagtgagtaccttcggtgcaggaaaattattaaggaagagagttcattatttatttgttttttgcataattaatttataaatatttttttcagaaagggttctgaaacgcaccaaattttatttacatgttagtttaggcactctgatgctttttctatcaaattgggagatgaataaa

SEQ ID NO: 64520 - DNA, 451 bp, Heterodera glycines
  Genomic contig location: Contig_ID=SeqID_7341; Location=339..789; Strand=+
  SCN-specific regions: Sequence locations=1-281,306-451
atgagttcaattatttggcaaattgggttgtttaacaaattgcctaacgggaaagctgaatgtgttgagtgcaaggctaaccaactgcaaaaatttgagtttgaacggagccatggcagcctcaaatctttgattgtccatcttttttcaaagatccatgccaattcgacgtatgctgagaagtacagacaattggaaaaaacctcaaacaaggatgaatcccagaaaaaactctcaactttttttccatgttcaagcagtaatttaagaaatgaaatgactatttaaattttaaaataattttaggcactctcgctgtgatggacaaaaaagtggtcaattttttggtgtctaccaacacttcattcaaagtggtgaatcatccaacatttcaatcattgctcgcaccacaacatattaaagttcgttattcgttagtgtattaaaagaa

SEQ ID NO: 64521 - DNA, 1703 bp, Heterodera glycines
  Genomic contig location: Contig_ID=SeqID_7341; Location=879..2581; Strand=+
  SCN-specific regions: Sequence locations=1-86,108-842,866-1033,1055 -1626,1648-1703
  Gene Ontology: Mol. function=transposase activity; Cellular component= nuclear chromosome
atgaactcaaagagtgtgaatcgatttcattcacgacggatgcgtggagtgggccaacaaacaatttcctatggtcagcataagaatgtaaaccttttaaagctgcattttagtttgactgctcatgggatcactcaaaattggacaatgaaaaatcatgtgttggcggtgactgaatttcagggaacacactcaggaaaagaaattgccaaattgttgtcaaaaatcatctcggactgggagatttgctccgcgaaaattcactgttttttgcgtgactctgcagccaatatgaaatcagtagtgttctattttttcatttgatatgttttgttttatttttaggcgttctcccagaccattgtggatgagaacggtttgacaacccaaattttggcatatgaaaatgtcagctgtggtgctcatttactcaatctcgtggtccaaaaaagtattaaatcagaaaggattgccgacctgcttaaacagtgtcgtaaagttgtcgcccatttcaaacactctaacaaagcattaggaatgttaaaggacatccaaatctttcttgatcttccggaccattcccttttacaagtaaatcaatataaatcttttgagccaaatgaccaaaatttaggaggtatcagtgaggtggaattcggctcttgggatgatttcgcgtctgtttgagcaacgggaagcgctgtaccagtacgccttcgaaaatcgtaattttgagatgacgttaacaaatgaagagtggggattaatcgaagaaatgatttctttgcttcaaccaatcgaagacgcatcaaagatgcttgtaaaagcaccattgtccggtgatttaaataaattaatttttaaagcccgaaacccagtttagcccaaataccaattgcactgacccttcatggaaaactttatactgccaaattaattaacaaagacattgatgtggtgcgttgttcattggttaatgagctcgagaaatatttttttgctctccgtgaaaaacggtataacattaatacacatttttcattttaaaactattatttaagagttcattgtttatcgacatttttggatttacgtttcaaggacaagtttttgctcgaaggacggaacatttttcttgctaaaatttcgtcatggctcaaagaggaacttgacgatttcatattgccattggttaatgaatgtgatgaaattgctttggctccgtcgcccaaaaaacagaagctttcgctttttgatgacctcaatgatattgcttcaacaagcaacaaggagaatgcaggcagttaaaaatttgagttttttaataaaaaaatcatttaagatccttcccagaattcatctgaccttgatgatgagctcaacaaatatttggccagtggttgtgtaaattcgcgcgaggatccgctgacagcttggcgacaaatggcacccaaattcccaattttgtcaaaaattgcgcgcaagtttctcactgcacctgccacgagtgtcccaagtgaagccacttttaaagtggcgagagacgtttacgattacagaaggtcgcagttgaagccagaaacagcggaaatgttaatctttttgaataaggcacttccaaatatcaattacagatattaaatttttcattatctcgcaattttatttttctactggtcaaaaaatgttatttaatatttgta

SEQ ID NO: 64522 - DNA, 108 bp, Heterodera glycines
  Genomic contig location: Contig_ID=SeqID_34823; Location=455..562; Strand=+
  SCN-specific regions: Sequence locations=1-108
gaaccacagtatgagctggagtgtttgaatagctcgaacaatgtcaaggatcggggtcggggaccgggggagctcggggacggggagcaaccctaatattaataatca

SEQ ID NO: 64523 - DNA, 647 bp, Heterodera glycines
  Genomic contig location: Contig_ID=SeqID_34823; Location=706..1352; Strand=+
  SCN-specific regions: Sequence locations=1-147,198-290,312-434,456-647
atggcaaaagcaattaaaatgctctttcacttcatccgaatatactttcatcatctcttttttgcaataatcacggttatttacgtcagtttcgttaaagcaaacgaatgcgtagaacactttcgcatctttttcagccttttcttaatatgggcatttgtgcagtttcgttttgaggaaaaaagaggggaaaaatgctaattgatttaaatgtgaaacggtcagcgattttttgtgagtaaaatccgagatgggcattttatttgggttttataggttaaattgcaaggttttcatttatattcattaaattttcagcttaacggcacattgaacccacaaaaatttgaacgaatattttttattttgacagtgtcagaatttgatggttgccacactctctggccgtaaaccgcttttttttcgcggcacgctttttccaaaaaacttccgtgccatccctacaagtgacaaaccagcaaaaaattcatttttttattgaaaatttcaaaaggagtcacttaaaaatagtgtgttttttactaaaattaatgatggatttttatatgaggtcattgaaacggaaaagtgccccagaatttgcacaattgtttattaaaagaccatttttttcatttacttttgta

SEQ ID NO: 64524 - DNA, 76 bp, Heterodera glycines; identical to SEQ ID NO: 63674
  Genomic contig location: Contig_ID=SeqID_34824; Location=736..811; Strand=+
  SCN-specific regions: Sequence locations=1-76

SEQ ID NO: 64525 - DNA, 173 bp, Heterodera glycines
  Genomic contig location: Contig_ID=SeqID_34827; Location=755..927; Strand=+
  SCN-specific regions: Sequence locations=1-79,101-173
tgtctaaacgcattcgctttcttcgtttgggaatacaaaccgtcgatgttggattttggagagaaaaaatccaaatgataatttatattttggataattaagctttcattttatactctgctttcattgttaattcctgttttttgtacattgataaagttttcataaacatg

SEQ ID NO: 64526 - DNA, 345 bp, Heterodera glycines
  Genomic contig location: Contig_ID=SeqID_34828; Location=1216..1560; Strand=-
  SCN-specific regions: Sequence locations=1-345
atgactcgggaatattcagacagttacattctggagtatgtgtcggcgggtccaaaacaatacgccttgaagcttaagaggaaaaaggatggggtgatctggtacaagacgaaaatccgggggtttacactgaataaggacaatagagtggattatgaggagttcaagtcaatggtcttgagctacacggaaggagttaaaaaagtgtttcgctatcctgagaagattgggccgacaagggatagcagaatgctctcgcgggacgtgaagaaagaatattcgccagtgcagaagaaggggataattgatgatgactataatgtgttgccttttggatattattaa

SEQ ID NO: 64527 - DNA, 233 bp, Heterodera glycines
  Genomic contig location: Contig_ID=SeqID_34828; Location=619..851; Strand=-
  SCN-specific regions: Sequence locations=1-233
atgaccgtggatttgtattgcggcaccttgtcagatccagtgataatacctggacgcccaccgggacagattacggcggatgttgttttcaatgagtttatgcgccgacaacaatcataccgggatgtcaaccttttggaagaaagaatttcgatgaaaatgacaaccttttcattaccattgcggtaggcaaatactccatgaaaaaaattatatttttattcagaagatga

SEQ ID NO: 64528 - DNA, 487 bp, Heterodera glycines
  Genomic contig location: Contig_ID=SeqID_34831; Location=329..815; Strand=+
  SCN-specific regions: Sequence locations=1-487
acatgcaaaaattgccgtcagctgttaccgctctactcagaaacgggttcatctccacatcaatgaaacagtcgacggtggacagtttgatttggtcgatgaccaaagcgaagcgacagaggctacaagtgaccaaataattgaaattgcataaccaagtgtatggcatttgctcaattaaattttacaatcgcaggtcaaaaatggattcctttcccatttctacgacatttcccaagtgatcaccggctctttgaccatgggactgctcggcggaagcgacaaagagttccaagaactctgtgcctattttaaggttccacaattcaatctctgcgtttaatgaataatggacaattaatttcaggagcaagtttgtgcctttgttgtcgatattttcaacccggacaaagtccggtttacaacggtcgaacatttaacggaagacgtgaagaaactgttaatgtatcgaattggcttaataaag

SEQ ID NO: 64529 - DNA, 65 bp, Heterodera glycines
  Genomic contig location: Contig_ID=SeqID_7343; Location=56..120; Strand=-
  SCN-specific regions: Sequence locations=1-65
atgattgagccgataggaaaagccaacttaagaaaggcatgcgcagttagagacacccgttccat

SEQ ID NO: 64530 - DNA, 902 bp, Heterodera glycines
  Genomic contig location: Contig_ID=SeqID_7343; Location=647..1548; Strand=+
  SCN-specific regions: Sequence locations=1-234,256-294,316-335,370 -371,395-534,573-645,667-784,807-902
aaacaatcagatgagtacaaagcattggtaaatctgcgcgactcaatgcaaaaaaatcatgaaagcatcatgaaagcaatttcctttgctcaagaaatgattggaatggaaagaaaattggacgactataccaatgtaattatatcaaagttcacagtttttggcaaatattttttggctccggtcagacattagtttttcgtatttaagcgccatttatggcatgttctaatcgctaatttaaatatttttcttagagttacttttatatttgaaaaatcaattataaaaaacctcaatttttattgagttcttaaaaattatttgtcgttgagaatttaagataaataaatattaaatatttaaattccaatttaatttagaatgttcgtattccgattaaaaatctttttgtacacatgcgaaaattttgggacccgtcaactgacaaatcgccagaagctgttgaaattttttcaaaagcctgctacacgaccgaattggccaacacccctctgggcatactcaatgttgtaaattaagcagaaattaaaattaaatttgaaatttttccagtacattcatacccacactgtcgaaggttgcaaaatggggttgaaaccgaaccaaatctcgctcttgtccaaatttgtgcctttattacaaaaaattcgaatgaagcttggcgatcaaatggacaaagacgactttaatacacgcgtcccaggtaataggatgagcaaaaaaaggatttaagggaaggtgccaattaaagatcgcagtcttgatatattttctgatttcagtcaaagaattcttttttttagttctaacaagttggttcatggaaattgacacaaaggttgctcgaatggtgttgggaaaaatcaaaaaattaattg

SEQ ID NO: 64531 - DNA, 865 bp, Heterodera glycines
  Genomic contig location: Contig_ID=SeqID_7344; Location=844..1708; Strand=+
  SCN-specific regions: Sequence locations=1-555,608-753,775-865
atggttggttccttttgtgccaatgtgacattcaaaaagaacccaacggaaatcttttggtttcaaagggagattttgctgacggctgttccaatcatggatcacgtacaaaattacgtggaaaatgaaatggtaggtcataatcgcaataacaaaaaccaacagttcattactattaatgatttaaatcagagttgccaactgaaaattttcaaaaatcagcatttgaaaattttattcaaaatgaaaaaatcaataaaatcagtaaaaatattttttacttgaattttttaagtcggcggggaaaatctatgaaaggagtgccatttgttaacagattttcacaaaaataaccaatttttcgattttgtgccaaagtttttggggtcgggcggtgccgataggctaaaaatgaccatttttgatgaaattattaaaatcagcataaacataataattcataaaatcacaaaaaaaatcatctttcaatgataacatcattaaccctttgaagtctgcaaaatgatgataaagcaacagagttggctaccctgctttaaataaataaaaagttttaaaatgattaatttaaaaatttaattttattcaggaaaaaacatttccaaagattgaaattggcttagtcaaaagtaaaatcgaccaaatgagtattgatcagccagtgaaagagaatgccacaattttcaaagcaatggttgaaatctttaatgaactcaacaaatatggaaacagaagataagtttaaattttcctccaaaatattcaattttttcaatcgaaaattaatttaaagcatattttgcaaaaaactaaatggtttttactcattctaaatttttccaaa

SEQ ID NO: 64532 - DNA, 272 bp, Heterodera glycines
  Genomic contig location: Contig_ID=SeqID_7344; Location=2442..2713; Strand=+
  SCN-specific regions: Sequence locations=1-272
acaacattgacaaagtagcgcttcttttggagctgtttgagcggcgacacttgcccctgacaaacgaagactttttccataatcttgcaattttgcgggattttggtccgaccggaaaatgtgctgtgcgagcatcgccgttttactacccacttgcaaattatacggatacgtgtacggcttcgtactatttttcgggttcattcatccatgcatgtgaatcgtacattgtttatttttttgtgtgatgaatggcacattttggagcaaaa

SEQ ID NO: 64533 - DNA, 950 bp, Heterodera glycines
  Genomic contig location: Contig_ID=SeqID_34836; Location=409..1358; Strand=+
  SCN-specific regions: Sequence locations=1-199,231-253,275-328,377 -398,422-586,627-950
  Gene Ontology: Biological process=coenzymes and prosthetic group metabolism
atgttcggggaggaaaagcaaccgctgaatcacaaggatgaggaggatggcatcggcatcaaagtcagtttttggaacatatgtagcaacatccgatcatctctctattcttatcagatccaacatttaagggatgggaggagatcaagattcttttcactcagttaacctaataataattaatgagttttattaacccaataataataatgatttttaaaataaattttgcggaaagtggaataaaattgagaaaaaatccattttaaaatatgaccgatctgttaggcccacaaaaaaagataatggcatggtttaggaccaaatgaaatattaaaattaatataattatatttttatatatctattttattttcatccttttaagtcacggacacttttttaaattttaaaattttaagtccggacgcattggccgtattttggagggtgtcacacgaccgcagtaccatgacggaatgttgctgcatacggtcaaactttacaacattgtgcaaccaaatttggcatttttcgggaaaaaggatgctcaacaggtggattttcacgacgggcatttttcggcattatttttaatttttaaattaaattaaatcattttaatacagaaggtcctaattttttcgaatgctttttacatcaccgttttgaagctgttcgccatccaacaaatgaccgtggtcatgaatttcccggtccgtgttgtgccggtggaaactgaacgagacccgcacggtttggcactgtccagccgaaatcagtacttaagtgccgaagaacggcgacgggcattgtgtctgtacaatatgttggtagcggcacgcaatgccgcaacgaatggtgccggtttggcctcagttgcggcacaagcgcaacaaatgttaacccaagcggaaaagcatgacggcataaagcaagttttcatctga

SEQ ID NO: 64534 - DNA, 557 bp, Heterodera glycines
  Genomic contig location: Contig_ID=SeqID_34837; Location=255..811; Strand=-
  SCN-specific regions: Sequence locations=1-156,194-309,347-512,538-557
atggtggacaaaggcgaaggtgacagccgctaccaagaattgaaggacggaatttaccatggctaccagccgttgcgtgctcgcaaaacgttcacttacacttacacacccgaatttgtgccaggagcattgaacatgtaaaatttgaaacatttgttttaatttaaaaaatgaattattaattaattaattagtgcggttgcccgtgacctcgactccatcccatcggggccaaaggacgacggcgcacattaccaaatggtcacggcacacaaagtgaatagggccccaaaggtgcggagaaatgccaaaatataataataataataaatatgattaataaaatggcaaatctttaacaaagcattttatcggtgataaaatggctgaaacatttccaaaagttttgttaattctaaaatattttattctaatccaatctctccctctgtttaatttcttttcattgtcagcccgaagatccgtacgcgtggctccaaccgcaggccccaaaacagcagcaacaacagcaggaggaagtgacggaagaagcatag

SEQ ID NO: 64535 - DNA, 879 bp, Heterodera glycines
  Genomic contig location: Contig_ID=SeqID_34839; Location=139..1017; Strand=-
  SCN-specific regions: Sequence locations=1-80,102-117,140-411,433 -611,653-879
atgacttcaaaacgcaacgggactttgcaaaaaggcggtccgtcgaccaaaaaatgggattttcgagctatagggtaagcaatttttaataatatatttaagagaaaagtgtaatcaataatttttcaggaacaattttactgaggaaatggaaaattataaattaattgacgaacggtcgacgatttgcgaaaaatttggattcacgaagaacattacggaatttcggatcaattcggatgtgagacgccctgacgaagcgatgagggacgcaatcgacacaatgattaaggcggcttttaagactacggaagaaaggatgaagcggaaagtgcggatgtttggtgtggcaataacgggtgccgggcttgcttccccggtttggttaccgtacagggcgtacccgcagaacaatgcggatgttattatgcaggagattaataagttagggcagagcggggacggagatgaaaataagaaaacgcttttgttgtcggagcctattatgatgaaaattacttgcgtcaccgtgcccagtggagaagggccgagaaatgtacacaaatttgacttcggattcaaggaacaccaacggataaggtgagtttttgagaaaaaaaaagaaaaaacgagaatagaaaaaaaaagaaaaattataattatttattaaggatttcgaatgtggataaaatttgtttgttttatgcgttggtggcgtcaaagctttatttggaagtgcatcggaatatttttaatcgttttatgaataatattatgagacaacgagaggcggctgttgaactattacgtaattgtggaattgatattaacgaatatagctatggagtggaacacttgccgaatgttcagaattattgg

SEQ ID NO: 64536 - DNA, 1423 bp, Heterodera glycines
  Genomic contig location: Contig_ID=SeqID_7345; Location=586..2008; Strand=+
  SCN-specific regions: Sequence locations=1-250,293-412,449-595,618 -886,908-1069,1091-1224,1247-1423
atgttcactccgaaatttgcttcattaatgtttacgggttcatgctattatgtaaacattagggttgagcggtaccggtaccggtactggccggtaattaccggtttttttggtaccggtaccggtaccggtaccggtttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatgtggtgtagtggttaaactttctacctttcataatttttcgcctgggttcaattccccacttggatagaatattcctcacattttttttaccattattttaattaaaattttaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgctggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctacatctgaattttagtgttctttatcctgaatttgaaaaaaaacttggtcaccctcaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctaatagaaaccatggatttagacaaaaacacccataaaaattgactattctggcataatttataatccttaaatttggtcatttttagacaatatctgtgcaattataccaaaaaagaatggaatcgaggcgatacatcgaataaaggaatgtggagccaaacacatcattcaaaaaaaaaaaaatttttttttgagattttttggaactaattaaaaacaaacccccgccccgttcccgggggcgcgaaatttctcacccccgcccccgcccccgcgactctgacccccgcaatcccccgcccacgcgaaaagccacccccgcaaccacggggtccgaaccctagtttttcttattgttagaccgatgaa

SEQ ID NO: 64537 - DNA, 75 bp, Heterodera glycines; identical to SEQ ID NO: 54636
  Genomic contig location: Contig_ID=SeqID_7345; Location=896..970; Strand=-
  SCN-specific regions: Sequence locations=1-75

SEQ ID NO: 64538 - DNA, 1412 bp, Heterodera glycines
  Genomic contig location: Contig_ID=SeqID_7346; Location=205..1616; Strand=+
  SCN-specific regions: Sequence locations=1-355,384-548,579-1057,1086 -1412
atgggacgaaaagaagacaactttggtaattttctcatttttataattaggggtggatttgagtcaattttttttgctgtttttaaatgaccctaacctaattgaaagaagtattttattctttgtttgaagcaatgcatttttgttttatttttttcaacattttggagatattaatgtggttgaaatttttagcttgaactgtttggaaaatcgacatcaaaggattgtgttgttcagtcgccaaacagaacattgttttgtgcatgtgaaggcccgttttacacccaaaatcgtccattaatagataattctcaattttttggtacgtttgtttctaaaaagtatgaataagataaaaaaaaatatttattatttaatttcattggaaatgatttatatttgtattaaatactattaagcgaaagttagggacaaacccgagtaatcaaattcacgaaaatgtggatatacctgtacacattgtatcacttattgtacaattgaatattgataatttatagaaaaataacaaatataaatccacctttaaataattaaattatttaaaaatttttcccaataagatataatactttttactttgtcttcttaatatgcatatttttatagcggcaatggatcctttttggtcggaattaccagcacgaataattggcacatgctgcatggcatcagaagagccaaaatatcgcggagatgatggtggttaacagggttgtcataaagagactttagcctcattttgtggctttttgagaagccaatgatgctaatgttttcaaatgaggcttttgttttgttttttgggaattttaagatttttgggaaaacttctgaaaaataatagctatttctaatcaaaatctaaggcttattgaacgcggatgatatttcttctcgtctgtcgaactgctcttgctgcgagaaggtattgactagtgatcgaactggccaaaagcttgatttaaaaatttgtaaaaaaaatttcttaggagccaaaattgttgaagatttccatcgtaagagtgtctacttttaattaaattaatcaaatttatttagaaaaacaaaatcagtgacacaccagaatgccgaaaaatgattgaagaaatgaggaattgtatatgcccaagccaagtggataaacgggatgaatactaccgtgacgtattcctaattgattttaaaacttttaatagtaaactgtttttaattcgattaaattaggcaaaaccagttgattttctgccacactcgtgcgtggaagaagaaggttggccgcaaactgattgctgtcccgaaaacacccgcgttgaatgttgcgcattccatgaaacggtttatcagactagcaaaattgctttggatatttcaaattattattttaa

SEQ ID NO: 64539 - DNA, 674 bp, Heterodera glycines
  misc_feature (546)..(546): n is a, c, g, or t
  misc_feature (554)..(554): n is a, c, g, or t
  misc_feature (609)..(609): n is a, c, g, or t
  Genomic contig location: Contig_ID=SeqID_7346; Location=1834..2507; Strand=+
  SCN-specific regions: Sequence locations=1-34,56-296,333-674
atgggacagtaagttatttgttgagatagcattttatcctcaccagaaataaaaatcttcaattaaatcctcatgttgtcatgaaacaattccttttttaacatctaaaattcaaaattaagttaatactgtaaattttgaagatttttatataaatccactaattattttagccattaaattgccttgaatgtgactacaatgttttggaagcacgactgataatgctcgtcaaaatagaggacgattcaccacttttttgcgagttgaaaaaatcctgcaatccgtactttttcttattaattatacaaaaatttttcaaaattttttaactagtaatttgtcgggcttggcgaaatttggccgccgtttcaacgcacacaaagaaaaatgtgctgcattgatcaagcagcagcagtcgtcaccatcgacggagcttaaattggaactgcgtcaggaattcatggactacagcaaggaagggtcctttctgatcgattaccttcgtgatcattgatcagtgccagaattcggacaattccctcncaaaaacncacaaaaattaataatacctttaacctctcccctcccaaaaaaaacccacaaatntaattcctttatccccctcccccaccaaaaaacgaaaaacaagtttcttcatcccacaacaaaaa

SEQ ID NO: 64540 - DNA, 785 bp, Heterodera glycines
  Genomic contig location: Contig_ID=SeqID_7347; Location=349..1133; Strand=+
  SCN-specific regions: Sequence locations=1-19,41-471,573-745,774-785
atggaaggatatggtgattttttctctatgtttccttcccactatactaattttctcaaatttcctttcacccaattttgaaaaagtctgaaatgtataaaatagaaaaaatgtcgaaaagttttcagtttatgaaagccaaaaaatgaaatatgctgatttgcagcactaaaatacttgaaataaataaaccgactaaattatcggaccaggaaataacgtcgccagccgaaacgtcgccgggcgaatttttggaccataacttttttcctactcaaccatattaaacattcttggtattgttccaaagcttatgaaaaactcttgaataatttattttattttcacatatttttgtcttttttaattcctgtgatcatccatatatttttgtcacttactctacgacatttatctgaatagtcgtcagagtaagtggttctcgcccttctgatgacttttttattttttatgaataaataaataaataaatgtaaaaaaagtgatgaaaaaaataaatgctaaataatacatgaaagaacaaaaaaataataaatacaaatatattaatagggataacatttatagttgctaaaaactgccaaaataattaatttttagtttctaaaaaccccaaaatagttgctaaaaatgggtaaatagttgctaaaaacttccgaatttaggtgtgtaaaatgacaaaaattttattcaaaagtcaacaaatattaatccaaatcattattgagataaaaatttttaaaatagaaattcttgtcaagaaa

SEQ ID NO: 64541 - DNA, 153 bp, Heterodera glycines
  Genomic contig location: Contig_ID=SeqID_34844; Location=450..602; Strand=-
  SCN-specific regions: Sequence locations=1-153
gatcttttaggccaagccaaaatttttgtttagtaatttattttgtttattttcatttttatttacaacagtgtccaattttctggtgtccatttttccattggtgtccaattttcggtgtccaattttctggtgtccaatttaccgggagcc

SEQ ID NO: 64542 - DNA, 304 bp, Heterodera glycines
  Genomic contig location: Contig_ID=SeqID_34845; Location=121..424; Strand=-
  SCN-specific regions: Sequence locations=1-304
atgcgaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagag

SEQ ID NO: 64543 - DNA, 400 bp, Heterodera glycines
  Genomic contig location: Contig_ID=SeqID_34846; Location=1..400; Strand=-
  SCN-specific regions: Sequence locations=1-192,216-359,381-400
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaaatttggtgcgctttagagcactttctgaaaaaaatatttatgaaacaaaaaaatcgatttttttcagtgtccgtttggggtactcaaacatttatggggagcaaaaatcccacgcagaattaaagt

SEQ ID NO: 64544 - DNA, 744 bp, Heterodera glycines
  Genomic contig location: Contig_ID=SeqID_34847; Location=123..866; Strand=-
  SCN-specific regions: Sequence locations=1-60,83-158,188-744
atgacgttttttagacttgcattttttgcaaaattatttgcaaacataagaattctctttaaaaagaactttaatttaattgtaagaaaataaattttgtgtcactttaaaaaaatggaggtttgatcgaggaaatttaggatttgaagaatcaaaacatttaataaattttttatatacaatttttgcactatattaaaagtcccgcattttgaattttaccaaaagttaaaacaacagggggaccctttggtttgcaaaaatttttaatgtatattcatgaaagtttattccctggggttattggggtccatgacctcatattagatgtcagattcgtgatcagcgacctctaaaaccccggataacaaattttcatggttttttatcacaaaaaaaagttttgcaaaacaaaagggtcaccccttttgtttttgataaaattcaaaatgcgggacttttaatatagtgcccaattttttcttactttttcgagtaccctcacactcttttttttaaataaaaaatcgcataatttccagggtgttttcccattttcagcttcattatgctgccctggtgtccacccaaatgttggagacactgcttgaacaagaggcgggcaaggcgttgatcaattcgcggaacaatgcgggcgaaacgccgtcaatggtcgcgctgcgggcggtcaatccgttgtgcatgaaaacgctgttcaaccacgggggcgacctgttgaataaa

SEQ ID NO: 64545 - DNA, 645 bp, Heterodera glycines
  Genomic contig location: Contig_ID=SeqID_34848; Location=176..820; Strand=-
  SCN-specific regions: Sequence locations=1-188,217-452,478-520,547-645
atggcattaaagaattttattaaaatgtcagaatgggtaagtaattgttaattcattcttcttcataagatgaaaaattaattgaaaatgtgaataaaaaatgctaaaatggaaatattctatgattgcaagcgtttatggcgtgtaaaaagtcaacagaaaaagaaatgctagcaattacatattagtaaaattatttatttataaatttaattacaacaattttccaaccatcaaaaataaaggaattcatttttttttctttttaaaatatagccaaaaaccaaaaaaaaattattttatttggttacaaaatcgtagataaatatttaaagtttcaatccaaaaatccataaaaatgattttttgggcaaaatttgttaatatttgcactctaattttcaatatttccccctgcggctcctattggcattgatattttttaaaaatcgaacaaaaatttacaaaaagtggtgataaaaactccgaaaaatttagattgaacaattttgacactgactttttttaaaatttaataaaataatagagaaatatttggctatctaatcatatcaagagttgaattaattaactttgaacaattttcatacatttaagctatcttacattttttatgacaataaa

SEQ ID NO: 64546 - DNA, 282 bp, Heterodera glycines
  Genomic contig location: Contig_ID=SeqID_34849; Location=40..321; Strand=+
  SCN-specific regions: Sequence locations=1-44,66-282
atgcccatccaacgaggccgcgggttggcggaagaacgcttcacaaaacagtacatgaacacggagctgaaaatgttttcagaactattaaatgaaaatcaattagaagcaattaagcaaattaatgccaataaaacttacacaatgtcagcaaattcaatgagggcacaagtgaagaagctgaaacgaattgcattaacaaattgtaccgaaaagggcagtgatcaggatcagaccccgaattcaaacaaaaagtcgaaaattcaaaactttcaaatttag

SEQ ID NO: 64547 - DNA, 661 bp, Heterodera glycines
  Genomic contig location: Contig_ID=SeqID_34851; Location=33..693; Strand=-
  SCN-specific regions: Sequence locations=1-594,616-661
gttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcggcagtagcttccctatagcctgtactttaattctgcgttggatttttgctccccataaatgtttgagtacccctaaacggacacttgaaaaaatcgatttttttgttttc

SEQ ID NO: 64548 - DNA, 1086 bp, Heterodera glycines
  Genomic contig location: Contig_ID=SeqID_7348; Location=51..1136; Strand=-
  SCN-specific regions: Sequence locations=1-687,709-768,790-817,839 -1086
atggcacaaagcaaatggaaattgtcaattcccgttggcaaccgttgccaattccgtcgccagacaaagtcaacggatttgaatgcatcgagatctcgtaaaattggcaaaattcaaaagtttgtcaacatttcccattcattttcagttacatagaccaaaatgtcatcaaatttctcctccgttttcatcaacttttcacctcctgtccaattcatttgatcatcaacgtaaccgatgacagaattttggagttcattttgcgcaaaatttggccagtgttcggaaacaaacttcgtggtatgttttgtttacgggtgtttatcgccgttttcggaaattcgtcccctcacttctcaacgattgtacagctgttcgcgttctctctttccacaacaatgccatgccgtttggtggacaagcggtggccaaatggctttttactcgccttccggacaatgggccaaaggtgttaagttgctgtctgctcgatgatgcaaatttgaagtcgacaattggtgtcatcaaagcggtgcttaccaacagggctgcaaaaaatatgcacgaaaaatggccaaaatatgcgcataaatatgcaaataaaatcgtgaaatatgcatcaaatatgcacagaaattgcaaaatatgcatcaaatatgcacaaaaaaacttgaaaattaggggtgcaaatttattttaaaaaattttcttcactagtgcacttgccaatgagctgctacatttcttttataaaattctctttagcaaatattgacattttttaaatcaaaaattttctcatgaaaaaaaaaatttgggggaagaatttttgagaaaatttccaattcttagtggtgtttttaaaaattttcggtcgattcttaggggtgtatttttttgaattttttagggccgattcttaggggtttccgttttattgaattttttttaacaaattttccaaaatatgcaaaaaatctgaaaatatgtacaaaaaatgtcaaaatatgcatgaaatatgcagaaaaaccctaaatatgcaaatatgcacaaaaatcccgaaatatgcaaaaatatgcaaataaa

SEQ ID NO: 64549 - DNA, 850 bp, Heterodera glycines
  Genomic contig location: Contig_ID=SeqID_7348; Location=2546..3395; Strand=-
  SCN-specific regions: Sequence locations=1-262,284-372,395-502,524-850
atgccatcgaataattcaagtgccattgaacgcagtaaaataagaaagaaaaaaaatgaaggagaaatgaacgaaccttatgctgtcgctgatgaaaggtaattaatattaatgagggggcataaaataattaacggcaaaacgatgacccaacaaaatggaaaagaactgaaacattatttgaattgtattttctcttttcaatcattaaccaataaattatattgctcggacattacttcgtttcgaattgaaaatttgcgaaaaaattatttacataaattcttccaatgcaaaaacttttgcatatttttttagtttagtttattaggccccctattatttaaggttagggatgtgcgagagtctcggttcccgactcgggaaatttcccggatttttcgcttgccggtctcggttcccggtctcgggtttttagtatcggaaaccgcgaaatttttacactgttaagaatgaccctttcggggagagggtcgacggtaaagggagaaaagaggaaaaagtccgacggtgccgttaggcgtcgccggatttttttttattagtaatttcgttctgatttgttaatagattttcatcaaaaagactaatttttttctgtctgtgtatgaacactgactcactccgttccccgtccatcctgccgtttccgtcatcttcgccatgttttctgcggcaggacgccgtcaaattgcacctcgggtggtgcaaaagtatcgatattttgacattgacttctcagtgtgtccattattttgaatttgcattggctacacttgaaagattaatgggatttgttcagcgccgaatgaatgcatagtaaaataaa

SEQ ID NO: 64550 - DNA, 1814 bp, Heterodera glycines
  Genomic contig location: Contig_ID=SeqID_7349; Location=644..2457; Strand=+
  SCN-specific regions: Sequence locations=1-840,862-1138,1160 -1414,1436-1528,1550-1577,1599-1717,1739-1752,1789-1814
atgaatcgacggtaaggaaattttttttagaaattagcaatttttaattccaattagcaatttttaattccaattaaccatttttaattccaattagcaatttttaattccaattagccatttttaatttcaattagcaatttttaattccaattagcaatttttaatttcaattagcaatttttaattccaattagcaatttttaattccaattagcaatttttaattccaattagcaatttttaattccaattagcaatttttaattccaattagcaatttttaattccaattagcaatttttaactccaattagcaatttttaattccaattagcaatttttaattccaattagccatttttaattccaattagcaatttttaattctaattggccatttttaatttcaattagcaatttttaattctaattggccatttttaattccaattagccatttttaattccaattagcaatttttaactccaattagcaatttttaattccaatttttgtttctcatttcagttggatttgtaacgacgtgtggatggacattttgcctcattttgaccatgctcaactcggcctcaaaatggcactgatttcgccccgttttgatgcgctggtggacaaacatttcgatggcaaaacggaattgataatttggaaatggatagtaattcgcaaggacaacggaccaaaatcaaaactgtctgtatgggtcgatggcaaatttgtgggatttccgatgccggaccgtccgctgcccatcaaaattcgatttaagaagcttcagattaagtaattttagacttttgtatatattaaagcaatttttatatttcttcagttacattgaccattctgtgctcacatttcttcgttccaacaagcaaatttgggacagaagtggcatcaaattggaagtgtttgtgtattcatttgatacggatgtccaaccgacttgggatgtttttgtccgtcaaatttggcctatttttgcgaaaagcattcgtcatttgggctttcgcaatggcgatcatttggacaatttccgtcgtcgcacttcaccaacgattctcactgatcttgatcaattgtattcaatcgattccggtgctctgttccccgatggaattgctgatgatgggccaaatggaaatgctggtcaagcgttgaccaaatggcttcacactccgacaaaagatggacagccgaagcgattgcgttgtaatggttatttggatctaatgaatctcgaatgggtcaacaacttcaaagaggtgtgtctcgccatattttctataaattgttttcgtttttccattttttgtgtttagacatttcgccgtgccaccacttctgtcagttaccatattcaacttttttttcatgcggaaccaaagccacttgaatcatttgaattagtgaacgaagtgacaaatgagaagctgacactgaagatgagcaaaaaatacaatggatcagtgtataattggctgttgcaacggtgcccaattggggagacggcgacggcgccagttaagtggaaaaaccgcgaaaattctgatgccaattttaattatatcatcagatttgatccttggcatgacaataattcgggcgccaatttgaacagtgtccgatttaatttgtgtgcaaatagttgcattgggtgagcagcaacagcaatatattattttgtcgaaaaaacaattaattaattcattttaggccattgtcgccaccaacggaagaagaaaaagaagaagatgaagcggatcaaagcaacaaaaatgtcgtctga

SEQ ID NO: 64551 - DNA, 739 bp, Heterodera glycines
  Genomic contig location: Contig_ID=SeqID_34852; Location=51..789; Strand=+
  SCN-specific regions: Sequence locations=1-99,125-140,162-395,417 -510,532-739
atgcatgaaagttttgtggccaaatttcgtgtcatccgaccgcaggccaatctgatcactttggacggggacaacaacaacgacatcattctccatgaagaagcagacgaagatgaagcaatagctcgtcagtggaattttgcaaaaaattgcattttttactgggccgtaaaatgctgtcacattgttagcacttttcgcggttttttaaatttttctaggccaactttaggagccgttgaatacgaatttgacattttttagaaaaaaaaaacaggaccacatagattcgtttttattatctactaaaattaccttaaaattaaaaaaatcaaatcaaatggaatgtaattgccccaattttgacgaaatcataatttttctgcagccaaattaattaattttcaaattttgcatgctaattgaaaatatggccattcgctaaatttttatggttatgatttgaactggaatagtgccacttttttttttttgcaaaaattcgctgtctcaacatggaatttccttttttgagagccctgtacttcttccgccggacaacagccgaggccgattggtggtggtactgctgacgaactgcaacaggaggcggaggacaacgaaagtgttttgctgaacggcgccgaatcgccgacccccggcgccggcactttgggctacgaaattttggcggaggactccaaaacgcctgccccattctatgaaatgatgagcgaaa

SEQ ID NO: 64552 - DNA, 383 bp, Heterodera glycines
  Genomic contig location: Contig_ID=SeqID_34853; Location=1..383; Strand=-
  SCN-specific regions: Sequence locations=1-245,269-383
aattgaacgctaacggacgacctaatggaaaaaaatccccgaaggagagaatttaattaaatccattcctttgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcga

SEQ ID NO: 64553 - DNA, 594 bp, Heterodera glycines
  Genomic contig location: Contig_ID=SeqID_34853; Location=456..1049; Strand=-
  SCN-specific regions: Sequence locations=1-539,561-594
aaacaaaaataaatcgattttttcaagtgtccgtttggggtactcaaacaattatggggagcaaaaatccaacgcaaaattaaagtacaggctatagggaagctattccggaaggattcggtctccccataaatctgggcgcatcggttcagggggactgccccaaaaacaaaaaaaaatcttttttttcgagtgtccgtttggggcactcaaacaattatggggagcaaaaatccaacgcagaattaaagtacaggatatagggaatttactccagaaggattcggtctccccataaatctgggcgcatcggttcggggggactgccccgaaaaaaaaaaaatcgattttttcaagtgtccgtggggggtactcaaacaattatggggagcaaaaaccccacgcagaattaaagtacaggctatagggaagctattcccgaaggattcggtctccccataaatctgggcgcatcggttcggggggactgccccgaaaacaaaaaaaaatattttttcaagtgtccgtttggggtactcaaacatttatggggagcaaaaatccaacgcagaattaaagtacaggctataggga

SEQ ID NO: 64554 - DNA, 105 bp, Heterodera glycines
  Genomic contig location: Contig_ID=SeqID_34854; Location=132..236; Strand=-
  SCN-specific regions: Sequence locations=1-66,88-105
atgcaactgttggaaatcattgtttccgaaaagacgtccaaggaggcactcgccgtggccgccaaactcggcctggaccagaagaagctgattgtcgtggtcaag

SEQ ID NO: 64555 - DNA, 461 bp, Heterodera glycines
  Genomic contig location: Contig_ID=SeqID_34855; Location=60..520; Strand=+
  SCN-specific regions: Sequence locations=1-55,85-138,160-205,227-461
atggtaaatgtagtcgttcctgtgggtatgtaagttgcttcaaaaatttcatcacatttaaaaattttagaaatattaattatactaaaaactccttgttcattaaaatggatcttgaagacaaatccggagtgatttatggaataaattgctatgaacccaccgttaataaaattataggatataatggagaagaaatcaatgtatttgaacaggaacaaaatgtatgaaaaaataaacaaaaaaaaagtgaaaatttttttagtggttggcaatcaccgatgcatttgacaaagttttatatgaagccgcccatttttttcgtctttttttaaaaactgtaagaaatttttttcaatttaatgtattgtttttttcaggatggcgcaataaatgccactgattttgaaagaacaataactaattctttcgattatttgagtgtttgaacagtgaactga

SEQ ID NO: 64556 - DNA, 543 bp, Heterodera glycines
  Genomic contig location: Contig_ID=SeqID_34855; Location=1075..1617; Strand=+
  SCN-specific regions: Sequence locations=1-14,51-229,251-543
atggaaatgttatctatattattaaactattttaaaaacaattttaaaaaggtaagtaaaaaaagactttgaatactaaaaaaattttttaaggagtcctttatatggtatgataataaacaagagctgaaaaatcgtttaaaatgccaggattctaattacaatttggctattcatttggacactagctatccctacgaagaatttttggatgtcgggggcaaagattttttatttacatttctgttttatgaaaaaaatgttcgatgttgttgtggcaatgtgatcggtacttagaacttatttcataatgggattgtacggttggagaatgagaccgaaattatcgtttatttttatcgggaaggagcacagcgatttgacagaaacaatttatatttgagccgtctctacagaatacgtatccctcttagcgcaatattgacatggcttcatagaactgagtgtctaatttcgcctgtttttataattctgaaggctttttttgtaatttatgacaggtttttttctttttttttaata

SEQ ID NO: 64557 - DNA, 292 bp, Heterodera glycines
  Genomic contig location: Contig_ID=SeqID_34857; Location=391..682; Strand=+
  SCN-specific regions: Sequence locations=1-132,157-185,245-292
atggcaacaaaaatggcacaatcatttggcgcgccattaaaatgcgcacagtgccaatgcaaacgaataacaatgacaaagaaagatcaatcattttggagtcatcaattgcctttaagaaattgttagtacatattttatttattaaaatattaagcaaaaatgcgtaagtgaactcttttttgtaattttaaaatttttaatcaaaaaaaaaaattatagtaaaaagattataaattattaagctatacattgggagcaggaaaacggctttctctgcttttcgactgga

SEQ ID NO: 64558 - DNA, 449 bp, Heterodera glycines
  Genomic contig location: Contig_ID=SeqID_34857; Location=789..1237; Strand=+
  SCN-specific regions: Sequence locations=1-127,156-449
atgccattctcagatttcgctgggcgtgccatgcaaaatgatttcctccgttcaaatggtccgtcttttttgtcggattatgccgacctttggcttcttgcgttagacatgctgccgatggcacaccaaacagcagaagagcaaagagaacagctgaagatggagctgttcatcagccgcagctccaattgctccatggaagcatgggtagaaagaaaggcaaatccgtccgatcagtgaaatccaattttttaggtatttaactattttcctttatctgggttatgtggatatataacatttagtaacaattttcccagcctaactatttgatcaaatttaattcccttaagtttgtccaaccgtcggattccgttggagcatccgatccgaaaatgccattcgacgattcggtgtgcaaactgaatccgattggaagaaaaacatga

SEQ ID NO: 64559 - DNA, 61 bp, Heterodera glycines
  Genomic contig location: Contig_ID=SeqID_34858; Location=1..61; Strand=+
  SCN-specific regions: Sequence locations=1-61
ctgtgtattatcactttatttccatctgtgttccgaaataaattgaattgatggtcattaa

SEQ ID NO: 64560 - DNA, 317 bp, Heterodera glycines
  Genomic contig location: Contig_ID=SeqID_34859; Location=1..317; Strand=-
  SCN-specific regions: Sequence locations=1-56,83-185,208-209,235-317
ggttcgatgaaactttttaaaatataagcctaaactttttggcctgtttaaaaaggaattaaaaatttttaaaatatttattcatctcccttttgatagaaaaagcatcagagagccttaattaacctgtaaataaagttttgtgtgtttcagagcactttctgaaaaaatacttatgaattaattttgcaaaaaataaataagtaatgaaaaagtcagaatttcgaaaaattttaaaaacaacaagcgttggcattttttcaggttaagttagtactttacaatggagaaggcctgcaaaattggagagattatat

SEQ ID NO: 64561 - DNA, 324 bp, Heterodera glycines
  misc_feature (34)..(34): n is a, c, g, or t
  misc_feature (53)..(53): n is a, c, g, or t
  Genomic contig location: Contig_ID=SeqID_34859; Location=640..963; Strand=-
  SCN-specific regions: Sequence locations=1-162,184-208,237-324
tcagtttataaaaaaaaagttaagcctaaaattnttcgcatgtttaaaaagcnaataaaaatttttagattttttattcatctcctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttat

SEQ ID NO: 64562 - DNA, 655 bp, Heterodera glycines
  Genomic contig location: Contig_ID=SeqID_34861; Location=250..904; Strand=-
  SCN-specific regions: Sequence locations=1-151,173-252,274-528,550-655
gttaaatgcaaaactgttgtgaaaaattgttataactccattcagagaagagatagaaaaaaaaaaataggtttagagagcccatgaacagctgaatcggatgcaagtaccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaataataataggcttggactaccatactaattagaatttttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaatagttgtttttcaaaaa

SEQ ID NO: 64563 - DNA, 436 bp, Heterodera glycines
  Genomic contig location: Contig_ID=SeqID_7350; Location=264..699; Strand=+
  SCN-specific regions: Sequence locations=1-240,262-351,373-414
atgtcaatgcaacaaaatcaagggtccgatgatgctttgccaatgtgggcggtaccggattttgatgaaatgggccaaatgccgcagcggcaaaaacaaaaaaaaatcccaacgttgaaggagtttcggaaccaatggaaggaacgaagacttctgtgggagagggaggaagcagaaaaaaaagaccccaaaacatggaagaagaggaccgatgagatgaagaaaatctgtgaggagagattggagcaatcaaaaggtgcaggcggcagcaacaaacgacaggagccggacacatacacttggaactgggacgaactactgcgccaagaaagagaatatttggacgggggtctatggggaaaatgatgagataccccccccccccccttcacctccctcccgttcgattgatcgattattttattttctatttgaa

SEQ ID NO: 64564 - DNA, 1157 bp, Heterodera glycines
  Genomic contig location: Contig_ID=SeqID_7352; Location=305..1461; Strand=-
  SCN-specific regions: Sequence locations=1-3,32-121,143-829,851 -909,931-1017,1041-1157
atgaaaatattattaatatttttattattatgcgcattaatattcaaaaaagcaattaaccaaattgaggctggcaaaataacccaagaaaaaagttttgctgaaatatttggccaaacatgggacgacggagcagaagaagaaaacatctgtcaaaatgatcaaataattcatggagaaattgctgatcagaataaccaattaggacaaaatgttcgtcaatttgatcagaattttgatgaaaatgtggaagtgaaggaagaggagagtgaagaaatgtccacggattatgatgaattgggccaattgccaatgccaacaaagaatggacaaagttgtgatcgtttttcaaatgaaactaataaaaataaaagagaaattgtggaaaaatttcataaaataaaagagaaattcaagcaagaaaaaaagaaatattattctggaaaagaatggcacaaaattgaaagaaaaattgctcaaaaatcgggtgttaattacgagaaaatttacgaatggaaaagagaatttggaatgatgatccataaaaattcggaagatgaaaaacgccaaatattaaagcgatttgatcaaatatatgacaaattaaaaatgaaattaaatggaaaattggatggaaaaagaatgaaatgtaaaaaaataatagcaaaacatttgggcattgaaataaacagcatttataaatggaagaggcaattaaaaaatggaaaaaccgatgaaaaaattgagaatcgaaaaagaaaaattgttgaaaaatatttgaaaacaaaaagtgaatttatgcaaatgggaaaacatccggacaaggaatggaaagaatttagagcaaaaattaaacaaatgtttggtgtaggttttttgacaattgaaagatgggccaagaaattcggcattaaacaaaatgtttcaaaaggtcaaatttaaatatttcttcacccatttttaatcttttaaaattatttttagaacgaaaagttctcacaatttgtgagaaaatggaaaagatgaagaaatattatcagatgaaaaaacataatccaaagctcaccgatcgccaaattgccgcagaattgggaatttcaacacgcgcattatgcaaatacaaatccgatttaatgagagatgaaacgaaattttga

SEQ ID NO: 64565 - DNA, 350 bp, Heterodera glycines
  Genomic contig location: Contig_ID=SeqID_34864; Location=411..760; Strand=+
  SCN-specific regions: Sequence locations=1-5,27-30,53-350
atgtattctttccgttttttcctcttcgtctttttgttcatccattttcgtttcattggcacggcacaaattgtgaatggtcagcagctggacagcaattcggaggtgtgtttttcgtattgtatgtcaatctcccctcctttttaagcagcttcagtctaaccaaacgtacagtgtcaccaacgtcgaccgcatgtccaatgcgttccattcgccaacggacaatcagacgacttctcttctcggagacgaaaccctcaaacccagcgacaacgaagcgaactgtacgactacggaaaatggttgcgagttgaacgatggcaaatattgtacggactgtaaaacaattg

SEQ ID NO: 64566 - DNA, 984 bp, Heterodera glycines
  Genomic contig location: Contig_ID=SeqID_34865; Location=178..1161; Strand=+
  SCN-specific regions: Sequence locations=1-161,183-437,459-984
atgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatatgggacaaaactctggcggaggcagctctgtcgcgctggacagatcagatgagatggcttttt

SEQ ID NO: 64567 - DNA, 49 bp, Heterodera glycines; identical to SEQ ID NO: 51181
  Genomic contig location: Contig_ID=SeqID_34867; Location=394..442; Strand=-
  SCN-specific regions: Sequence locations=1-49

SEQ ID NO: 64568 - DNA, 399 bp, Heterodera glycines
  Genomic contig location: Contig_ID=SeqID_34869; Location=445..843; Strand=-
  SCN-specific regions: Sequence locations=1-68,92-143,175-287,367-399
  Gene Ontology: Mol. function=voltage-gated calcium channel activity; Cellular component=apical plasma membrane; Biological process =epithelial fluid transport
atgcgttcaattgctgggacattttggttgttgctgtttcgcttgtctcttttgtgctcaaatcggacgccatttcggtggtcaaaattttgcgtgtgctcagagtgttacggtaggcaaaaagaaaacattggcattttgccaaaaaaaataattttaaaattcaattaaaaacattttagccctctccgcgccatcaatcgcgccaaagggcttaagcatgttgtgcaatgtgtgattgttgccgtcaaaacgattggtgagcatttttttggggggggggggggattttttaaatttaaaaaaaaatatttataatttttatttaaggattttgattttgtttttattattttttaatttttagggaatattatgctggtcaccttcatgcttcag

SEQ ID NO: 64569 - DNA, 361 bp, Heterodera glycines
  Genomic contig location: Contig_ID=SeqID_34870; Location=80..440; Strand=+
  SCN-specific regions: Sequence locations=1-244,266-275,297-361
tccaactgtcttccgcttcatcaacacaatttgatatgagaaaagtcaattgatgcagacattgcacgatgcgtcgctggtgaagtccctcctcaaaaacgcgcaaatatcgtgccgtcgatgcgagaattctcgactcttacagggttacaataccatcaacaacatcaaccatgcttaccaaaatgatcaaaattaccatacaatgttaatcctgataatatcttcaattttctcgttgaatttctcaaaaattatgtaataaacccgtagtcattcttcaatgttttgtcattttttcgttgaaaacacactgataaatatgttatggtgttaattttaaacatttttcgaaaaaaaa

SEQ ID NO: 64570 - DNA, 138 bp, Heterodera glycines; identical to SEQ ID NO: 50950
  Genomic contig location: Contig_ID=SeqID_34871; Location=408..545; Strand=-
  SCN-specific regions: Sequence locations=1-138

SEQ ID NO: 64571 - DNA, 1458 bp, Heterodera glycines
  Genomic contig location: Contig_ID=SeqID_7353; Location=281..1738; Strand=-
  SCN-specific regions: Sequence locations=1-1458
atgaaatttgctcatagtttagcctttacaagtggtagtcaaatttccgagcagttagctgggtctgtattggccctctcgaggattttttgctattttttggaagagctttttcgcagctttcgaatggtatatgcatttttcctgttactccaatatttgcggagatatgcacgtccgaaactcagaaaaaacaaatgcggtagcattctataaaaaaacattgtttcaagataattatctagaaccatctgaggaaaactattcagaagtccgcttcttaataataatctagcaaatatatttacgtttcagtgagttttgcttgtcacgcttgtcacatgacgaagcgattttatgctacagttatagttctgtactagtaaattcctcaaacgagctcgaaaacatgaaatttgctcatagtttagcctttacaagtggtagtcaaatttccgatcagttagctgggtctgtattggccctctcgaggattttttgctattttttggaagagctttttcgcagctttcgaatggtatatgcatttttcctgttactccaatatttgcggagatatgcacgtccgaaactcagaaaaaacaaatgcggtagcattctataaaaaaacattgtttcaagataattatctagaaccatctgaggaaaactattcagaagtccgcttcttaataataatctagcaaatatatttacgtttcagtgagttttgcttgtcacgcttgtcacatgacgaagcgattttatgctacatttatagttctgtactagtaaattcctcaaacgagctcgaaaacatgaaatttgctcatagtttagcctttacaagtggtagtcaaatttccgagcagttagctgggtctgtattggccctctcgaggattttttgctattttttggaagagctttttcgcagctttcgaatggtatatgcatttttcctgttactccaatatttgcggagatatgcacgtccgaaactcagaaaaaacaaatgcggtagcattctataaaaaaacattgtttcaagataattatctagaaccatctgaggaaaactattcagaagtccgcttcttaataataatctagcaaatatatttacgtttcagtgagttttgcttgtcacgcttgtcacatgacgaagcgattttatgctacatttatagttctgtactagtaaattcctcaaacgagctcgaaaacatgaaatttgctcatagtttagcctttacaagtggtagtcaaatttccgagcagttagctgggtctgtattggccctctcgaggattttttgctattttttggaagagctttttcgcagctttcgaatggtatatgcatttttcctgttactccaatatttgcggagatatgcacgtccgattgaatacccaccaatccaaattttaatggttggattttataatttttaa

SEQ ID NO: 64572 - DNA, 346 bp, Heterodera glycines
  Genomic contig location: Contig_ID=SeqID_34872; Location=67..412; Strand=+
  SCN-specific regions: Sequence locations=1-346
atgggacgaaaaacgatgacattgacggccgtagtgctgatggtgaaatcagcaaatataacgcactcggagtttggctcgagaaccgagcaagcttttcatttatcgtttaatgtatcatttttgttgctaggacccgcaaaatcttacaaaatgattcccagccctagtaatgattggagttttattgtaaaaaaattttcgcttttcacccccaccacttaattcatgaaaatttttttttcattcaggttccgccgataattttttccaaattgctcgctgttccgacaagatcgtaatgtatcactttggttgttggaacccgcaaaatcttacaaattga

SEQ ID NO: 64573 - DNA, 167 bp, Heterodera glycines
  Genomic contig location: Contig_ID=SeqID_34875; Location=152..318; Strand=-
  SCN-specific regions: Sequence locations=1-167
cccaggcgggcattgaagtgattgagctcgcaactgctgaaactgaaccgacaattccatcgctttttgcggatgatttggctattgtgataaatggcaccgctcttttgactcgacctaaaagtaacaacaacaaaaagacgcccgttgtcagcagaaccaatgaa

SEQ ID NO: 64574 - DNA, 195 bp, Heterodera glycines
  Genomic contig location: Contig_ID=SeqID_34875; Location=601..795; Strand=+
  SCN-specific regions: Sequence locations=1-195
agcctttgaagtttttgtgcacattatgtatttccggtttctctccaaagactaattagttgtcattaggcaaaggcatttgtacatacgccaaaattcccctgctgctgttaatcaccgtctccgccttttctctttttattggtgattttgattttcagctgcaaatcaaaagcaagcagcaataaaatagac

SEQ ID NO: 64575 - DNA, 418 bp, Heterodera glycines
  Genomic contig location: Contig_ID=SeqID_34877; Location=751..1168; Strand=+
  SCN-specific regions: Sequence locations=1-99,121-157,183-240,262-418
atgttgccactccctcgtgagttggaagagaatcgaaatcggacaaagcctctcaactcaccaccaccggcgaagagaaacaaaagagatgagtcaccaccagtttttgatgagaacgggaacgagcttggctctcccccatcttacaatggagataaagaggatgaggaggaggaagggataatttctgagtcaccgcctcattatgaaggaatcgagactgtaacatttgacttccctcatcatacaatgaagattatgaacgtgttattgcggattcaccgcctcgttatgtagaaactcaaaacgagactataacaccaaaagtaccatctcgtcagccgcctcctaccccaagcactgctaagccggcccccctcctccaccaccaccgtctacaatttcgactcctatttca

SEQ ID NO: 64576 - DNA, 56 bp, Heterodera glycines; identical to SEQ ID NO: 52733
  Genomic contig location: Contig_ID=SeqID_34880; Location=230..285; Strand=+
  SCN-specific regions: Sequence locations=1-56

SEQ ID NO: 64577 - DNA, 167 bp, Heterodera glycines
  Genomic contig location: Contig_ID=SeqID_34882; Location=128..294; Strand=-
  SCN-specific regions: Sequence locations=1-167
atgttggacaccgtcgttctgtgcgggaacaccgtcgacgtgcagggcgactcactgttcagttggctttttgcgcagaaacgcgagcccaacggaccgtcggcggaccatcgccaattggcggcgcagcaatgggcgtggattgagcagcaaatgcgccgatcgga

SEQ ID NO: 64578 - DNA, 723 bp, Heterodera glycines
  misc_feature (619)..(619): n is a, c, g, or t
  misc_feature (666)..(666): n is a, c, g, or t
  misc_feature (713)..(713): n is a, c, g, or t
  Genomic contig location: Contig_ID=SeqID_34884; Location=567..1289; Strand=+
  SCN-specific regions: Sequence locations=1-60,82-392,415-439,461 -590,612-632,655-723
atggcagccgcagaaccgtgccgagaaattctgacagtgacagattttgacagtaagaagaatttttaaaaattatttaaaggcaaattttaatagataatagatatttaaatctaattctcgtaaaatttttaaaaatgcaagtgatatgagcaggcatgatgaaattctaattggtcacgatgtttttctttctcgaatttgtaaccccgagagtgtggtctagtgcctattttctaggtttttattttttttatagtctaaaaagcctaaagatttttaaaaagacctattttggcgttttgcccaaaattattaacaatttgcccaaaattattaacaaaaatgcaataaaaacgaaaaatacaccccctaaaaatcgaaattccaattttttaaaatttgttataatttgttggattcaaacaaatcgtagctctttgtttatcttcaaattataaattggcacgaactttgtgacaaaatcaaaaaattttcaaaaatcaggcgctgagcaaataaaacacggacaattaattgaaaaaattacaattgtgcaaactttcatttgaatacgggcaaaagtgtctgacggaaaccaaattttacgtgccattanattcgtataaaaaaggaattgaaattttaaattaatacattcattanaaatataaacgaaaaacatttttaaacattagtcttaaattcattgntgttttaata

SEQ ID NO: 64579 - DNA, 885 bp, Heterodera glycines
  Genomic contig location: Contig_ID=SeqID_34887; Location=137..1021; Strand=+
  SCN-specific regions: Sequence locations=1-591,613-773,797-840,864-885
  Gene Ontology: Mol. function=tyrosine aminotransferase activity; Biological process=phenylalanine catabolism
atgcacaatcgcttcggcgtgctttccgacgtcaaagccggcattgtgtcactgagtcagaagattgtcgggccatgtgcactgatccaaggggcgttgccacgaatactgcgcgacacgccgcagtcgttcttcgacaacaccaaagcattgctagcaaaaaattctgaaattgtctacgacattctgtgccaagtgccgggactgaaaccgctacgaccccaaggggcgatgtacatgatggtcggctttgacgaggaaatgtacggggacgagacgggcttcttgcagaggctaatcgcggaggaaaggtaagcatcgttggcactttgctcttcctgactttatctctgtttcgctttcagcgtgtactgcttgcccggttccgccttctctctgcccaattggttccgtttggtgttggctttccccgaagaaacgacgagggaagcgtgcgagcggatagccgccttctgcacacggcacatgcgcccgtgcaggaaacaattggcactatgggggagtcaactggacgaggaggacggccgagggtcggaaggggcggaacggaccgcagctgaagagagtacgagtggtgaggaggaggaagacggccagagacaaagcgagcgatcagccgaatgatcaatcgatcggccgatcaaagcgtgccgaaatgcggcacgggcacacattcccatccaaccgaaaagcaaatctcaaacagtcgctaccgtcgcgtcatttatcctttttgattgtttatttttttctcttattaatttatataatttctaaacaaattactttgcttttatgcattctttcctatttttatccatttgattttgattctctttataacccaatgatatttttgagcaa

SEQ ID NO: 64580 - DNA, 158 bp, Heterodera glycines
  Genomic contig location: Contig_ID=SeqID_34889; Location=541..698; Strand=+
  SCN-specific regions: Sequence locations=1-158
atggcacattttggtgcaccacaaattcgggaacaaatgctcaagggaattggtgacgacctgcagaaagtgttggacatatttggcaatggcagtgatgacgacgatgcaagcatacaattgctgttacgatacatcgttgaaaaggtgtcatggat

SEQ ID NO: 64581 - DNA, 691 bp, Heterodera glycines
  Genomic contig location: Contig_ID=SeqID_34891; Location=86..776; Strand=-
  SCN-specific regions: Sequence locations=1-548,570-621,673-691
atggagatcgtgagcagcaagatagaagggcagtggtgagacaacactgagacgtgcggtgtctgcacggaccactgcttcgcggagatctcgtcactcagctgccctgtgacaccaatgtcaagcatatcttccaaccatctgcgtacgccgttcgttgaccaccaaccggacatgcccgaagtgccgccgtcccgtcaacatcccagacaacatatggtgaaaaagataaaaaaaatatagcataaaatgtttgtttaggccgaccaaagactcgcatagtcagtcctacaaagattactttgctgaacaaagtcagagctcaacatcagcccgacccccagacgacgactttgtgatccgagcctggtaaaaaaaattgaaagagtttgaaaacaattatcagaaatataggagtgtctacgaagaccttcgcaatggccagagagacgcctacgggagtgtgattcgtcaaccaattgcgccccgtagagctttccagctcgtgatcgaccaaatccgggagggcagctctgaccttggcgaccgtcaaatggagtgggacatcaccgacccacggaatgacgaggaacaagggctgcacatgtgcgagaccctcctgagagaaagaatggaggaggatgagaaggaggaaaaggagaagaaagagaaaaaatatttggaattttga

SEQ ID NO: 64582 - DNA, 2679 bp, Heterodera glycines
  Genomic contig location: Contig_ID=SeqID_7356; Location=100..2778; Strand=+
  SCN-specific regions: Sequence locations=1-251,273-678,700-893,915 -1560,1582-1705,1727-2232,2254-2314,2336-2576,2598-2679
atgccgtgttcgttagctgcactcatcccttcttatggtctggacgtggaggacaagcccttcttcccgcatttggccaacagaccggaaaactacggcagagaaattcgcccaacgcccgacgactatttggcaaacggtatgatgcccgggaagaggcgacaattcgacgaatggtacgctgcgcaccaccatgagccttttatgctcgatgaggcgcttgccaggtaaaaactatttttacatgtataaattaaatttttctgtttcagttattgcacgaatgatgtcaagattttgatggctgcccttgtcgcattccgtcgggaattctttgagatttcgcgtcgccaggagtacatggacgggatcgacgacagagagaaccatgatggcatcgacgtactgcgtgagtgcatgaccatcgccggcgcgtgcatgcgacactttcgcactaatcacctgcctaacgaccaccttgccatcgtccctgagcgaggttacgacaacgctcaaaatcaaagccttctcgccttacgattcttccattggtactcggaggagtacggggtggatgtgcagaccgcccactctgccggaggagagaaacggatcggcccctactcggttgacggatggattgaggcagaggggcgtgcaattgaagtgcatggtattgattatttatttttattcagtaaaaaatcaatattttaaggctgtacttggcacggatgcaagaaatgttatccaatcgataacatgttgttgcccaacggaaagacagcggggcaggtacgggagcgcgacgcaaagcggatggaatacatctgggcccgagtgaatcgtgtggacgtgtattgggaatgcaaaatcacgtctatgctagagcggagcaaagccatgaggaaatccttcgcgaactacgtggatgacgggccactggtgatccgggaggcattcactggaggacggaccggaccactgaaattgctgcgcaaagcggggccgggagagaagatctcctattacgacttcacgtcattatacccttacataaagtcagttcttttttctgtatttgacaaataaattgtaaatcttaagcttcaccactcgctatcctgttgggcacccgaaagtacatgttttaaaccaacaagtggaatggatcagcgcggcggacaatcctttcccgttggcgctgctcaaagtttgggttgtgccgccccgccaaatcgatgttgcagtgttaccggtcaaagtggacgaccgactgtgctttccgctgtgcatcagctgtgccaaagaatacccaaccggaggcgtggacaacgactaccactgtcagcacactgatcaacaacgcggatgggtcagcacctgtacatcgattgagctcaacgcagcgctcgacgagggttaccgcgtcacgagggtgttccgcgtgctagaatacgagcaaagcgacgacaagctcttccgcccctacattgcggaattcatggctcaaaaaatccaggcaagcggatttgacagcagcataagaggggacgctgagaaggaagaacaatttgtccgagagtgtgcggagcagtttggcatcaacattgatcctacaaaaatggtggtcaacaaggggaaacggtccctggcaaagctctgtctgaacaatttatgtgagttttgacatattaattttgacaaaaaatgtaatttttagggggacgtttttcgcttcgcaactttggcctgtgccagacactcatcactgacgacccggtgacgctggccgagtacttggacaacaaatcgatcgaagtcacatcgatcgatcagctggacgaggcgcacatcctcatcacctacctccacaagaaggattggatcgatgagcacgcttgctcaaacattggtgagactaaagttgtaaacttgtgctaatttgataaatttagtcatctctctgtggaccacttccgctgcgcggcttgttctgctcaaagccatgcagaaggtggttaggtcgccggggtccgagctactctacaccggtacatatgccctaaaaaattgcatgaaataaattgcaaatattttttagatacagacagtctcatcctcgtccacccggaggagcgatgtccgctcaaaactggtccacatctgggccagttcactgacgagtacccggaccacgacattgtggagttttgcagtgggggtgcaaaacaggtaaattttaagttaaattcatcaatctgtattgattatttcacattttagtatggtctgtgtttgcgacgaaagggagctggggcggatgccaaaaaggaatacgtgctcaaggtaagcggattgacgctgaactacgacgtgatcaacaaccaaggcatgcgttacgagacgttcaaagaagaagtggtgcggtacgcaacaacgggtgattatgagccaatcattgtcacttatcctaacttcctccgaccgaacattcgggagggagggagggtcgtatccatgcccctacagaaatgttaccgaccatatgttgggaagggaattataggcagcgatttcaatgtgaagaattttggccacactttgtaatgtttttgttttctgatgtatctgtctttctcatcaatacaccataaattgtatttaactcatttttca

SEQ ID NO: 64583 - DNA, 909 bp, Heterodera glycines
  Genomic contig location: Contig_ID=SeqID_7357; Location=523..1431; Strand=+
  SCN-specific regions: Sequence locations=1-251,283-327,349-510,532 -743,766-855,877-909
atgcgcttggctgaagacattgagggcctggagatgcgcactcgaaagcttgaagaaggtgcagccgcgacaacggaggcgcagatggaaacgatgcgccaacaaatggagcaaaaatttcgtcaaaatctgctggaagccgagcagcggattgatcacaagtgggcgacgatgctgagcaaagaacaacaaagaactcagcgaattgcggcacaaagcgcggcggtgattggacaactgatgaataagcgactggcagaggggggagaagaaaaggaaaatacgagagagacagaggaaaaaaagttgataataagtgatcggtgcaattggtgcttagagaaaggccagtgttatttggagttaggggatgcggacatgtgtttagctgtccaccgtgcactattgcgataatggccgttgacgagccaaaatgtctgatttgtttccaaaaattaactgatttggaatacttaggatcataaacgtgtaccgaatatttgctttggatcctaattattttaaatgtttgtactcctataattgtactcctatagtatttcctcatcatcacttttttcattgcctacagtaatcgttaacattttcatttctcattaactaactaaatttgtcacatttatttgctttggatcgcatgaatttacaatatttgtgtaattgtactcctacagtatttcctcatcatcacttttttcattgcctacactaatcgttaacattttcatttctcattaactaaataatttgccgtctttatttgaccacactgtaacccataaaaaatgtttgccatctttatttgatcaaacagtatcccataaaaaatgaattttcatgaacaaatcccaaatttcgaccgttttgatttattgaaggcaaaaaata

SEQ ID NO: 64584 - DNA, 312 bp, Heterodera glycines
  Genomic contig location: Contig_ID=SeqID_34893; Location=100..411; Strand=-
  SCN-specific regions: Sequence locations=1-2,90-151,181-312
atgaaggaaaaagaggaggaggagaagaaaagaagagagggaaaagaaaaagagacggaaaagaagaaggaagagatgaagcagaaggacgagacggaaaccaaacgaagcctcagcgtcggaacaacgaaagacgatgaaatctcgattgtggattctgaagaaagagaaagagatgccttcgaaaactcgccgaagccgacaaacgagcgaatggcattttgggagtcgactttgaacaatgaggcaaaaaaggatttgcgagaggacaaagagaaagccttaaaaacacaggccaagctattgtcgtaa

SEQ ID NO: 64585 - DNA, 453 bp, Heterodera glycines
  Genomic contig location: Contig_ID=SeqID_34895; Location=138..590; Strand=+
  SCN-specific regions: Sequence locations=1-453
atgatgggatcgaaatggtcagtgcgcgagttcaggagagcggtggcggaacaagtacggtgcatgcggtcagcagagtcagcattggcatcaatgaaagacccggaagtacgcactgatcaccgaaccgagcgtggtcagacgggacgaggaggcaaagcaggtcgggagccatttcaaagagcatttacgggacaaccaacaaacccgtgcgaaacccaacgaaacacgaagcgaggagcggtacgggacgaacgcccgtttcgccagacgatcgaccacacatgccaacgagaacgagagctcaggcgggaattggccccgcgtcgcatcaaacggaccaattgccacaacggagatatggagctgttcactatgcctaagaagtggacatcgaccaagcaaatgccgcgactatccgacagctcaggagcggaggaggagactcattga

SEQ ID NO: 64586 - DNA, 258 bp, Heterodera glycines
  Genomic contig location: Contig_ID=SeqID_34896; Location=370..627; Strand=+
  SCN-specific regions: Sequence locations=1-258
  Gene Ontology: Mol. function=beta-N-acetylglucosaminyl-glycopeptide beta-14-galactosyltransferase activity; Cellular component =extracellular space; Biological process=development of secondary sexual characteristics
atggactacgccattttcgtcgttgaacaggtgaaaaaaggccagaaaattgaaattttgcgatcactcccaaaaaaaagcgatgttaaggccagcaaccagacattcaaccgggcgaagctgatgaacgtcggctttgtggaggcgtcccgtctctacgactggcaatgcttcgtcttccatgacgtcgaccttttgccggaggacgaccgcaatttgtactcgtgtccggaacacccgcggcacatgagtgtggcg

SEQ ID NO: 64587 - DNA, 197 bp, Heterodera glycines
  Genomic contig location: Contig_ID=SeqID_34900; Location=435..631; Strand=-
  SCN-specific regions: Sequence locations=1-197
ctcgttcaatttgagtgattcttcaacaaatacatattataattaaccaattgtccaattctgtgcttatgggaacggatgtcctccagcggcagacatttgttcacattgtccatcgccatcatttttttgtgtttcgcggttactgtcgtccaaacccgctaccgtttccgggaggaaccgatgccggacgaggg

SEQ ID NO: 64588 - DNA, 438 bp, Heterodera glycines
  Genomic contig location: Contig_ID=SeqID_7358; Location=8..445; Strand=-
  SCN-specific regions: Sequence locations=1-5,27-438
atgcattttcttatttttgtttttgtattcttattcataatcatttcaactggcaaaactttatcagttaataatttatgtgaaaagaatggtaaaatacggccaacttttgctgaaatatttggccaaaaatgggacaatgaaaaaatggaagaaaatgaaaatgaaagtgttcaaaatacaaattataatcaaaattatcaaaatgaattaattgatcagaatgatcaattcgatgatcagcaaaaacgcggcattattcacagatttcacgcaataaaagaaggaattaagaaaaaggggaaatattcggcaaaaatttggaataaatttgagcaaaagattggcgtaaaattgggaattaatggactgaaaatttacaaatggaaaaaagaattaaaattaaagaaaaataaaagaaacttaaagcattattag

SEQ ID NO: 64589 - DNA, 3742 bp, Heterodera glycines
  misc_feature (3576)..(3576): n is a, c, g, or t
  misc_feature (3673)..(3673): n is a, c, g, or t
  Genomic contig location: Contig_ID=SeqID_7359; Location=481..4222; Strand=+
  SCN-specific regions: Sequence locations=1-246,273-707,729-1127,1150 -1299,1322-1343,1461-1518,1572-1943,1966-2143,2177-2298,2323 -2555,2621-2625,2647-2657,2679-3045,3068-3201,3223-3285,3323-3742
  Gene Ontology: Mol. function=non-chaperonin molecular chaperone ATPase activity; Cellular component=endoplasmic reticulum; Biological process=response to stress
attgcacacacaaactgcaacagagccaaattttgtacaattttcgcgtcaaactttccattttaaatttcagcaaactcggcaatggccatcgaccttggctccgagtacatgaagatggcattgatcaaaccgggcgtgcccatggagacggtgctgaaccgcgaatctcaacgcaaaacgccaatggcactgaccatccgggacggggaacgcttcctgggcgacacggcacagaaaaaagtttgattttaatttttaaatttgctagtgcttgtatgaagtctctcgtcactctcttttcttggaccaaagcttttgtactacttgatttttagttcttttctgggtcactctgatcatgaatatggcattcattttggccaatacataacccgaattcgaatataagtctaaaactcgaaaaaaaattttttttgcaatccttttttgtttcaaaccgaaaaattctttgaaacgtaacaatcacaaataattaaaataaaacaaattggtactgagttgaacggctcggactttgttcatttcatcaaatggccgaatttgtggtacagaaaattgattttgaacaccatccactaccataattgtttggctttcttcaaaaaaactttttcgttttttcgctaatttttttgccatattttttttttgtttttttaggcacttggcatgccacggcacacttttgccttctttttggacttggtcggcaaacaaatggacgacccaattgtgcaagcgtttcaagccgaattcccacatttgacgctgaaagcgcatccggcacgaggcactgtccaatttgagacggagtgagttggggccaaatgagggcaaaatttggatttttaccaggcaatttgagtagatgttgggatgaggttcgataacaacctattagcaaaaaaaacaaaacatttttttacggttttcattttgaagcgttgcaaatttcgaaattttttagcttgccaattttttttttgccattttcagtgccggtgacctgtctgtggagtgtgcacttggcatggtcctgtccaatgcgaggcacgaggttcggctctaatttggccaaacaacacatttttctatatctttctcttttttgttctctgtctcctcggggttgtgccaaattccgtgcctttttgagaccgggtgaattacaaatttaatttttttttgtgtgaaaattcaaataaaaatcccggatgcatgcattttgcaactttttttttctgcaaattccgctgatttttaatgatccgctggcattttacacatttagaaaatgtatatttttcgtcctgggttcgctttttctctctttcctctctctctctctctctttctctttctctttctttctttccttcctctctttctttttctctctctgtttctctctcactctctcatctcccttccctctcaccatctcatttcatctcggacattggtaccatcctcttacatttttcctttctattttctctcctctctttgtctccctccccccctctctctctctctctctctctctcgtgacatttccttttctctccctaccattttctctgtctcaaattattttcagtgtgtataattcattaaaatttgcattaaaaggtggaggcatacgctggccaaacggtgcgcgacgcagtgatcacagtgccttcctatttcgggtagcgcattacgaaagcccttaaaattgcaattaatttggcaaatgtgatccgccatttttaaaggctcattgaacgggcggcggttgaagcggcggccaaaattgcggatttgaatctgttgcaattgatcggctccggcaccgccgccggactcaactacggcgtgtttcggcacaaagaaatcactgaacagccacaggtaatggtgttgccaacgccaacaaacacaccagggtgtggggctagtttcgtaggataaaaagcagaaaaatttgctgcattacagaaattccgacaccaaaaagtgtctgtatgtggattttttaaaaaaatttgatttttttagtctaaaaggtttttgaaattaaaatttttttgtatgaactgccatttaaccctttgtatttggcactgaaacaatcaaaaaaatttttaaattttttttttgattttttcacccccccctttttccattaaacagaggctgctcatctacgatgttggatcatcaaaaacgctggccactattgttcaatttcggcttgtcaacaatgacacggaagcagcaccaccgctaccagcaacagcaacaaacagcacaacgaccacagcgaagcgaaaagcaaccacaatttatccacaagtgcgtcgcgtgtggtttggcaggcctatagatttcaaaaaaaaatcgagggaggcaggttcttttatggtattcccaaaccccgaaaaatctttaaaaaatcattttgtaaaaagattttaggaaaaaatttcgaatttttctaatgcatttcaggaaacctttgagaaacttcgtaattcatgcgatgcattataaaattttgaaaaaatcacaaattttcttttaaatttttttacttaaattttgtttaaaagagttttaaggttttctttttgatttaaaaaaattctgggagagggtggggtggacggtgaaaaactgagaattccattattttccgctcctgcatttgttgcttaaggtggaaacgctcggcgtcggctacaaccgcacactgggcggtcgtcagttgacacttcgactccgggaccaccttgtccgcgcgttcaagcagcagcacccgtcaacgagcaataccgttgaacagaatttgagggcaatggccaaactgatgaaggaggccgaacgcgtcaaacaggttgaattttcagaaaaaaatattagaaaatttgacgaaaagaaaaaaaatttttttttttgattttcagcgacttgttttttttgggaaacatagccagtgggaatgccttctcggtggcgcctatcggcaccgccggtcagaaaatttgaattttaacgacaaaattcaaaaactagtacttttttttggcggaaaacagctacaaaaatttctgtttttttctctcggtcgctcacattagagaaaagcttttttggcccgaattgcaaaaaaaaaatcttcgggttccccctccgaatttttggtttttggttacgacttgaacatggcatcttacaataggagtaagtatcgcaattcctggtaattattcttatgatatttttggtgatttcataaatacgctcttttaaaacccatagattttgtcggcaaacacggaccattacgcccatgtggagagtgtgtttgaggaccgcgacttccgcgtcaaagtcacccgggacgagttggaggcgatgttccaagactttgagcaattccacatggagcccatcaccgacgcgttgcggatggcccaacttacggtggaccattggacgtgttgtgttgatgggtgccggcacacggatgccacgcctacagaccgtccctcgcacatttctccnagggggttggttggcactatttaaacgattgccagagtttggcgacatcggccagctttttttgtgccattgacccattcattttgacccaaaattncaagcctgtcagaaatggggaccggattaaaaaaagcgaaaacaatttttgggcagaaatggaaaaaaa

SEQ ID NO: 64590 - DNA, 659 bp, Heterodera glycines
  Genomic contig location: Contig_ID=SeqID_34903; Location=393..1051; Strand=+
  SCN-specific regions: Sequence locations=1-59,82-167,189-473,495-659
atggatggatgctcttatgcagtttatttagttcccacaaatttttttcactttccaagcaaaaaacacacaaaatatataggtttacggggtcacttgccacgaatctggttttttgaccaaaatctatttaaatatacgaaatgggtgctggattcggatcatcgaccccaaaatctcctggaaaatgttttcacatccgtaacattagcaaattttcagatttccgagttggacagttacatgtaccaaagtgtgggcagtcagggaatcaaggttagtgagactaaatatgtgctttaaaaatatggaaattgaatccgatttaatgtttgtttgatagttccttttcgaataaatttttctaaaaatgccaatttttggtacattttaaaacccaaaaattgtaaaaataggcatcataatttcttaaaatttcggctttaaattttcggtttcccacacacatttcgctgaatatttaattttttgtttgtaaaatactcctaggcctgttttcctgcaattttcagttttacgcggatgccattggcctgccgctgttccaacgcaaaatttcgggacgtccaaaatgtgttgagagcaacacttatgtgcaggacgaggaggatgtagtggaggaattgtaccacctttag

SEQ ID NO: 64591 - DNA, 439 bp, Heterodera glycines
  Genomic contig location: Contig_ID=SeqID_34908; Location=88..526; Strand=+
  SCN-specific regions: Sequence locations=1-154,176-306,328-395
atatattgacaaagtcaacctttctgctgtaccaattgttgaattcaattttatgatttcggacaattttttgacaattaacaatggtaacaattagcctaattatatgtacaattaatttttaaaatttgcagtttcaccgaatccaaagggtttttacaaagaattttttgaagaatcaaagcttggctcatttttggaagaatatgtcggactttggctgttggcagcggacattatgccaaacttgcgccaaaaattgacaaaattaatttttatggtgccggataaatgtagacttattcgtgatgaacgtcaccctcaaaattgcgccacatttgatcagatggcatttgagaagaagcatcgctccgtccgtcaaattaacccactcgtaaataattttaaaaatatttacaatttatttatatttaaataa

SEQ ID NO: 64592 - DNA, 1145 bp, Heterodera glycines
  Genomic contig location: Contig_ID=SeqID_7360; Location=339..1483; Strand=+
  SCN-specific regions: Sequence locations=1-285,309-949,972-1145
atgaaatttctgtgccatggacgtgtttctgattggaacattgccaagggcaacagagcgacatttccaatggaaattgagaaattgtcggaatttgcacgagtgaaagtggggagtaaacgttacagcgatgtcgttcaaataaagggattccaattgaaaataaaggcacaagttaaaatgaatgagcaaaacccagcgaaatgtttgggcatttatctttgttgtgccgcttcagaagatgcagaaaaaggtgattcaaaattaatttaggtaaatggtttattaaatttattaaaatgaaaattggagttgcaaatgttcggcaatattttgaattgtttcgcaaaagagcggcacgaacgatttaacaaggaaattaagttccgatttgtttaatgaagataacagctgtggatttttgtatttcattaacttttctgtgagtggcaaattagcttttttttaattgctcagaaattaaggaattaatggacgtgaccagaggattttacaaaaaagaggaggacaaagtgacattggccattgattttagcgtggaaggacgaggaagaatggaatcagaccgagactcagacaaatccgccgggaaaattgtgatggaaattggcaaattgtcatgacggcaaagaaaaaagtttgcgcatttacctctgttgtaccgcttcagaagatgaagaaggtgattcaaaattaatttagatcgtaccatgtgattatttggagaacaatggcgattctcaagggcaacattgcccaactgtcctctgcccaacttcgtcagcaaattttatccccccccctactgaccccttgcgttcggcgtcatcatgacccgacccaactgaccccttcgccctcctcccactcatttactatgcttcctatatacaaatcatcaaaataattcagtttcgaaatatttctcaaataaaaattattttttttaaggaacaagtaaaatccgtggttcaaataatccgtcagtggacaatccatcagtggaggacaatccgtcagtaatggataatctgtcagtggataatccgtcagtggacaattcgtcagaaaattttttttttgagcaatgatcaaaaattttgcaaaaattaatattaaattta

SEQ ID NO: 64593 - DNA, 2321 bp, Heterodera glycines
  Genomic contig location: Contig_ID=SeqID_7360; Location=4355..6675; Strand=-
  SCN-specific regions: Sequence locations=1-27,49-1298,1320-1359,1387 -1443,1465-1543,1574-1819,1857-2106,2130-2224,2260-2288
atgggatgtataaaggcgattgtagaaggaattgtaagcgctaaaattgtttgaaaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgattttacttacaccattttttgctaggcttagatcacatgcgattttcggcactctgataattttagcgctcataatgggatgtataaaggcgattgtagaaggaattggaagcgctaaaattgtttgaggagctttttgagcgtaattacgattttacttacaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgattttacttacaccattttttgctaggcttagatcacatgcgattttcggcactctgataattttagcgctcataatgggatgtataaaggcgattgtagaaggaattggaagcgctaaaattgtttgaggagctttttgagcgtaattgcgatttttacttgcaccattttttgctaggcttagatcacatgcgattttcggctctttgataattttagcgctcatgaaacgtcccagcactccatgcaactacctgagcttgagacagcagagcttattgtagaaagcgctaactgattttttgtttagcaactcaactcctaagaatttgtgccctgagcaacgctataattttggtgttcgggaagagattacaatttggcaatttattgttgctgaagccagggcaagaaatagggcaacattagcatgtgatctgcacttctgggaatattttaacaaccgcaatttgttggaatttaagacgtcgtccgtttccattgaactacagtaatgatttgtttttacaaagatttgggtgcagttagagccagtgtcaaaatggacaaaaacattaattgggcatatgaatataaaaaccatttgtccagggatggcattttgtaaacttctgttcacttggcacgctcagataagcatgaaaagcaaattgttttgttttttcttaaataaaaatcaatgacaaaattttaattgccgtttttgtgcatatttaatgccgttttgtgattttttgcataaaaatgccatccctaatttattgtttagagttgctaaaacaattcgcaaattttattttaaataatgtacggggttgaaaagggcaattttccatttaataattcatatatttaaaaaataatggattattttcagcttccggcgaagaatgttgccgaatattttggaagcacaactgcccaacgaatatttattctttcttttgcgcttattttccattaaaattaacactacgcagaaagaaaggcaggaattgaaaaacagaaattagctgtttttaattactaaattttagtctcgcgcagcgcactgggtgcattattgtcacagagctaggcacttctttcctgcatgcatattccggtgtgttttaataattaaacaaaatttataaaaataatttaacggaactaggattttttgttgctattttaatatgttcaaaagttaaaccaacaatttttagatgacaaaagccctttttgaccacagattatattttaaaaaaggatttgaaaatttcatacgaatccctggtgttattttaaaatcatcaccggcaaaaaaaagaaggaatttagccggtactcaccaaaaatgattcgtttcttattaaagcaacaaaaaaactttcacattttttgacaaattgctgaaaatttaaaaataatttaatttgggtggaaaatattaattgacaaaaatctcatcgggaaattaagtcaaaatcattgtttattatgaatttcaaaatctggcaaataattaggagcattattttaacaaattttttgattaaaaattttttggcacataaaactccagttctgattatagtttaatatttaaaaaatatttaataataataaa

SEQ ID NO: 64594 - DNA, 438 bp, Heterodera glycines
  Genomic contig location: Contig_ID=SeqID_7360; Location=5817..6254; Strand=+
  SCN-specific regions: Sequence locations=1-438
aaaatggtgcaagtaaaaatcgcaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 64595 - DNA, 374 bp, Heterodera glycines
  Genomic contig location: Contig_ID=SeqID_7360; Location=6359..6732; Strand=+
  SCN-specific regions: Sequence locations=1-269,291-374
tatacatcccattatgagcgctaaaattatcagagtgccgaaaatcgcatgtgatctaagcctagcaaaaaatggtgtaagtaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttttcaaacaattttagcgcttacaattccttctacaatcgcctttatacatcccattatgagcgctaaaattatcagagtgccgaaaatcgcatgtgatctaagcctagcaaa

SEQ ID NO: 64596 - DNA, 47 bp, Heterodera glycines
  Genomic contig location: Contig_ID=SeqID_34912; Location=572..618; Strand=-
  SCN-specific regions: Sequence locations=1-47
ggaagctactcccgaaggattcggtctccataaatctgggcgcatcg

SEQ ID NO: 64597 - DNA, 780 bp, Heterodera glycines
  Genomic contig location: Contig_ID=SeqID_34913; Location=250..1029; Strand=+
  SCN-specific regions: Sequence locations=1-270,292-588,610-780
atggttgagatgggaaccgaaattcaaacatcacgaaatgaacttaaggcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatatacaagtatctgaagctgagaaaggaccacaaaaaagagaaagactagccaatgaggatgttcaatttcaatatgacagcattgatcaaaaatttattgtctatctttccgctgctgtctcccacatagatttgtcaaaacacctcgcctatgtgctcggttttaagaacacaaggctatttcatgcggaagaagcgaattatatgccagatttgactggcggcgtaaggcagctatacatttatgcaccaaatttaatcgaaaacacaattatcggcaaccagatggccccactcttaagaatagttaacgtcgtcgatgacccaggatcgattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaa

SEQ ID NO: 64598 - DNA, 1229 bp, Heterodera glycines
  Genomic contig location: Contig_ID=SeqID_34914; Location=1..1229; Strand=-
  SCN-specific regions: Sequence locations=1-3,25-205,231-803,825 -845,867-1229
tcatttctccccctctcttcttttgtcagtctgcacaatttgatggttttggtgttccattctcgggttggtcgtcaacggaccggggtttgttttgttttttattttttctattacctacacaaattcctccattggacagactttcgctctcggcggcactttcgaattcatttccgaggcgccctttttgccgggccctccactccccgggggcccaaaagggtgtgcctttttgatagagccaaacggagccaacgacggcaccggtgtcattttgtcgcccacttaccccggggtttacccaagcgtgggtttggccgctgaatcaaatgtgtcacctccctttttgtttagaatttgcaatgtttgtttctgctgcggggcctcgcccaccaacggatccgtttgttcttccgcgatttcgacgtgtatttcggcggcgaacagttcgatttaagggggggggggggaaatgaaatgccacggcatcgccaccgattcattcggtcgctcatttgtgccgttttcagctgtccctacgattcgctgacaatttacgacggcgcctcaacttccgatccgatcattcgaaaactctgtgggctccaacaacgacttgaactgttctcattcggacacgagctgttgctggagtttaacaccaccgaagtggaggggaaagtgggcgacagggggtaatttggatgaaatttaatgaatttattatgttcaaacatttctcgtcaattttccatctgtcccccctcccctccccccgttcagctttcacattgagtaccaattctcggataaattcgtggccattagccgtctgatcggtgccaagccgagtgtccactgcccaggccatttgcgtggttccgagtgcgatgttcgcgtctgttcgggccacgaatccgtccattttgtgcactctcccaatgttcgttttctctgctcttgtccgtcattcattgttctttctgctcagttccccgacctttacccaccgaatacgacgtgtacttacattttggatggtctccaaggcgatcagaatttggagaaagtcattctccgcttcgaatcgttcgtcgtccccggccaaagtgcgccttcgcccatcgtcgaaagaagcgccattccgtcggccgattggtcccacatcaattcgatgcccgggcaccgtttggcgcaatctctccccgcaaagtgcagcagcagcg

SEQ ID NO: 64599 - DNA, 74 bp, Heterodera glycines
  Genomic contig location: Contig_ID=SeqID_34915; Location=570..643; Strand=+
  SCN-specific regions: Sequence locations=1-74
gtatacatttgagacaattgggcaggacaagaaaagaatgaagttgatgcctcatgaaactcggaattggttat

SEQ ID NO: 64600 - DNA, 441 bp, Heterodera glycines
  misc_feature (386)..(386): n is a, c, g, or t
  Genomic contig location: Contig_ID=SeqID_34917; Location=462..902; Strand=+
  SCN-specific regions: Sequence locations=1-42,65-101,123-131,169 -203,243-270,346-396,427-441
atgaacaaaatgtaagacaatttctgacttaataattagttcaatgctttgttattcagttacattctcattttcaacggcatttgcattggtaagaattaatttaatattttgtgacacttttcaattgcattttaaaatgaaatttaattttaattttaatttaatctttgataagtctaaaaatcacttctcttctgatcattttatttccactttgtttttattttacattttattttctcccccccccccttttcgattttatacattttatttattttatttatttttaattcattttcattttatttttttattttttcagttttctttctccttttcggcctttgtgtgatttgcaattgcgtcgtccgaagggtcanattccaccacgagacagaggaaaagaaaaagaaaccgaccgttagcaggtgaaaa

SEQ ID NO: 64601 - DNA, 226 bp, Heterodera glycines
  Genomic contig location: Contig_ID=SeqID_34920; Location=1..226; Strand=-
  SCN-specific regions: Sequence locations=1-89,111-111,140-160,182-226
attatgagccacccaatttggcaaatcggtctttttaaacgcattaaagaagattcagtcgattgcttggagtgtaagcaaaaaaacgttattaatttttcatcttcatcattttttggtttaaaaatatatttgaatactttgctatactttgaaagacttttttattaatacagaattttttgaaatttcctaaaatccgcaatcctgcgcaggatcctgcaga

SEQ ID NO: 64602 - DNA, 1233 bp, Heterodera glycines
  Genomic contig location: Contig_ID=SeqID_34921; Location=321..1553; Strand=+
  SCN-specific regions: Sequence locations=1-211,264-555,577-774,796 -1233
atgcttcgtaataataatcctaaaaatgttaacaacgcgaaacctcagcaaacccttcatcttaataagaatgttgaatcacggagcactgttattgaagcactttccatgattgaagttgaggaccggcggcttcctttgctgcaatacgaacaggaaatgatgatcgacactttcatcgacgacgttctttttattacagcaaagtaactttaaaaatgtaattaaaaaaattttatatatttcaaatgaaaaatatttttcagaggattgggcttagagcggatcttcttcaatcacctccatttgtacagtgtcccaagttttacagtgctcgtcttaaacacaaccccagacgatgaagtgctttttagataatcatttaattattctttctaagccccatggaatatgattctaattttcgaggaattcttcgttggactataacttacaatttatagcatttttacttggaacgcctgcgcagattgaacccgggctgtcctcctaaattaatcactgctgatgttccttcacgcaaccggtgttctgttgggggcgcacccctttttcaagttatgaagtccatattattcacagtactctcatttaccgttctggcggtgttcaattcgtcacttctcgcattttaatggttgatttactaacggacaaagtgcctttcgattgcgttattggcatcctcgtctttagggcacacgagtaatttatcattttacgaatttatttttaacaagcagcgcaatttgtttcaggttgctttttggttttcaggaatcatttattctgagattattccgagagaaaaggccccatggctttgtcaaagtgaatactcttttattctttttaaatttgacattttatttttaatgatatcacccatttgtgaaggcattcaccgacagttgtgtacaaattaccagtgatggactcggccaattgcaacggcttgtgaatctgctatatctaaagagggtcgttgtccttccacgtttttatgcaccagtcaaagagtgtttagacgtcgatcaggcaaaaaaaaagcaaaaaataattagttcccaaattgaaatataaaaatttcagcaaaagtttgtgcaaacggtaattcaactaaacaacactcaacgcaaagtgcaggccaatctccgcgacatcatcggaacttgcgtcagggagttgaagcagtgcacaaagggcgtggat

SEQ ID NO: 64603 - DNA, 2069 bp, Heterodera glycines
  Genomic contig location: Contig_ID=SeqID_940; Location=325..2393; Strand=+
  SCN-specific regions: Sequence locations=1-81,104-250,281-325,356 -620,647-778,800-1022,1044-1221,1247-1317,1341-1342,1364-1485,1519 -1734,1764-1781,1805-2069
atgaagtgtcaacattgtgggtaccagttctgctgggtctgctcaaaaacctggtcgccacatggtaattaaaaaatacgtgcattgtccttttttccccaaaccggtggcctttgtgatggaccagagccaaaaaagcaggggttggagcagaaatcggcggaggaatttaagcgctatgaaaaacaccacgattcctacacacagcaaaaaaacaaaattacagcagaagaggaagtaaaaaaacgcataattatgaaaaacaaaaacttttcttttgcaggttggcaaaagaatatacgactatatcaaaaaacttggtgggtttctttttgaaaaatatttaccaaaattacctaaatttaaagatagtaaatcgaaagaagcagcattggttttgcaggaggcactcgaaaagctgctcgaaggccggaaaacactgaaatatacgtaagcggaacaaattgcttattttgatgagtggttccaaagacggtcctttttggaattgatttgtcaagtttttaaattgtttcgaaaggccccaaattgcaaaaatttggatttgggattttgggtcaagatttatttaaattaccgagttaaaatttaaaagttgcccattttttgggaaattttgtttcaatttcgggggcagtgccccaccctccttcccctgggtagagcatgcccctgtttgcattgtctaaatccttttcttaaaatttgttttagtgtcggtgaatttttccataatcacataaacacttttagttacgtattttcattttgtcacattgacgaaaaaaatgatgaattccacaacgcccaatcagttcttgaaaagtcggtaaaagcggtatgcctatgatgtttgaaattttcgttagttttattcatatgtatagttgagtgagcgcttgacgaacatggattttgcaaaagtcggcaacgccatttcggacgtactcttttttttttaatttctagttttattattttagctcaaagaattgtgccagaaatttgaggcagagaaaagagcattgattgatttatgtgacgaaaaaacagttaaagagatgatcgctgaaaaagggccgacggaaaatgaaacgggcacatctgctggcttatgaaaaagcaaagtgaggaaaaagaaacgaggtggagaagcggtgaaagttacaatatttattccataaaacagcacccagtgccttcatttatttattttattgttttggctatacaatcttcaattcatgcgggcttttccatttacaaaacattccataatattcgacacacacccatttcatttgttttcttttattttaaactactttatttgaatcaaaattgttctttttttccatttggttagaagtcctgaaaatacgtatccgggggttctcgaggtcgtcatttcgaccaatttgggatcccagaccagaattataacaaaaagtcaaaaattctcaatatttctctaaatttatttttaaaaaaccaaaagtagtcaaattctcttttttttttttttgcttttcaaaaccgctttttttgcggcgcgctttttccaaaaaacttttggagaactgggggttccggcggtgccgataggcgccgccagaaaaatttttgaaaattggagtgcaatttgttaaaaatcatataagaaaaatgaagtcctatttgataaaaaaaaatacgaaatattactcaatttcgtaaaatttttcaattttttatataaaaatggctaaatttaagagtattttgttaaattatttaaattctcttcgtctttacgaagtcgcctctctcttttcccttcgtctccgacccttccccagattttttcactagccccccccttttttcggcccctcatacgaacgaagtcagagggggtcgactcccccccccccatttaaggtatgccgttgggtttcggaatcaaattttgtaggtgggtagagcacccagggtttttaagaaaagtggtttcaatttctgcgaaatgattcccatgccgagttattaaatgccaatttttttaatga

SEQ ID NO: 64604 - DNA, 447 bp, Heterodera glycines
  Genomic contig location: Contig_ID=SeqID_940; Location=2718..3164; Strand=-
  SCN-specific regions: Sequence locations=1-360,399-447
cttctcagagcgttaaaaactcggaagctcgaaacattaatttcagcatataaaagctatatcagaccacagttagaatacgccacagaaatttggaatccattaaaaaaaaatatccgcaaaattgaagcagttcaaaaaattttttacaagaaaagccttcaaaaaatgtgggcttgttcccatgccgtatgaagaaagattaaatctttgcggaattaagacattggaaattagacgtaaaatcaatgatattacaactacttttaaaatcctaaaaaaacatacacatcttaaaccatctaacttttttgctgttgctaacgggctattcgcaaaccctttttattacaaaataggatatatattacaaaaacaaaaaataattttttttaatagggttattaattaatggaatttattaccgaaaaatattatggaaataaa

SEQ ID NO: 64605 - DNA, 1411 bp, Heterodera glycines
  Genomic contig location: Contig_ID=SeqID_941; Location=2496..3906; Strand=-
  SCN-specific regions: Sequence locations=1-218,240-276,299-525,547 -549,598-747,769-1210,1233-1411
atggcacgcggcgccgaaaaagccaagaaaaagtcaatttttgaggttttttggccataacttttttgtaaacggatgaaattttttgaaattttgcaggctaatagagaatctcaagagctatcgaatgataataaaactataacttttttctttgtcaaccaaattcaacaatcttggtattattcgagagcccttcgcatgctctattaacctgcaaaaatctaaaaattttcgttatgtttaaaaaaagttcaagccaaaaaagttggaaaatttggctttttaaattcttctgaccataacttttttgaaccttaatgaaatttttcaaaatttggcatgctaatagaagacacttagggctttcgaatgataccaacaatattggatttggttgacaaagaaaaaagttgtaaccaaaaaaatgctggcgcccaaacgtgccggcgcccaactgacgggttccgtttttttgtgttgtttattttgatcactgattagccatatcttacttttatcacaactaaataaatcattatatatgtatttcatttaaaactttttaaaagtaagaatttttaaagaaaatgctaagcaaaaagacgcataattagaaaattatgagctttcaaatttgattttgtaccattacgaccaaaattaggtacctatttgcatttgcaaatttcattttttttcatatgtaaaagacatgaaaaaaacgccaacaaagagaagaaaagaaattttttccttgcggtgtgttaaaagcttaaaaacttaaaattacaattattgcgcttttttgcttttagaattatgaattttgtcgtccgtctttcatcaaaatcgcgtttcctccgacttttcccttcctcctactcgccattttcctccccattttcatcgtccccttccaccgcttcatcaagcgtttcttccacccctctgctcattatcacacaaagggcagcggaccaagttgaaaatccattgcttaaataatcgtgacttttttttgacgaattgggatgagattttcttgctttctttgtgtgtcctggttgatactttgctcggaaatttaacggcctttaaattttgaacaaatttactcaggccatcagatttgaaaattctttttgaaagagacagtgccttaccaaacattaaaaaaagaaaccaaaaagtttctatttcataacccatttcatttttattttcattttagctccgtcgcatcgccgccccgggtgagcatttgcgcatttgtgtcgactcgggcggctgttccggtttcgagtacaaattgacgctcgacaagcgattggacgaggcggaggacgaagtgattaaagcgtcggagggagccatcgttgttgtggacaaggtttcgtgcaagttttga

SEQ ID NO: 64606 - DNA, 602 bp, Heterodera glycines
  Genomic contig location: Contig_ID=SeqID_942; Location=662..1263; Strand=+
  SCN-specific regions: Sequence locations=1-76,98-118,140-194,223-602
atgaaccgcaacaaagaaatgggaaaattaacacagagatgtaaaaaaaaggtccaaaaatccagaaaaggagaaataattgaaaagtcagttaataaaaaattttttttgaagtcggaaataaaaaaataaaataaaagcttatgggcagatattgaggaagaattgaaaaattttgccaaatcaagtccatgaatatttatttttaattttcaattttttgaattcagttgagggccaaaaaaatgtgtcggtcgatgatgagtatttggatgatcaaaatgccgccttttctggcttagttcacaatgataacgtcgatttaagtgctttggacgaaggtggaagcagcgatgagtgttcgatgttcgaaattttagctattttttgattttattgcatttaaggcaaattcgcttagaaatcggttcaaacatttttgtgtcttaataaaaaaaaaattcattttaaggctttctggtgaaatggctcaaaacttgttgatcattaaagcaaacatgaacaaattgtttttgggaccatctaatgatatcgatgacgaggaaaaggatgatgaaaataatgataacgaggccaaatag

SEQ ID NO: 64607 - DNA, 599 bp, Heterodera glycines
  Genomic contig location: Contig_ID=SeqID_7361; Location=289..887; Strand=+
  SCN-specific regions: Sequence locations=1-97,132-199,221-254,353 -470,492-599
tgacgaagaaagttgtgcaccacgtgaaggccattgtgcacaagaccagttcaagtgccatacatcgggcatttgtataccaggcacatggaaatggtaaataaatatttgttttaaaattattattaattgaattatggttaattcaattaatttttctgtactatgcacgccacctacaatgtaaaacacatcgctcaaatttattttgatgcaaaattaaaactgatttcagttttctcaatttcttcgagtatttttttagtaataaatttttttattattttgaaattggattttaaaatacaaaaaaaatattaataaaattcttttaaaaaactatttttaatttcttacaagaagaaaaaagtcataagaaatttaaaaaaaaatcttttaaagtaattttctgttatgaatgtacaaattaataggtacataggtatgccaaaaattctttaattaattgattatgtcattattattaattacagtgatggccaattggactgtgacgatggaagtgatgagccccgagcgacctgtgaggagatgcacagcacatgccccgctggtcatttccggtgcaacaatggacg

SEQ ID NO: 64608 - DNA, 389 bp, Heterodera glycines
  Genomic contig location: Contig_ID=SeqID_34922; Location=420..808; Strand=+
  SCN-specific regions: Sequence locations=1-99,239-389
atgactcttcttggcgcaaatacgctcgccttgttcttcctcacattggccttgtcatgtaagtgtgactaccttctacttttctaatgactttgcttactctcgctctctcttttttctctttttctcattctctctctctctctctctctttctcttttttctctttttctcattctctctctctctctctttctcttttttctccttttctcattctctctctctctcgctctctgataattacatatttaatccattccatttttgtaatatgaatattaatttaattttaagccccaatgttaattacctacagtttcgtgtgcctatacgccatgttcggtgcctgggtgttctacagtattgaatcgccgcatgaagaccgt

SEQ ID NO: 64609 - DNA, 352 bp, Heterodera glycines; identical to SEQ ID NO: 55331
  Genomic contig location: Contig_ID=SeqID_34923; Location=449..800; Strand=+
  SCN-specific regions: Sequence locations=66-66,98-104,133-294,325-352

SEQ ID NO: 64610 - DNA, 272 bp, Heterodera glycines
  Genomic contig location: Contig_ID=SeqID_34925; Location=19..290; Strand=-
  SCN-specific regions: Sequence locations=1-140,162-272
atggtatctacacgtaataaaactggaaaatttatgaagctaagcaattctgggactgaagcaagacgaaagcggaaggaatggcgccgggagcatgcaaaaaaagctggatcaacaccaaaaagtgacgaaaattgaacaaatttaattttattttaaaacactgcatttttcagcgctaaagcagaccgaagccgagacaacagcagacggagagggtacatcgacccaagccgccgaaaaagggccgtcaaaaagaactccggaccttc

SEQ ID NO: 64611 - DNA, 308 bp, Heterodera glycines
  Genomic contig location: Contig_ID=SeqID_34926; Location=364..671; Strand=+
  SCN-specific regions: Sequence locations=1-145,167-308
atgccgcaatgtcctccagggatgtgtgccgacgccctccaattcgacagtctgaaattggaattcagacggaccaaaaaagttcaaaaatcggaaatcggcatgccgacacatctctggtgtgcacatttattaattggtaagattgggttttaattttgaaagatttttacggtttgtttggtaaacaataccagggtcaatggcaactcgtacaacaaaaaaaaaatctaagaattttcaactaaaacttagaattttcagataaaaaaaatctaaatggattttttagcctagaaagactttaa

SEQ ID NO: 64612 - DNA, 675 bp, Heterodera glycines
  Genomic contig location: Contig_ID=SeqID_34928; Location=259..933; Strand=+
  SCN-specific regions: Sequence locations=1-675
atggacggccccaccaaagagaccgtcacagagcaaaaccacccggacggaacggacaatcaagaaggaatttcgcccgaaaaaatggagctgatcaacaacacacttgacaagctgtacaacgacccatcctccccagcggcgttcgctggagttactgcactgtggaaggaggcgcgaaaaaagttaaaacatttacgtaaaagggacgtggagcattatttggaggggcatcgcacgtacactctgatgcgcccccgaagagtgcgctttccaagggccaaaactgttgcagctggcttcatgacagacgtccaagtggatttggccgattttcaggcgctttcgcgccacaatcggggtcaccgctacctgcttgtggcggttgatgtgctctccaaacgactatttgttgttccactaaaaaataagagagccgatgagatgctggaggcatttaagcaacttatcgacaaaatgcccatggtcccccatcgcatcttttccgacaaaggaaccgaattcaaaaacagattgctgaaggaattcttcgaggagcaggagattgcgaagcacgagcccgtccattcatcagtcaaagcgtcggttgctgagcgggccatccgtaatggaagcagaaacggtaccgatatttcgcggaaaaggagacactga

SEQ ID NO: 64613 - DNA, 293 bp, Heterodera glycines
  Genomic contig location: Contig_ID=SeqID_34929; Location=687..979; Strand=+
  SCN-specific regions: Sequence locations=1-64,138-246,268-293
atgatgacgtggcagtcggaaggacagttcaacggcatgttcactgtgcacactgaacaggaaagtcgttgttgtcctcgttggtgtttgagttgctgttggtgttccgttgttgttgtccccgtcggttgttgtcgcaggagacggcttttgctggcgatgtttgaaagagtcgaaaaagttgaccaattgggacactttggagacgaacgctctgtaaaaaaattctgtcaattagcatttttcaatcccttttaaataaggaaatttttgaaaatccgggcaatttacaa

SEQ ID NO: 64614 - DNA, 49 bp, Heterodera glycines; identical to SEQ ID NO: 64413
  Genomic contig location: Contig_ID=SeqID_34930; Location=702..750; Strand=+
  SCN-specific regions: Sequence locations=1-49

SEQ ID NO: 64615 - DNA, 1214 bp, Heterodera glycines
  Genomic contig location: Contig_ID=SeqID_34931; Location=184..1397; Strand=-
  SCN-specific regions: Sequence locations=1-110,144-354,383-482,504 -509,556-576,598-709,735-1184,1206-1214
atgccaacattcttaatcgaatttggcactgaccagtggaaaagcgcaatccgagaaaagggcgacgaaaaaagcatttgtgaagaattcaaaacggtcaaaaaaaaagcataaattaataatatataaataatcattttttacagagcaatggcattggcaccatactcaatgacattgagccggaaaacgccaacggcactttggcaaaaataattcattttgtgccgccatcgaaagataccaaaatgttcgcatttttccaaattgaaaggcccaaattttcaaaattcataaccaaccgtacaaaattgttgccctaccaaaatgacccgaacaatacaagtcaggaagaaaaaaatatttttaaatatttaattttggcatgtttttagagagagcaacaccctgtgattactacggcgcagattgtgtgccgatcaaaaatttgttgttgaaaattgaggcattggcaaactgtggaaagaaggaaagcgaaaacaatgcggtaaaaaatagaaaaaatatttaaaaaatattatttaaaaataatttcaggctttcaaaaagccagactgggccccacttccgccagaaatgccatggaaaaagccatccgaaacaatgctatgtggaggggatatgctttgtgacaaacaaaggctgcgagaacagtacaacagattgagggaaagtgagttaaatttggaaatttaaataaataaaaataaaatcgaaattaaaattcagtatgtgggcttaagcccgaaaaagtggcaagtcagcggctaaaacgacaataccaaccaaaagagaaatggaccgaatccccgatcaaaatcgcattcaacaaatcagctcgtaataatttttaattagctgaacaaatgttttaaagtgccagaaagttatgaccactgctgggataatgccaatttgtaaaaaaatacataattaattgtttagtgccaaaggacgggtaccaacaatggaaggatgcgatagaaagtggtgccgctttgataatgtgagaatgatctttttaggtttagttgattttcggaacgattgtcatagtttcagccgagtttttgatacaaaaaaatgggggggggcggatggaagccgtaaatccgtaaatggaaagccgggagttatggggaagcgcaaatccgaaggctcattaaaaaagggacaaaaagtactagaataaa

SEQ ID NO: 64616 - DNA, 658 bp, Heterodera glycines
  Genomic contig location: Contig_ID=SeqID_7363; Location=641..1298; Strand=+
  SCN-specific regions: Sequence locations=1-544,567-658
atgtctgacgaaattggcaacattttgtcccattacaaatgccaaccccaacaacagtcttcgaccgctgattgtggtggtagtactgtttcggcacgacttatgcctgctgatggtcaaccaccagaagtgccatcgtcgccggttgtgccattggcattggctgcagcacccattgacaattccttccagccaaagcatttaacagcggttgccaatttggacgatttgtcgggcgatgaggagggcaacttggtgcgcaacttgtccgccacggtgtgtatgtgcgtgtggatttggcggtggggttcaactgagccccgccaactgggccccaaccaactcgggcttccggaccaactgggccccgctaactgagcgccaaaaatcattgcttgacaatatgaagcaaaaaatatgactggctcatggtgtcgagttgatccggggcccagttggttgagctatcggaaggcccagttgaccaagtccgttggtttggaattttggaatttggacaagaaaaaagtttttgtctctttcgaatatttaaaaaaaataaaattcgggaaattaaaaaaaatatgcccctttttgtggaaatataatcatttttatatttcagtttttgtacgaaaacaattataagcacttttga

SEQ ID NO: 64617 - DNA, 2915 bp, Heterodera glycines
  Genomic contig location: Contig_ID=SeqID_7364; Location=47..2961; Strand=+
  SCN-specific regions: Sequence locations=1-47,71-768,790-854,883 -934,957-1650,1700-1786,1808-1825,1847-2192,2229-2424,2468-2664,2692 -2767,2811-2915
cgattggcggaaatgcacgcggaacgcgagacaaacaatgccttgcaaccagccccagcagcagcagcgcaacaacaattagcagcagccggccgaagacggctgtccaccgtatgcgaggatggtacgcatttgcatggaaaaccggtggcattgcatgactcacgggtgctggtactgtacacgggaggtgggtgaggaattgctaatatattcgagaggtgaatgaggaatcattactgtatacacaaggctaactggggaattcttactgtagattgtggggcggagcggtggggaataatattatagtaccggcatgtgagaattattattgttcatgggactgggtcatgaattccaagtatacgcttgataggaattacggcacccagttcgcgagggtttttttgtcatgttaattataaaaaaaaccatttttcactcaaaaatgtttttcaggcacaattgggatgcgcgcgtgccatgatggaggtgcggtaaatttaaatacctaatttttacagtgcaattaacttattaaatagggacacccaagagtttgtccacttggcgaaaacaaaaagagctaataccaatagtacaattctaataaattaagagataaaaattgaaaatatttctcaatgtttgattgttctagaaaaaatgaattcatttcaaaaaattccagaattaccaaaaaaaaaatcactaaaaatttagctggttcgttcttttcatacatagaaaatgagatcattttgtttttagtattttcaaaagttaataattattaagaatctctgaatacccctttaaaatgatccgttgttaaattctttcccaaactcttttttttaaatttatattcattattttcaccgacgaatttttgattgcttttgttcggattgttattttcaatttattattatcactttttctataaaaaactcatttttttaaataaaatccatcaaataaagtagggctttaatcccctttccccgcaatttggtccccgtcgttccccggtttggccgggacccctcctgctgcctataagctttaaaaattcaatatcgcgcatagtttacgcgcctgagcagtactatttgccgcgtgccatccgcgacattccgccgctcaacgacaaggagtacgctgatcggatgtacgcggatttgccgctgaagccgctctgtttgccgcccgtgcacgggatgaacaagcgggtggtgtattgggtaaggacggcgaatgaaatcctactcaaaaaaatgcggaatctccgaccttaaccgaagttcgggcaaagaggattttggcaaaattggatttatccgacttttcagttggtcgaatatgaaccgctgttggattcgtccgacatgacttttgacgattggatacgaattgccaaagtttgtacggagaattgatgatgctcgaccgaaaaacttctcaagatcgaagcactaacaatcttccaatggaacaaaccgaattgtactgcccaaatcgcattaaatcgatttactattgcaaattttcggttttttttgtctccagcggccaaaattgatcagacaaaacgagaaagatctaaaaaaatcgaatcataaaaaagcaaaaattaagctagagttattaaattatttttttaatattagcaaaaaaattaattgaataaaaaggaaaatcgcattatttcttatcacttttggcgccggattcccaaaaagccgaaaatttacaattaagcaaatcaactaccttcaacagataaaagaaagtgatttgggcagtcacacttcgggatgctccattataagcaaataaagatgaagatcagggctgcaagcaaatacggattacggaaattacgggggtttttggacccctgttatgacggattacgggtttctttaattgagaaaatcaccgtaaatactgattacggatttccgtaattgaaatcccagttggatatggaaaaacaaaaactaaaaatactgatgagccttaaaagccgagtccttctcaagtcggaagaccggcgagaagactctcgagtatcatttcagcactgaatgttgaatggcactttaaaattggttaaaatttgcaggacattcgcaagtcgtattctgcctacgacggattcgttgtggtcatttttttacatcatttttaattttatttaaatattatttattaaatttgtatatcaatcaaacagctccacggcaccgacacattggcatatacggcatgcgcattgtcatttatgatggaaaacttgggcaaaccggtggtgatcacgggtgcccaggtacttgaatatatatgggtgcccaatatggacaaaatgtacccagaccaactcattttagattgatcaaataattagatcgaacctaaaaaagtattaataattgtaatattaaattaattattatttgcattttatttccaaaataataaatcataacttagctcaaacttattgaaatttgaactgaataataaagaattatgtatctttgaaatctatttaatcatagattgatttctgaaaaaagttatatataaattaaatgtatcatattttatggtcaaaccaaaaatttcagtacgttttatcgcttaaaattctgcaaataaaataaataataattaaatttacatatcaattaattccaaatcatgtcgtatcaatagattttcatattatccaatcacagttaattcatctcttgggattaatttattttcaaatattttagtaaaaataaacaaatttagtctaaagcgaaaattcgcagattccggtggcagaagtccgatcagatgggcgtgaaaatatgatcggtgcactgattgttgcaggcaatttggacattccggaa

SEQ ID NO: 64618 - DNA, 1169 bp, Heterodera glycines
  Genomic contig location: Contig_ID=SeqID_7365; Location=387..1555; Strand=+
  SCN-specific regions: Sequence locations=1-238,260-426,523-547,592 -1169
atgagtccatttttcgcagtggccaacttcggcctttcactgtgcaagaatcgttgtgccgaaatgttgttgtgctacgcattttcccttctatgcccattgaatcggtgcaatttcaaatcttaaaatttttgttacagtaatcgaatacagtaatggaactgatgtcgcaatttttaaaaaatgccctttggcgctgtgtaaaaaatcgtaattttccaacacttagtattaagatgctaaatttttgaaactttgcttagcccacaggctaattcggcatgtaaagcctttcgagttcatttccatattggttacaaaaaagattttattgttgacttttttgcttaaaatcaaaataatttttaatttgtgataaatgcggcactctccccccttgtgcctatgtgccagtggaggataacgaattaaatttttatttgaattaagtcatttttatttattatttcgtaataattaatttttataaatcaaaaaattaaattttaaatttttattattcttgtcactcatctttatatttaaaattcttccccttcaaaatgccataaaaatttttaaaatttaaatgtgccaaattcttctcttttttttctcaatttccatttttttggtccgcgctttgctccgtccgccaacccgtggcgttgtgctgcaggcgtacggctcgggcaacattccgctccgtcgggaggacattctgcaggaaatccgtgccgcggtccaacggggctgtctggtggtgaacgtgtcacagtgcgccaagggacacgtggcggtggattatttgacgggaaaggtggccaaagttagaggggaaagcatatattaagcctgagcaaatccgggccaaaaaatggaaattttagtctttgggctacgatggtggcgctaggcgccgtcggcaaaattttgaaatttcaatgaaatcttcaaaaaaaaggttcctttaaatttaaacttagcttgtttcatttcaatgatttttcgtacataaatttttaaaagcttaaaaaactactcgataaaaaagtcaaatatttttttaaataaacgataaaatcaaaaaggaattaaaacgaaaatttcagaaaaaagaaaaattaattcgtttaagaaaaaaataacttatataaaagtacgataaa

SEQ ID NO: 64619 - DNA, 949 bp, Heterodera glycines
  Genomic contig location: Contig_ID=SeqID_34933; Location=108..1056; Strand=+
  SCN-specific regions: Sequence locations=1-32,54-57,185-312,334 -518,540-571,593-661,683-745,767-949
atgtgcttccagccgctatacagcccggacgaattcaaagacattgaagaacaggtcagagaaagagagggcggaagagagcgcagaaacagagaaagaagggagagagagtaaaaggaagagagagactggggataacgaaagagaggaagagagaatggaaagaggggaagagagagagagatatgtgaatagagggaggaagataaagcagtaattagagaggcgaagaggaatgaaaagggatggaaaggggatttagagagaatggagagaaagagattaagagagggtggaaagataatgaaaaggaaggggaaaattgccatttttcttgaggatcaattcttcaaaatgcttatcgttcacggaaaagaatacgagtcgttggactgcatgagcatcgacttccacggtcggcccggggaggaggcgcgctatttggggccgaagggacggacgaacgatggcacggacggagacgtacggacgaggggggcaattgaatttgggttaaaattctgttttttcagctctgtctgtccgaatcacacgaaattgtcgcggaagtgaaagaaatacagactttgctgccgggcgcggaagaagcggaagaaaaatgcatggaatacggaggggaggagcagttcgggacggagttggagtgccatggccaatgccgacttggcctaattcgggtcggctaaatgccatttttggttggctgatcagagaactccctccaattttgcaatttaaaatttcaaaaatggactttttgatcaaaaaccatcatccgttagcaaattgaaaaattttgtgaatgtttcagaaaatttgcaaatgcaccgctcgcactttggaaagcctcgccgattcggaaactctacagaattttcccctttgtgactatgcgaaatgcaatttgaagttaaatggaaaaaaacaa

SEQ ID NO: 64620 - DNA, 376 bp, Heterodera glycines
  Genomic contig location: Contig_ID=SeqID_34936; Location=71..446; Strand=-
  SCN-specific regions: Sequence locations=1-267,289-376
atgctcaactcaaaaagttacagccttctgaaaaagtgcgtctattttaaattaacacccctttttcggaaaaaaattcgttaaatttttttccgtcatcatttcgtcttctcactttcagaatcttaatattttcagaactaacccaccccggtgctatgtcgttattagagctcggtattttgaaaaaagcctggacctggacttggattccatgttcgacctggatttcctggacaaaaatccaggaaaatacaggttcaggaaaaatccaggcctggatccaggtccatgccgagctctagtcgttataaaaaaacccatcaaaaagggagcaatcattaataattggtgtcccgacgaaaaaaaatgttaa

SEQ ID NO: 64621 - DNA, 141 bp, Heterodera glycines
  Genomic contig location: Contig_ID=SeqID_34937; Location=280..420; Strand=+
  SCN-specific regions: Sequence locations=1-96,118-141
atggcccccaaattccttccgcccgaacttctgttcgaaatcgtggcgtttatgcctgcaagaggtgccgtgccgaatgcttttacctcctgctggttgcttcactcacttttgctccaacgagtcaccaaatggaagcag

SEQ ID NO: 64622 - DNA, 619 bp, Heterodera glycines
  Genomic contig location: Contig_ID=SeqID_34938; Location=47..665; Strand=-
  SCN-specific regions: Sequence locations=1-112,134-197,307-461,581-619
atgaattttcaggcattggtcaaagcattcgccgcgactaacgcaactcatttgagtgaaacggaattggagaaagagttggacagggaattggaccaatcagtgccattgattttggaagaaattgccaaaacggagggggcaaaggcagcaggggaaccgacgacggaattggagacattggttggcgaggggttggagcagttggaggagaacaacaggacgaagacgaaggagcagcagcagaagcagggcgaaggaggaggcgaaaagagcgggaaatgtaaagaggaagagggggaaaagacaacaagggccaaaacacagggtaaaacacaacaagggaatacaaaaaacacaaaaaaataaaaataaataaggtgtgacagacggaaacgaaactgaggagccatttgttggagtgggcttggagataacgaaagttgggcaaggaattaccaaaacgaatacagaagcggaagaaaagacagagacaactgccgaaacacatccagaaacagaaacacatcctgaggaaaagacagagacaacagcagaaacacatgctgaaatagaaacacatcccgaagtagaaacccaaccagaggaaaatacaacg

SEQ ID NO: 64623 - DNA, 744 bp, Heterodera glycines
  misc_feature (15)..(15): n is a, c, g, or t
  Genomic contig location: Contig_ID=SeqID_34940; Location=217..960; Strand=+
  SCN-specific regions: Sequence locations=1-446,469-508,536-541,564-744
atgacaaccataccngaagtcattgttagggcacgagaataccaagggcgtggtctgttgagcgcactcgacttttacaacgaactgtttcaaaaaactaatgaactcaaacagcaattaaattgtgaaagggttgtgccactcgttgaaattgacaaagcggaattggacaattatctgcgaaaaccgccagcgggattcgttgggtttgaggagctctggacccaagctgtgctggaaaaccccgacccggagaatttggtgccctatccaatccagggatttgaacaattgttgcagcgaaaaaagatgcaattggcaacggtttcttcgctccatcagggaattggttggaattactatattttttctttttaccttttattcttttattagacaattgcgtttctcgaattgctacgaaccaaagcttagtgctttctgcccacaataaatatattcaaataatgcaagcgcaaaaacaattttctaatcggttgtacccccaaacactaaaaataaaacaaataattttgcagtttattgcgcattttggcttcacaaacactttctcaacgctttgggatgattgttgacgaaaaagaagaacaattattttgccgcttagaaggaatgaatttaagagtgaacggacccgggcgcttaaaggtaatttttaatcaaaatttttttctcgtcctttatcccgagattaaattgaaatttcttcttgtcaaggatcaa

SEQ ID NO: 64624 - DNA, 735 bp, Heterodera glycines
  Genomic contig location: Contig_ID=SeqID_34941; Location=1..735; Strand=-
  SCN-specific regions: Sequence locations=1-509,531-662,689-735
aaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagttccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatcctacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctcactgttttgatagaaaaagcatcagagtgcctaaactaaca

SEQ ID NO: 64625 - DNA, 1643 bp, Heterodera glycines
  Genomic contig location: Contig_ID=SeqID_7367; Location=2109..3751; Strand=+
  SCN-specific regions: Sequence locations=1-1125,1148-1643
ttggatgcttatttggattcatgtgctataacaaaaccggatcgagctcccgaacacgactaccaatacacgtggagttgtgagccgttgcgatttgaaagcatcaaaagcgatgagctgacttggcattctgagtggcgttggatgaacttggacgcacttcgcaatacggaaaacgaatttttggatgaccagggccgaatccatttgtgggcgagggtggacattttcgaactttctaattacgggtaggttttaaacagccctacaactaatctttacgtgtgatttagacgcgctgataagccagacctattaacagtgaatggtcgaactttccgagtgaataaatacgtaatcaaacttcgtgctgaattcattttactatgtttttcagattttggctggcttttccccattttttcgcactttctttttcaaggacggcttcaaagaattccttactcagaacttcgagattcgagaccccgaggtggatgccgacatgtttggtcgtatgctcgacattgttatgactcaagaccaatacgacccggatggtgggtttggaggccatgtttatttacacgaatctcaatctccgacttgacagatgaaactgtggaaggcttgcttcacttagccgacaaatacgaccttgcttgtgtgaaagaagtttgcgagaaattcctcatggattacagtgaacagtcgcgcattttcaaatttcggatggcggaagcttacggacttgtcgccttaaaagtaaggaggacaaaatttttaatctactagtttgtagtgggtttgatcgacgaccgatcctctgtattttattcatttttttccaaaaagcataaaccgttttttcttgcctaaatttgagtgataattaaaaaaatttgcagtgtctgatttttggaaggtgggttgttttcgaaaattaacagtgaagaagctaacacgtttatcccgcgttaaatcggaatgtttgaacatcgttcctctatatttaactatgcattttttgttaccgttcgcaccccttctagcaaattcccccctcttatgctttcctcttacaaattaggcccgtaacaataaaaaggcgagataggttaattgctttattttgtagttaatccatctcaacaatttttttttcattaagggtcaaacattacggagaatggacccgcaggagttttgtgccaattttcttgccaatgtcaacgaattcgccaaactcagcgaaagatccaagcgcacttgggacaggcgcatgggcgacttcagttttggtcgttcttcggcttttccatgttacaactgccggaagcgtcggcgagtgttttcgcccgagccaaacattcatttgtccatcggtgattatacggcacgctcgcgcacagtctcttccactcacacggcaagcattcgcactttgtcccggtcaacttcttacgatggccaagcgagtaacgacgacaattcatccatttaccatccgccaacggaggcctccttttctgcatagcaacaaacgcccagaaccacaaacattgcccctcatagttgggcaccctctgattttgcgtgtgtttttcttagatgcaaagaaagtcaagtcgaatgttcagtga

SEQ ID NO: 64626 - DNA, 91 bp, Heterodera glycines; identical to SEQ ID NO: 53030
  Genomic contig location: Contig_ID=SeqID_7367; Location=154..244; Strand=+
  SCN-specific regions: Sequence locations=1-91

SEQ ID NO: 64627 - DNA, 1592 bp, Heterodera glycines
  misc_feature (975)..(975): n is a, c, g, or t
  Genomic contig location: Contig_ID=SeqID_7367; Location=4294..5885; Strand=+
  SCN-specific regions: Sequence locations=1-346,369-440,462-996,1018 -1205,1227-1365,1389-1406,1448-1553,1588-1592
atgccatttcggcatgaagaggagggcgactcgtacacccaaacggaagagattcaggtgggaatctgaaacggcaaagaaaatggccctggagggggggggggattggtaccagggaaggagttccgaggccctaaaaaattgcagaaatcggacttattccccaaaattcagggacaattccctgcataaatttgtatttaaatttattggaccatttgggtgaattaaactccttccgtcaactaatcttttgaggtcgcttcgatcacatggaattatcgtgcccatgatttcgttgtcaaattggacatttgggatgttgtggacaagggacgtcgtgccgacccttcgaccggtgcggcggctcctctcaaattgggattttctcgcaaaaatgcttatcaatcggccaaatgttccgttgacattccctcggctgtccaagaagtggtaaatgagaaattaggcccgaattttttgaatattgttggccaaataacagctgtaagccaccagaattgtcattaaattaatcattttctcttaaattgacttgatttatgcctttttgaagattcaaaacgctgcttgtgatgcgagcactgtgaacgtttacaacggctgtgacggagtcgtcatgttattcgacgtgaccagagattggtcagaggcgggggggggggggaggcgtacaacaaagatcaatcgctcgctgtttttaattaccgcattttcatgtttttctgactgtgttttgtgtaggacctgggcttacatccgtcgcgaattgccctcagtgccggcccatattcccgtgttggtaatggccaacaaaatggacctgatcagtgctgctgatcagccactgccttacaccatcggcgaatgtctccaatttcttcgcgttttcaatgaacggtggggaggagcacacatttaaagggcggggggggagttgaggggccgaatggnttttagcattgggtttcggttaccctcccccctctgttaaatttgacattttaggtgcaaaccctgcccaaatgcatcttcctccgtccgttgtcccccgctccctttgccaattcgatttgtgaaggcgtcgatgaaaagcgcccggggactgaaatttttgtacaatttcttcaacattccattcctaaatgtgcaggttcttgactgacaatgaactttgcttattgctagaaaatgttaatttttaattccagaaaagctttcttaaaaatgcaatggaagcgaatttgagggagctgcgaattgcggaggaagaattggacattttggcgaaagaggaaggacaaaatcccacaaattggcgaagaaaaagcgacgaatcggcggacgaaggaaaaggcgaagagagaaaccgaagacacagtggagaggaagagacggaggaagaaagggaggaggaggaggaagaacacacggaagaggaagagaaagggcatggggagaggcagagacggcaaagggacggagagcggacgtccccagcgaaaagcgcacaattcgccgccgcttctcgcccccgtccctccccctcctcctcgtcctcgtcggaagaa

SEQ ID NO: 64628 - DNA, 1509 bp, Heterodera glycines
  misc_feature (17)..(17): n is a, c, g, or t
  misc_feature (30)..(30): n is a, c, g, or t
  misc_feature (68)..(68): n is a, c, g, or t
  misc_feature (110)..(110): n is a, c, g, or t
  Genomic contig location: Contig_ID=SeqID_34944; Location=95..1603; Strand=-
  SCN-specific regions: Sequence locations=1-502,525-676,721-757,790 -840,919-925,948-1040,1062-1172,1194-1198,1228-1509
aaaattttcatttttanagggttcattttngaaaatttttgctcgattcttagaggtgtgtgtgtttntcgtttttattgcacaaattttggacaaaacactgaaatatntgaaaataattgtttcaaatttttttaggcttttaggtgttaatattaataaaaaactataaaatagttgtaaataactcgaaagtcaaccttaaaacaaccacaaaaaaactttttttgttttttgtgcgttgtaggcactgggagctcaggaaaaaatatgaaaaaataaatttaagcaaattttattagaattggttccatttaaattagcgtattttatttttgctaatttttggggattaatctgttttaacaatttttagaccccaaaaatctgagcccttataatttgcgatgtgaacttacaatacgtagtggaacaattgtaggtgaccatctcgacaaacaattacagcaaagacaaacagaaatctggacaaattatgtggaagcaactgttagaaaaattaggggtcacgttgaaaaggtaaaacaaattttttggaaaattctaaaaaactaaaaattttcacaaaatctatgcacattatttgttaggtaatggtattttctgcctaatttgtagaatttcatgttttaaagtcctatcgagtgcaaattacattaattaaaattcataaaaaatttgtcaaattaatatttttttgaaaagtttcgtttcataaattttccatttttcgatgaattaatataaaaatataaatatacatatatacaggtcaagaaattgtttctaaatttaatgctatttggtccttttttcacctttaaatttttagatttttgataaaatttcaataatttattgtatattttttaaactcacatttaatatttttaaggatgttcagtaccaaaaagtagcacaagaaaactatgcgctccaatctttccccggtttggatgaaattttcagaaaaagtcgtttttttcttgtaaattcccagccccaagtggactttgacaattacaatatttttaatggcattgaaaagatcaaattaattggtggatttcaattaaaacaaaatggacgagaattagacgaggttggcatttgaatatttaataagcaaacttaataataattgtatgttctttataatacatagtaaaaatagctcaaaatatttatttaattgtattttattttgtgattctttagaaaataactgcaaattttggcgacagaaatggcattgttttcgtcagttttggcacagttatggacaccaataaatcggatttttcgtatgtcatcgaagccataaaagtgacaatccaaaaatttcccgattatttattcgtttgtaaactgagcaaaggtcatatggaaggaattccaaatgtatttgcgaccgatgaatggttggatcaacaggggatattaggtgaaaagaaaattaataaaactaaatacgatcaaattcattaa

SEQ ID NO: 64629 - DNA, 313 bp, Heterodera glycines
  Genomic contig location: Contig_ID=SeqID_34951; Location=508..820; Strand=+
  SCN-specific regions: Sequence locations=1-313
atgggccgaatgcttccggcagaggctggcccgcgttatgggctttacgcggtttgttttgtgatttcgaatattttgtatagctgcaatttaattttaggcactggcggcaattgccggattggcctattgttaccgcgaccgtcttggatttaaaaagtgaatggacggacggcggaacggattggtcacccaccattttgatgagagagggggcaattttgaattcggattgttccaaggtccacaaattttatggccaatggtcggatcttttttcatttgatgctttttggtttcttttcactgtaaa

SEQ ID NO: 64630 - DNA, 958 bp, Heterodera glycines
  Genomic contig location: Contig_ID=SeqID_7369; Location=327..1284; Strand=-
  SCN-specific regions: Sequence locations=1-107,129-171,194-240,275 -276,298-626,651-772,794-958
atgttgctgaatgtgtccgactcggactcggcacgcgaaggcggactgatcagcggagaaagtgtgtacaaggccagcttcaggaaggtgagccggggcgggagatgaacacaaaaagggcggggtggagccaactccgagttctaattccccatttttagttataaaccgatttttcaaaaataaaaatgaccaaatttactattttagcagatttcatgaattttttgacagattttcgctaaaaatatctataattttgaaaatttacaaacccaactttgtaaaaaatttacgaaattggaaaaacgaaatttcctaaaaaatcaaatttgcctgggatgcccatacgatttacgaaattaaatgggaatctatgggaaatgccattcattcattgtccattgcttctgttgttgctgtgaccaattcattcgcaacaattaacccaaaaagtgcgctctgttaattgtttgccttttcctaacaaattttattcggacatttaactgctaattgactgctctttccttctccttaattaatacgctaaccaaatgcacagaaattggcggacaaattgcgccaaattcaaagcaacacttcgcttccgcccggctcgcgtggtgccaccaccaccaccagccaacactcccaggcgggcgcaggcgccgacttcgcctcctccgcgggtgccaacgcgtcgtcgacgttgcgcctgcggctgttggaccgatctttggacggcgccaacagtgccgccggaagtgtggccaacggcggagggggcagcagcagagggacaccgccgccacagccacagacagtgcagctacagcagcaaatggcattcggagaggagagacccgcctcggaggcgagcagcagcacacggcggatggaaaacaattgcaatgagaagcaacagcacagccgaagcagaaggagggtcgaacag

SEQ ID NO: 64631 - DNA, 602 bp, Heterodera glycines
  Genomic contig location: Contig_ID=SeqID_7370; Location=596..1197; Strand=-
  SCN-specific regions: Sequence locations=1-602
atgcacatagaaatagtgcacgaagaccgaatattgggcacggaaaatgtgccattggaattgaccgaacaacaattggacaaggtcagtattcggtacctctgaattttatttacccccgcttatgtctttttgtttttagttaagcttaggcgcttacgatcgcctgcttcgccaagggtcgtttagagaattggtcggcaaaatgatgagaaatcccctggcttcgcctgatctcgttgtggcgacgtttggccaaattcgcattcggaatcgccttggccaggcactggctaaccacgacaaacaagaacttcgggggttgttcctcttcctccggcacaatttgttcgtcgcttcgtactttgacattctctacgacgtggcaaccgtcgcaattggtaaaaattgttgcaattatacacaaattgtgcctttactccaattgttttgctgcgtttagacacttacgctggaaaaccgctccaaaaagatatccgtgttaacattaaactgttggaagcacagctcagaagtgaagtgcaattgcaggaaatgctctgcgagacaattggtgcgtttttgcaaataattaaaataaa

SEQ ID NO: 64632 - DNA, 1086 bp, Heterodera glycines
  misc_feature (655)..(655): n is a, c, g, or t
  Genomic contig location: Contig_ID=SeqID_7371; Location=705..1790; Strand=-
  SCN-specific regions: Sequence locations=1-202,224-269,300-1086
  Gene Ontology: Mol. function=ATP dependent RNA helicase activity; Cellular component=nucleolus; Biological process=nucleobase, nucleoside, nucleotide and nucleic acid metabolism
atgaaccgaaaaggagaagcgatgcttatgcttacgccgtcccaagaaccttttgttgctttgctcaggcaaaggaatgtccccgtcacaaaagtgacgtgagttctctttaaatagatttttgttgtctttttttctccatttttaccttggttaatttcagagtcgactccaacaaagtgtttgatgttcgtaataaaatcaccaatttgatggttcctttcccatcggtgaagcaatttgctcagcaggtggttgacatttacttatatttaaaacaaaaaataacattttgttttaagagtttaatcgcttatgcaaaagctctctatttttcggaattgaaggtaagcgcaatttcatgaatacttaaaagttttcgttttatttattttaaaagtttttactttttgttatatcccaattaaatgcacagcagcacttttattaattttaggaagtgtttgatgtgcaaagcattgatttcgatgcactttccaggttgttttcctttgtcgaattacacatttcttgggaccattaatattaaatgttaaataccatacattttccaggtcttatgggttggtagttacgcctcggatcagatttctcagaaaaaaaggaattattacaagaaaatatgtcgaattgnagaagggaacttcgccagaaatggcaaccaaaactgaagaaattttgcttggcaatccgagcggaagcggcggaaaaaatccatttgatattcaatgccaaaacgaaatggaggaggaagaaccatttttgaaggtgtcgcgaagggacgtgttcaattccatcactgaggtcgatgtgaaggtaagcatttcgctgatttatagtcaagggaaaacgagaattttcaggaagaaattttgtcgagaatttcttcaaagaaaccaatttcgaagacaatgatggctaggaaaatgatcaaacgaatgggcgttgttgggaagcgaaagcgattcgaaaatgagagagaaagcgacgaagaagaggacacggaacagcagaagaagaagggggacgcaatttgttgttgatttttaaatgctaaataataaa

SEQ ID NO: 64633 - DNA, 114 bp, Heterodera glycines
  Genomic contig location: Contig_ID=SeqID_7371; Location=476..589; Strand=-
  SCN-specific regions: Sequence locations=1-114
atgatttcatcgaagagaattcggacccattacaaaccgattgtacggatagaggacgatgattcggcacagttcggatgttcggaagcagagcgatattggatgggaatggcg

SEQ ID NO: 64634 - DNA, 805 bp, Heterodera glycines
  Genomic contig location: Contig_ID=SeqID_7372; Location=1..805; Strand=-
  SCN-specific regions: Sequence locations=1-133,159-223,245-675,697-805
  Gene Ontology: Mol. function=ATP dependent RNA helicase activity; Cellular component=nucleolus; Biological process=nucleobase, nucleoside, nucleotide and nucleic acid metabolism
cccattttcggcactgacgtcgactttgaaaagcagcggttgtcttccgtcaatataatcatctgtacgcccggccgtcttttacaacacatggacgagaatgaacatttcagttgtgatcagctgcaaatgttggtgatcgacgaggctgaccgaattttggacatgggatttagacatcaggtgactgaattataagtcgctgatcagcgaacattaatattctaaatctgatttttatttccgattgacgccatcattgaaaatttgccgaaagaacgccaaactctgttgttctctgccacccaaacgcgacggacggaggatttggtccgagtttcgcttcgtaaccccgtcttcgtggcggcccacgaacactccggcagtgcgacgcccgatcaattggtgcaggtgaagcggaccaaacactgaaattctgaaatgttgttttttattttcaatccatccttttttgcagagttatttcgtgtgcatggaagaagcaaaactgaacatgctttggtagcctttgttatttcgataatatccgtcaaaacttagtgttagttaatttcctctttaatcctttcaggtcatttctgaagaacaatcggacgaagaaaacattggtttttgtcacttgctgtaagcaggtgatgaatcatcccatccgaattcttttgatttagtttttaagtgatttttccttttcaagggctcgtttcatcactgaaacattcactcatttggcggcccggcctttacttcacccggcctttggggtgacctgaaacagagcaaacgc

SEQ ID NO: 64635 - DNA, 826 bp, Heterodera glycines
  Genomic contig location: Contig_ID=SeqID_34952; Location=641..1466; Strand=+
  SCN-specific regions: Sequence locations=1-2,25-162,202-571,593-805
atgaaaattttattgtttttcattgctttcattggcattctgtgccatgaagtgttcgcaaaatttacaaaggagaagaaagacttcttctcatctgtaaattttaaatgcctaaaactcatcaacgaaatgaaaaaatattctactgaagcagaatgtgagtaataaattatataataaaaaagttgttttaaattttttggtttcctttttttttgaaaagaaaaaaatattgcagaatattgcttagtctcttctttttttgctttgtaaacaaaaattcacgtcattttatattatcaatttaatgccgaattaatgaatttatttttctttttgctatagattctgaagacaaattgatggcaaattttagagatttatctgagaaagtaaaaacttgttcttgttgtgtggacgaaggtaataaatcttttttcaattcaatggacaatgccaaagaattctttgaaaatattgggaaagatgccaataaaagtcacattcaaaaatggcttcatcaaataagcaccgatttcaatacattgactattgaaagtgacctgtttgaaatttgggaaaactttatcgaatactcacatgccattacctcggaaaatttaaagtaatgtgtgatcaagtggcgaaaaatcagaatgatataagaaatgatgcggcactttatgctgtccttaataccattcattatgctgtagaaaaatgtaaaagtttagcagcaaactatgaaaagcctaagctttctgaaatgatttctgtttttcgtgatacactcctcattatgaaaaaatccttttacgaaagggaa

SEQ ID NO: 64636 - DNA, 664 bp, Heterodera glycines
  Genomic contig location: Contig_ID=SeqID_34953; Location=792..1455; Strand=+
  SCN-specific regions: Sequence locations=1-386,409-432,460-506,528-664
atgactgatgggacgaaatcggtgagtgtttttctttctaacttttgatgccattacatttcttgggcctttgttttaagatggacgacgccgttgaattggtcactgccctggagaacatgcgggtgaacatcgacctgctcagtgtaaaaaccgacaaatttgggatttggggtcacacttgagaggaatcttgccaatgcaaaaatggtttaaaacctttgttggttttgtttcgattcaatgccccaggattctatgctcgtaaaaactagacatgcatattccaaccgtttcaggtacttttccattgatgacacaccccattaaaaaaatgagcaacaaagccggttcagtatacatagacttacctattttgtacgcataaaagaattgggttgggttcaaatgggacaaagttttctcatcttctttatattttgtatttacttacacatatcgaatggctttgttgcgcttttttaaattggggtgtgtcatcaaaacataaaaatataccttttattccctctattaatttttcaacgaatttaatttacaattttgcttttttcagaaaactcgcattggcgctgttttgaacgaattccgcaagaaaatcaaagacgaaaaactagcaaaacgttgcaaggcattgatcaag

SEQ ID NO: 64637 - DNA, 724 bp, Heterodera glycines
  Genomic contig location: Contig_ID=SeqID_34954; Location=161..884; Strand=-
  SCN-specific regions: Sequence locations=1-57,79-106,128-646,668-724
aaattttatttcttattcacaagcaatgtcaaaaaacgacttccgccctcacaaagaaatgtaaataaaattgaaaattttgtaaatttcatagaaattcttcaatttttcagctttatctgcggcgattgttggcttttggtgttcgattttcttgcgccttctcagctcggccttgaaattgcgctggtcaaccgccgttttaactgcatcgtcgacgaacacttcaaaacacgcaaatggaaattgggcaaaatgcgaatttgccacaaaattggagagaatggcacgaagaaaatgcaaattgtcaattccgatggaaatccattgtcaatcccgcaaaatccgttgtcgaacaaagtcatcggattcagacacattcatatcttgtaaaaatttgattaaattggaatttttcatctacattctctttttttcagctacatcgatcaaaatgtcatcgcatttatccgccgtttgttcaacggatttgtacattaccacgggcaatgatcgcattttggaatttattttgctcaacatttggccaatgctgcatgactccattcgtgttatgcttttgaactccatcgcttttcggcgtttgcgtcaattggccccgtcacttctcagcgaatgtccatcacttcgttttgtctctttctttgacgtcattttccccgaatttccgccggatgaaagtgccaatgcgtcggatggctaa

SEQ ID NO: 64638 - DNA, 356 bp, Heterodera glycines
  Genomic contig location: Contig_ID=SeqID_34956; Location=524..879; Strand=+
  SCN-specific regions: Sequence locations=1-356
atgaacctagcccaccgaagcgccgaagaatgccaaacatcctcaaaagtggaagcaacaacaacaacaacaatggcaaaagacgcaattttcggcactatgtacgcgcgctgaacaccgacgtagcgttcaacaaaaaattcagactaatgaatgctaaaagtacattcatgatccagactctaccatcaaatcctgagtcgcttttgcgagtcatttttggacattgcatacaatcgtcattaaatgaagctcagagacgtggaattgaaccgagtcgacttggggcaacaattacttcacagttattggaccctgacatttggattccgatccgtcagataactccaaacaca

SEQ ID NO: 64639 - DNA, 690 bp, Heterodera glycines
  Genomic contig location: Contig_ID=SeqID_34959; Location=91..780; Strand=+
  SCN-specific regions: Sequence locations=1-17,39-92,121-306,328 -490,512-690
atggcatcaaaatttgttctcatccccgacgaaatctatcaaggtctaacaaacaatgattcgggaaatatcaatttggactttgctcaacgtactttggaaagaacaaaaagaaggagggaaaatgtgacggctaagaatgtacattataaccaggaattgtcccgttatctccatctgcgagatgaacaacaaaatcggccaactaaagttgaaattgcgaaagggttaaaagcgttgattaaaaggggagatgaaagtgatgaagaaccggtttttaatttgggatcagacagacagcaatcccacgcttcacaaattcgtaaaccacgtcgacaccatcacagctataatgaggatgaggaaatgccattacagcagccttctccaccgcttcgagctgaaaataggggacaaaagcggaaaccaaatgatttttattcctcgtgggaggaaggcgcaaagagacaactgcgtcaccaagatgaaccggttcctccctcctctaagatcgtgaatagacaaagaagaagtcaaccgccagtttcattgagaagagaagaacaacaaattccagttgacatcccgcaggaagaacccttccaaccagtcccacaaccgtctattcctatacatccacaagttaacagaaaacggaaagcccagcataccctaaatgatattcgggaa

SEQ ID NO: 64640 - DNA, 49 bp, Heterodera glycines; identical to SEQ ID NO: 57477
  Genomic contig location: Contig_ID=SeqID_34960; Location=401..449; Strand=-
  SCN-specific regions: Sequence locations=1-49

SEQ ID NO: 64641 - DNA, 2167 bp, Heterodera glycines
  Genomic contig location: Contig_ID=SeqID_7374; Location=172..2338; Strand=+
  SCN-specific regions: Sequence locations=1-877,906-1052,1074 -1409,1473-1473,1555-1755,1799-1799,1879-1894,1973-1976,2026 -2026,2125-2167
atgtctcggaacgtacgagttcccgaaaaagccggctccaactgcagtttacgcgcccaatcaacaactaacctcaatttcattttttttatgatcaatgccgacatttttgttatcaatcgaacatttaagcctatagaattttttgctaaactaagttttctgagttaaaggcaacaaacataaaaaattagttttgattataatcgaaaaaatgctaatttattttcacgttgtaattttttttctcaatgttagcatttactctttttttgaattaaaaattcccttgactttaagctttcgtttgatgccaagaataattaagttatggccgaagaaactgagtatggtcattgattggatgcgtaaactgcagtagagcgaaaaccaaatgccaagtttcattttggcatttgtgccaacatttatttgccaattggcattttaatccacgcaaaaaaaaatggcataactttttgcagttgcttttcttcgcctccacctcgttggcattggtcaaggtggttaagcggcagagtggaaatggtgccgccggcccagcagaggaaacgcatgtcggctttgagggcaatgatccgccgccgagcagcttaaatgagcccatctcagcgatcgggcctgatcagcaggtcaaattaaaatgattgaggaggacaaattttgtttctctttaatctgaaccaagggtgtgcgaatttctcggcattttcgttgcgccccatttttcggcacttttaatttttgtttcattttcgcatttaattgcgggattttttttggctcggtgccgacacttatataaaaaaatgggcaggtcaatgccacgaaaaatcgcaatgagcaaaccgaaatcattttttaaaatgtaattttttttatttggtaatctttgtgccaaaatcccatccctgtctatatccaaattaaaaaaatgagaattttcttcgattttaggccgaggacggaaagggtctcgccgacattgcctacgacacggtggaggaacagtcgcagtcatcggcggcgtccagtagttgggcgacttctccgtccagtaccagtgccgctgcgactgttggcacagtgtcgccgggcattggcgacgctgaaagtgccgccgagactcgactgcaggacaccgccgcgtcagagggcacaccatcggcaacgactgaggaggcgtcgccggtcggagtggaggaagagaacaatgacaacaacaacaattcgcctagcagcagcgacagcggcgacgctgccgccaccgcgtcaacagttgccgaggaagggcagcgactggaggagaccgtggcgaccgccacgacagcgagcagtacagcacgacgaatcgcggctgtggcatcagccgggaagaagcaggacgagcgcaaggggcgcaagaagaccgggctgccaaccgcagcggtggagaccgcggcgaccgatggcacggcgacaacaccggcgacggcacaacaacagcagcagcgcaactgcaactcggaacgccttcggcaactgatcatcgaggtagggaaggcatttggacagccaaataatttaataatttagtttttatgaagtaaattagggttggtcatttaaaaggtgtactaattactagttcgcaagtcttacgagtagtcatagtctaatgggtcagtatcgtttcgattctcagagttattcccgaccttgaatctaagggatgatttactaattgccaaatttagaacatccattcaaagccatccgtggccaagcgccaaattcagtccaaagtggccgaggagatcaacggaaagattgacgtaatatgcgcacgacatgcgttcagttacattgtcaattcaggtcataaaatttttccattaattaattagttgattccataattatttttaaaaattaattatcattaacaaattaattgcatcattagataatttgccatttttgaatagaattgttttgtgaggccgaacataacggagtgatctgcttgtgcttcaaacaacagtgatcaatgatcagccgatgaaaaaacaaacgatcaaagaaatttgataaaattgaatgacactaaatttaatttatgataaaatcacattggataccaaataattttcaaggcctttttata

SEQ ID NO: 64642 - DNA, 947 bp, Heterodera glycines
  Genomic contig location: Contig_ID=SeqID_7374; Location=2475..3421; Strand=-
  SCN-specific regions: Sequence locations=1-11,33-247,277-465,528 -755,779-803,825-915,939-947
atggctaattttaagactttaatctattgttttcagtttttgaatgcttcacacagcggcgggattggcctaatccaaacaatttgccagcacattgatgaaaaaacgtcaccgatcacttcggcggagtgcgaacgtttcgacaccaatctcttttcatccaccatatccatggcaattgaactgactggccaggatgtcatgtgtgagctgatcgccgggccttggttattattatttaattcataaataaactaaaatataataaaataaaatcatattttagcccgcgtgcaaacacaactgtttccaattctggcccaatcagttgcgccttctgtcacctgcttcacaaaaaggcgttaagcgtaagtgattttaacaatttcaatgagtttatgttgatcccatatatattaggccaatatccagtggaaatgagggaccttgacttctctaaatgggaaattattttttaaagaaaaaatgataattatgaaatttttgtttaaattcttaattaaattgtgttaattttttccctagtagtgctgactggatttccggactccatttccatttttttcatttggttcattattcacttcaatttatgaacattccagattattaacagctttgtacggttgtttgagggatttaatatgatgtgtgaccgactctccgatgaaaagaatgcgtgccggctttacgtgaagcaaatgacgctgaaaatgggctatatcatggacctacaccttgaggagcaaaatgcccgagtatactgtaaatatgttttcaattgtgtatgatcgagactggtgtcctctaatttctgcaaatgttttatgttccttggccttttgattgatgcaaaaattatttcaaaaaaatttaaatcccaaaaaatgtcactttttgtattatttattaataatcttaataaa

SEQ ID NO: 64643 - DNA, 582 bp, Heterodera glycines
  Genomic contig location: Contig_ID=SeqID_7375; Location=50..631; Strand=-
  SCN-specific regions: Sequence locations=1-1,25-196,218-262,288 -327,349-582
cttaccatgccatacttgctgcggacgcaatcaaactggccaaccctgctggtggcaactcgaacattgtggccaatctgaaaagggccagagcgggatttaagcaagcaattgacatcattgacacggttctcggagtcgcgtaggttttaaaaaatttttcaattttttctattaggttttttttgaatatagcaaattttaaaataaaaatttaggagattttgttatacaattttacttttgaccgaaaatttgtatgaaaatggatttaaaatagaaaataatgaactttccatcgaaacaaaaattttcaaatttttttttgaaagatctttaaaaataatttcagcattttttttacagaatatttaatgaaaaattgataatcggaaaatttttcgaaaattatttaaattattgttttactaactttaaggtcgaaaaaacggccagagaccgttgctgtggcacgcaaaaccccaacagcacttttgagaaccgatgattcggttgcgcaaattgttggaacattgggcccgtgcttctgcaaaggctcctctttcatcatccattctgtca

SEQ ID NO: 64644 - DNA, 853 bp, Heterodera glycines
  Genomic contig location: Contig_ID=SeqID_7375; Location=1120..1972; Strand=+
  SCN-specific regions: Sequence locations=1-44,77-81,103-501,536 -538,560-579,607-703,742-853
atggcgaaaaaaggtagccaaaaattttgggtaagaccttcccaatttatgtttctcttaaaaaattgaaaaatattacgaatgaatgaatgatgaattgaataaatgtgaacattgtaaagcttagaaacgattggaaaagcaattattaaaggtcatttgggcaacgagagtaattttatgattatcccccaaagaaaagcaccaaaaaggtcattcattattcgagaaatgtaaattttatcagatgaaaaggcaagaattatagcattttagagggagaaagagaaaggccaaaaaagtgcaaaattgctaaaacaaaccttggcgaaaaatgccaaaatgtgctaaaaactaaaaaattgctaaatctacttcaaaaagtgctaaatcatatggtgctatgcgaaaaattcaagaaaaacgaactaaaacaagtcttttttttttctaaaatgcttaaattgagctccaaagatgttctactgcttataatcccactaaaaaagaatttaaattttaatataaatttaaagcgtaaatttatgatatcaaaatttttcagtgtctaaaaattcgtaataaatttatttattaatattttatgtgatctttttttaaatttcattatgatatgttcgcgcactcatatcaaaaaatttcttttcattttcattcattttcaatttctgatttttttttaaatccaaaaaatacaaaaatatggaaattaaaaggcatcctagaagcaccaaaccaagctaaaaatactatttacattatatttaggccgaagtacttataaatgtgcaaaaaaatatatggaaacatacaaatccaggccctataaaaa

SEQ ID NO: 64645 - DNA, 413 bp, Heterodera glycines
  Genomic contig location: Contig_ID=SeqID_34963; Location=372..784; Strand=+
  SCN-specific regions: Sequence locations=1-240,276-413
atggacaattttttattgagctcaattcaaacatgtccattttgtatggttgccaccaccgtacgtccgagagcagcacacactgtacaaggtgctatgtcattacttaaaaaccatcataatgggcgttacttaaaaaaccatcataatgaaaatttttgcttataactttgctctaaaaagaccaaatttttaatccttgctatcattcgatagatctaaatgttctttatgagcctgtaaaatttcaaaaaattttattaagtttaaaaaaagttatggccaaaaatgttcgaaaatcaaggttttttgagttcctcgagctataacttttttgaaacttaacgaaattttttgaaattttgcagactgatagagaacacttagggctatcaaatgatatcaagaattaa

SEQ ID NO: 64646 - DNA, 433 bp, Heterodera glycines
  Genomic contig location: Contig_ID=SeqID_34965; Location=252..684; Strand=-
  SCN-specific regions: Sequence locations=1-433
atggcattgctagtatcacgtgccactgtgttgtttgcttcatcgtacaccgtgtttgcctaccgtagcacttcgtccttttacaaaatgtacagtaacaattttgttgggtcattaccgtaatctttgcgacaaatgatgcaatgtctgaaaatgaatgttcaaattattttagatttgaatattgtgcgagttttttaataaaaaaatgtttttgtagcgtgtacaactgccaaccatggtctactgtaggcgatgaagagtgcggtaaggtgtacggtatcgccaccgaagaggaccacccaatgagagggccagggcgtgtgtttctgctcaccatgctttcctctggcgctgttcagctgctctcatgcagttctgatctggcacaaccgttccaactgatcgccacgacaaaccatttcccatacaa

SEQ ID NO: 64647 - DNA, 531 bp, Heterodera glycines
  Genomic contig location: Contig_ID=SeqID_34967; Location=128..658; Strand=+
  SCN-specific regions: Sequence locations=1-54,119-210,266-285,308 -421,443-508,530-531
atgcgagatgattttcgccaattgccttcctctaatggactcgtcgaggcactttccgcctcctcctcttcgtccgcttcctcctcctcttcgtccgcttcctcctcctcttccgcctgttgctgtgcggagaatcgtctctttctatgctcaccgcagcagcggggactgacttttccgtccccaattcgcccctccggcgaatgttcatcttcctcctcatcatccgcttcctcttccgcttcatcttcctcctcctcttcctttgctttgtcttccgtcaccccccgtcgtccttttttctttcacaaagtggcaaagacaattgtggcggaagatgaggacgaagttcaacagcaggggacggagaatatgtggaagacaaatccgatgataaagcgaaggacgagcaaaaacagtgccaagggaaagggaaacaaaggggaggaggaaaattgccaacggaggacggacccgaaaaaggcaattgaagctgcggacgccgtctcacggatgggttttctaaactga

SEQ ID NO: 64648 - DNA, 117 bp, Heterodera glycines
  Genomic contig location: Contig_ID=SeqID_34969; Location=526..642; Strand=+
  SCN-specific regions: Sequence locations=1-26,48-117
atgcagaatttttttctctatcgctatgcaaaatttggtatgaatttaacaagcagaaaaaaagttaaacaggatgaagtaaatgttgttctttacattattaagaatgaagagata

SEQ ID NO: 64649 - DNA, 828 bp, Heterodera glycines
  Genomic contig location: Contig_ID=SeqID_34970; Location=74..901; Strand=+
  SCN-specific regions: Sequence locations=1-192,216-358,380-686,708-828
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgatttttt

SEQ ID NO: 64650 - DNA, 2039 bp, Heterodera glycines
  Genomic contig location: Contig_ID=SeqID_7376; Location=1..2039; Strand=-
  SCN-specific regions: Sequence locations=1-262,291-856,878-1050,1072 -1157,1180-1389,1411-1493,1516-1977,1999-2039
  Gene Ontology: Mol. function=pantotheine-phosphate adenylyltransferase activity; Cellular component=intracellular; Biological process=coenzyme A biosynthesis
ccctccattgacattggtctgcttgtcctgcgcggaaatgaggaattaatacggcaaaaattgaaacgccttttggcaataacaatgccaaaagtacgtcaaaagttgtacgtgcatttggagcaaatggacgtcatccgggcacttcttcccgccatttacattaatgcggcatccattgcgccgaaaattgatctccgagtccttctgaaccgaacgaccagcgtcccagttgaccgggttttctatgacgaggtttttgatttttttgtataattaatttaattttagtttgtaaatttatgcttgaaaagatttggcacatattcaatgccattgaaaatttgctgttttcaggtcaaagacccaagccatccgatttttccgatgcttcgcgaagagaatgggccaactttcaagatggattcttttgccacctcccatcacaaacttccggaaaagccgtatgaccatgtcgtgttgggcgggacgttcgaccgattgcacaacgggcacaaattgctgctctccgaggcggcaatgacggcacggacaagaatcacttgcggagtgacggacggaaaaatgaatgaaagtacggccttcttgcccatgtcgaattgtgcaatctcagaaatttaaaatacatttatgttgggcttggaaagttgaccaaaaacagaatgtttaagtgtcctgctagcgctcttttttcgggaaaaccgcagaaaagcaatccaaccggaaaagtaatgaatttcggctttttaaatttgaattctaaaaaattccagaaaaaattctttacgaactgatggagccggtcgaaactcgttgccgctccgtcaccgaattcattggcgacatttccgaaggcatcgaatgccaaacagtgcccatttatgatgcgtatggtccggccattgttggtgaccattaccaagcgattgttgtcagtgaggagacactgaagggcggcgaggcggtcaatgcgaagagaatggtgcaatttaatggcggtttctcccatgttttcgatcccttacaaaaaatgggtatttggaatttttgcaccaaattcaaaaattccaatttaaatttgttgagcaaaccagcggacattacaatgttttccattttcaattccaccccttttcaggagaatggcttcaaaaagttggacatttgtctggtggagttgttgaagaatgcggaagcggacaaggtgctgaacgagacgaagctcagctcgagtttgaagcgcaaggaaatgctcggcactttgctggctgagccgggccctccaaaggcggccatttccaatgcgcattacgtaatcggactgaccggaggcattgcatccggcaaaacgcacattgccacctttttggcggagaagggctgcgaggtgggcaaacatattttcctaatggcctttgctaaaacacagacaatctttaaaaatcagaccgtttttttctctcaaatcccaaccccctcgagttttttaaaattagattttcggagttgcgagacatggctttttaacgtttttctgcaccttccccaagcaaaaattttaaaaaatgcaacaacatccaattgaaccaatttttatttgttttttttctgcgagttaaaccgttcaaaaaagtttcaagcattaaattattagttgaaatgttagactattaaaaggttatcgaatgcgatacgcttgtccatcagttgtacaagaacaacatggaattgagggagaaattgtccaaagtgtttggggacgaaattgtgaaaaacggtgacatcgacagggacaaattggccaccattgtgttcggggacaaggcgagtaatctagataattggatgatttttgcggaaatggggtatttttcgtaaaaaaaatcatgacttgttttttgttgttgtttttttgcctagatacttttttccttttcgcaacaaatccggcaaagaaaatttaatgcattttatttacagcttttcaaacaaaaacaaattttcggtttttttatgaa

SEQ ID NO: 64651 - DNA, 984 bp, Heterodera glycines
  Genomic contig location: Contig_ID=SeqID_7377; Location=3408..4391; Strand=+
  SCN-specific regions: Sequence locations=1-398,420-699,784-910,932-984
atggtcggcggactgttccacaacttgcgccacaacctccaattctttgtcaagaatttggtgagacagtgccaaaaagaaaaataaatcccacataccgtatccatttgggtttactgtattttttgaaagggatgtctcaatcatgggtgggatgttctattaaagaaaactgtatcttaattaccatatgtcttcccgaaggcgatctgtcaaaatgttctccaatgctgccatgagactgacgtggaacggtgcgtttcgtgcctttccacgtgcattttccccgacaaaacgccgtacccaattgacgagacaatggcacgtgaacaatgaacatttatttatcttaataaattttatcgatcatatggttttatcgtattcctaaattacgactcccttttctctaaaataaagtccctcttttgaggggaattgaaaataaagcaccggggctatatttctggtcaaaaaaagggaaaacagagataaaagtcaaattttagagggtctcaaagaaaagcgtgatttttcaggtacataacggaccgccgcatgacagcaattttggctattcgtacgccaaacgaatgatcggtgagttgcaatgatcagctaaataaattcaaatttccaataaacaaacagatgtactcaaccgcggatatgctcaggagcacaatcgaaagtatcgagaaaaaataaatattttatttttgattaaataattttaaactttctctctccctctctctctctctctctccccgatctctctctaataattaatgcgtcgagattgccgacatttttgaacgagtgttccaaaggtacacttcggcagtgccgtgcaatgtatttggaccgcgtgacaattacaatttggagaacggtaagagaaaacgcaatggacagaagagcacagacaaatctttacggagagggaaaaactgggcaatgcacgaaaatatgaaaataata

SEQ ID NO: 64652 - DNA, 669 bp, Heterodera glycines
  Genomic contig location: Contig_ID=SeqID_34975; Location=114..782; Strand=+
  SCN-specific regions: Sequence locations=1-112,163-186,210-313,338-669
atggaaagttcgactgaggaaaaaatttcacccaaatttcttcaatttataccaaaatcgccaattattggtgggtgatcttacacaaaataatttaatacattaatagagcatttttttcattaaaaaagataaataaatattaaagtttaatgataatttggtcaatttaaattaaatcttcgcttttgaaaattattttaatttttgacggacttttatcttctaaaagtcgttatccattgtaataaataatccgtatttgcgtagttgaacagccaccttcatacgctactgtaacacagtatcagcgccagcaacagcaacaacagcagcccaattataataactaccaatcgtatcctgtccaaccacctcaacactgttatggatgttacgatggtgctggacggtacggaggaaacggtaataaactctcaattatcattactattttttataggagggtataatggaaatggaggatataatagtaatagtggacaaggtcagctaaacagtaaaaattaacagtgttcggtggaaatggaggatactattatggacaaggtcatcttctaattgccaacataaataacaagtactttaggaggatacggcgtggggtacggtgggaacggaggatacggtaactaacaaaaccacata

SEQ ID NO: 64653 - DNA, 802 bp, Heterodera glycines
  Genomic contig location: Contig_ID=SeqID_34976; Location=143..944; Strand=+
  SCN-specific regions: Sequence locations=1-90,127-178,200-317,339 -735,757-802
atgcgcggcggcattctcagcaaagcgttgcgccgctacgccgccgacggacacttaaaaggcgacgatgtgccaaagtgaggaggagacttttaaaaattgaaaatttgattttttaatatatttgtggcgattcgaatcggattttctttaatggcaaagtttttccttgccgatttcttgagtcaataaaggagtttcctttatgactagtgaatgatcatatgggttttgccaatgttttatgaactgaatgcaaagtcaaaattcaaaatttgataatttcgttacaaatttttggcgaaaagttgtttgttgattttgacaaaaatttgagaaaatttatcatttttttgtagaatgagtggagataattttgaatctgctgaatttaagtatttttaaagaaaaaaatcagtttgaagattttttaaagttttcatttatttttcactttttttttttggcatttttgagggtttttagcacaaataaaccccaactaaaatcgggcacaaaatatttttcctgctgttaaattgggcatcgcgatatataatttgaaacttttgaatttgaaatttgtctccaattgattctaatgaatacagtaagcgtcgtgtaagcgttgtggacagttcggacgacgactatcgctacggtattttgggcaagtcgctgcgccaattcaacgatggcgggaaactgtatttgcatgacaaccatcgacggaatgacacggaaacgagcagcagcagcgctgaagggacgatgacagtgcaaaatgcaattggcagaaagg

SEQ ID NO: 64654 - DNA, 581 bp, Heterodera glycines
  Genomic contig location: Contig_ID=SeqID_34981; Location=948..1528; Strand=-
  SCN-specific regions: Sequence locations=1-242,290-295,331-343,385-581
atggccaaaatgttctttttatcacctcggtcattgtggatcgacgcgaagtatccatttcgaaaaacgccgacacgagaagcgctcgtgccaagatcgatgccaattgcatgtgaatttcgcggcattattttatgcgaattagaaatttggtaaatcttaaatccggtttattttttaccgtttgttggtaaaaattatattggtttgattattttttggctctattgaagggagtcaacaaataaattattaaaaaattttatttgaagaaatttgaaaaatttctgatttttgacacaaaaatatgattttttaatttcaaatttctgcttactaaatttttctgtctattttttctttaataaaggattgtccttcaaatttgtgcattaaaaatatttttgttagtctttaattaactctcgctcccgcccgggactcccgtaaaatttcagcgggattttaacgggattcccgatcacgctcccggaaattttttttaacggactctatcaaaaaggaaaaaaatatttggcaactctaacaaaaaattcgaaatcgtaattctgcaaaataaa

SEQ ID NO: 64655 - DNA, 451 bp, Heterodera glycines
  Genomic contig location: Contig_ID=SeqID_7378; Location=151..601; Strand=+
  SCN-specific regions: Sequence locations=1-451
atgcaaacaatcgctgaaattaaaaatttcgagattattgaaggcggaagagtttttattgtgagagtgagaattgagaacgtagtacatgtggagtacagggtttgtattaaaaatgaaaaaaatatcagttttttaatgcttgcgttttatgccgtaagggggtgtgttcatgtggcgttgagaaggcactgacaccttatttgaaggtgtctgtggcagatgatactgggattttggaaaatgtggcattttttggtgtacgtgggaagaaaaacggaatggtaatgttttaaagaaaaaataccattctaatttaaattcaggaggagttgagaggattgtctggggccgtgtgcaccatgaaaatcggcgcgagagtgaaagaaatcggagggaagaaggggatctattactctttgattgatattgtcagcctttaaatctataa

SEQ ID NO: 64656 - DNA, 1644 bp, Heterodera glycines
  Genomic contig location: Contig_ID=SeqID_7378; Location=1788..3431; Strand=+
  SCN-specific regions: Sequence locations=1-95,117-397,419-543,575 -598,621-1118,1140-1261,1284-1367,1410-1517,1539-1644
atgaattctgaaaaatcagaaaaagctaataccattttggtggaagctgcaaaaaaagagacagaaagagcctggagggatgtagcggcgttagcagaagaagttggcgattttgccaaatcttctcgggaaacgcttaatcgtgcaataaaatctagggaaaaagctccgtatgctaatggtgttcgggaattatatcttaaaatgtcagattcaatttgggaaattttcaaaatcatggaccaaatcaatttggagtcagaaaaagccgaatctgcgtggcgtgagttcgagagatgcaaaacatttgaccaggcaacaaagttcgaggaacaatcgcaaaattcattaattgaagcccgaagattacattttgagtcccggagggtgcagagccaaatgttaaattatgaaaatagactccaaacaattgttttgggagcatatgggtatataagaaccaaaaaaaactaaaaggggcgcactcaaaaggtgtttgataatcgattcattttgtcatgaggacttaaaatttggatttacaaaatataaatctaaattttattttaaaaatcctttcataattaatgcagagcaaaattttaaaaatatcctcgcatcaataatcgaaaaaatttataaaaatgaacagggaaaattcaaaagcattctgaagctttcctttggttttgaatcattttattgccctcttagatgccctagcgaaaacacagccgaggctttgttccgacaagtcttattaaaagaagaactatattcgcttttctatcctttggacgatatcataacactagaagtaactataatcccagatgtccacaatagaccaagaaattgaatttattaagaaaaatgttacgaaaaattggaaatttgccggaaaaatacttaaacgatcaaataatcttgaaatctttgcaaataaacttttcaaaggggtgaaaactttctacataacagcatttagtgcacctggaatggaaaatttatatttttcattcttagaaatgctcgaaaaaattcaaaaattacctaaacttattatgcatgagtatggaaaccaagcattagctatgcaaaaattagaaattggactcaaagaaataaatatatttaaatgtcaagaagcagagaatttaacatgtttgaggcacaaaaaagaagttgcgttatgggtaataggaaaaaaagaatttgcgttatgggtaatatgatgatgaaaaaaacgttataaaaaagagaatagtgtaaaaaattttcattataaatgctgagactaatcagaataaagtatcacaaaaaatgacatctttgagcatatctcatcatgctgcgcatcccaatggtttttattttatattatttttataaaaattcaataaattaaaggtatttggacaaaatctttcgaaccaattaatccaaaccatgagttcccaacagtaaaatacttcgaagtcaagcttgtgggacacgggtgattatttttacgttaattttttatgatttaatattagcacatatggaatcggcttttcaacgcgaaagtacggatccggtgaattcgttggatggaacgacgactcgatcggttatgattccatgggagatataattggttaa

SEQ ID NO: 64657 - DNA, 808 bp, Heterodera glycines
  Genomic contig location: Contig_ID=SeqID_7379; Location=287..1094; Strand=-
  SCN-specific regions: Sequence locations=1-199,278-427,535-808
atgatcaatctgtcttttaagttggcagtacaaattgatgaaggaaatccagacagcagaattgcaccggatgagcacggtcgctatttgatcagcaaagttcatgccgtctatgtacaccaaaataatagagagattattttctttcattttatggcatgttttttatctattgaatttcttattaatcaaagttatgaattaaaaatatattttgagaattaatcaattataaaataaattataaatgttttaatgaaaataattttataataaaccatatcttttattctgtctactctcgcccctgaagcgcctggggtcgcttcgttgtcacaacgaaatgacccttggagtttcagggtgaaatcgggttcaccctgggttcatatctgaaccttgggcgcccatcaccctcatgtctctcttatatttaaataaattaataatataattaaaaattttgtatatgtaaatttattcaaaaatcaacaaataatttattcataatttaataaaaaattgtaaaaatatggaaatcctaggttggcccggatttgaagagtgggtgcaatccgaggattgcgaaaacatggaacaaagtaaccaattcacagaattggttacagttgaagcaatcttcgacctaatgttaaagcgaccaattgcgcaccatatggctaagatcgtcgaaacctgtccgaaatatgtccaaggtagatacaaatcgggacgaaaaccattaaaatgattgtgtttcaaattctttagttcgtcaaaaatatgggctcaaaaccacaaaaataaa

SEQ ID NO: 64658 - DNA, 1160 bp, Heterodera glycines
  Genomic contig location: Contig_ID=SeqID_7379; Location=1960..3119; Strand=-
  SCN-specific regions: Sequence locations=1-194,221-285,311-409,432 -836,858-961,983-1041,1109-1160
atgtctggacaaggaaacggaggaaagggacgcggaaaaggaggggcaaaaggttaccgtaaagtgagtaaaaaataatttgcaaaaaataataactatcgaaatttaattagtttttaccaagccacttcatttaaaactatttatgagaaaattattttaaatttgacaaattttctagggtaactaatacttttaaataaaatttaattgattaaatgtgaagtttttgttaagtttttccaaatgggacattgttaactattcttattttagaccaatcttgacaacatccaaggcatcaccaaacaggtcatccgtcgtttggcacgctgtggggggctaaaacgcattcccggcctgaactacagagaaattccggtatcaaaaaatggacgaagggattttcatttgtttaacaaaaatgaaaatttttgacagtatctggtattattatttttaactcaattttccggtaaaaaaatcattttgagtcaatttttttagggtaattcatttttggtattttttgctttcattttttctaaattctttggtagaaatgtaagatttttcggtactaattaatttgagttcgctttttcagacagtccatggcaacatccgatgcatcaccaatccgattcgttacgaagccgtcaatggcatctccggggcgatcaacgatcaaattcagccagacgatcccgttttcggaacggtgaaatttctcgggtttctttcagaatctttgtaaaaatagatataatgattataataattagagctcaatttttgagagccttttttcggctcattagtttcaatatattagcaagtaaaatcacatttttccaattggcttgagccttcaacattgacttttattatgttttttttccttttttttgcgtgtttcgtgcctttttggcattttgccgtttttggtctctttttcaggtaataattaaaaaatttaaaagtacaccccgtattaaatgaaatttttttaaagattggaaatttcattttttttccttgataaaaaattatgtttaaatttttccttattcaaaaatcattataaaatttttataatcatttaaatgagcaattttgattaagtttacatgttttgttccctaaaaattcttaataaa

SEQ ID NO: 64659 - DNA, 633 bp, Heterodera glycines
  Genomic contig location: Contig_ID=SeqID_34982; Location=1..633; Strand=+
  SCN-specific regions: Sequence locations=1-181,224-546,571-633
atttcctttcagtttgggttcacacacaccaaaaccggcttaatgtttttcctttgtgacggctcttactgtttgaccgccactctgtggggcgttctgttggaccgatggaattgcaacaattttctgatgtttttcggctcatccgccaccattgtttcattggttctgtttggagttgttgaaaagtatgtttttccatttcctcttaatcaaaattactccaattttcacttcccattttcactgattaggcgtctcgaatggatttgcatttccttggccattcttggcattgcctccggcgccctttacatcccctcgtttcagcagtgtttggacgttgtcaagtcatttgtctcatttaaaatgttgttcttccgaaactaaactcttttcaggaagaggggttacgacgattcatttcaaacgtacggatgcgtttccggacttattcaatcctcctacgcattggggtgactaaataaatttctggtttcattatacctctgacaatgtgtttttcctttgtttagtggttttatgggtccgactgtcctcggcggttggggctgtcaaaagtttggcctacgttcgatcgtgttatccatcgtggtcatcaatctcattttt

SEQ ID NO: 64660 - DNA, 618 bp, Heterodera glycines
  Genomic contig location: Contig_ID=SeqID_34983; Location=24..641; Strand=-
  SCN-specific regions: Sequence locations=1-618
atggaaaatcgcaaccttcagtgcccctcaaaattttccattgattatattctgtccattcctgcaaaaaagccacgtcatggtgttcaagcgggagctggaacgtcatcggctaaatctgcaaaggatttcgtcaaaaagttggaaaacagtgtggagcatgtgccacggttccaatacgtcaaggccaaatctaagttcagcatcgaggacgtcccaacgaatccagaagggctgcttgcaggcatttttcaattctgcattgatgaggccattacggatagtcaagagcgtggaatcaaaccaacccatattggatgtttgatcagcagccctctgttgaccggcggtgacatacccacccccattcgtcaaatcactaacaacacggtggacaccatccttaatcaattcaataaagtggcgcaaagcaaacagcagcaaaatgtgaccctctggggcgagccgttcacagttactgtgaccaccgttgaccgaactggacttcccgacaaaagaagtctgaaaggtggcgcccggcgcagtctggcatctgtacatcaccgtatcaatgatcggtgtttgatcaaagttcgctccaaagaatgtcaattttga

SEQ ID NO: 64661 - DNA, 604 bp, Heterodera glycines
  Genomic contig location: Contig_ID=SeqID_34987; Location=98..701; Strand=-
  SCN-specific regions: Sequence locations=1-168,190-534
cacaaaaatttcgtcttgcggatttttgtccggcaacaaatcccaaagtaccggcccagctgatccgttgtgtttacgcgattgaatctgatgagaaaaatggcattgctgtgtatgagcatgagaagcctgcttggtgggcaaattgtccttattttatgtccttaaatttttgtactgcaaattttgtagcgcaaaattcctaaattagagacttctccaggactgcaaaactgcttagcatcgccccttaaaaaatgttttttttttaagaaaatgggttaattttcaaaaaaaaattttgctaatatttcaaaattatcatgccgacacattttttttatcttcttaaatttaagtacaattccagtatttgaggatattaaggttgatacttgatcttttaggtctgatccgacaattttggcaatgttcgatgattttgaaaaattacggtcagctactgttttgaagggacttcatgcaaggacacttacgggatttatcaaatcatttttgcaggaattgaaggtgaaattttattattattatttttaatttcaattgtttttaaattatgaatgaaattaattactaaaataaa

SEQ ID NO: 64662 - DNA, 1203 bp, Heterodera glycines
  Genomic contig location: Contig_ID=SeqID_7381; Location=381..1583; Strand=+
  SCN-specific regions: Sequence locations=1-115,156-294,351-1108,1130 -1203
atgtcggaggaagagccctgtgaaaacaatgtaattgaattcattttttattcggtggacacaaaattatgacataattccatcaaatttcggtatttcgaataagaaaaaaaggaaattaaaattatcaaaattagaaaatataattaaaaatagacaaaatcacaaaattttgattggttgtaattttcgtagaccgaaaaaagttttattttactcggagttatttatgcccctgttttagaccacccaaacgttaacacgatcttggtttggcaaattcaatgtatagcgattaaattcaaaaaattaaaatattttaattttagaaaactaattttacaaaaattgaaatgccaaatttgccggaaattccgctgatcaattttcgaataatcctaatgggcaaggaagaagtgattaatgggccaaaatcactaaaggattgatttagcccctaacagctttagttggttttttttttattagactcagtttttctcatattttgagtctccaaaagaaaaattttttgcttatgaccataaatttttgtctaaatattattttactttcgaaatcattcaatgtcaaaaacactaggcatggacggagttcaatcactcatttcccaatacccaaatttttacggccataaaaaatttctcggaaagtcacagtaattgcccgaattcacctggcacaacaccatgtcctggttgagctgtcgccgcacatggctcacatagttgtacatcagcggcagcgtaatgaacgccgccaccaccgaggccagcgagaaggtcagcgcggaataggcgacaaatttgtacgccttcacttgcgtgtcgtaattcataatgtgtggcaccggttgttttataataatcaatggattagcccgcctttgaagggataattaaggataattaatcgccttttacgctcattaataatgtcccatgatggaagcttcaatatggtaatgacccattaaaaaaggaggatttttttttattcccaaccagtggacggacggctgctttaattgaaaattacagtaatcgatgatacagtatttcaagggcaaatattgtaacggtaaatgaaaaagaaataacaaaaatgtcccaaataatgattataagattttgagaaagattaaagaaattattgagaaaattaaatttattgataagatta

SEQ ID NO: 64663 - DNA, 1152 bp, Heterodera glycines
  Genomic contig location: Contig_ID=SeqID_7381; Location=88..1239; Strand=-
  SCN-specific regions: Sequence locations=1-509,566-704,745-1152
  Gene Ontology: Mol. function=structural constituent of cuticle; Cellular component=extracellular; Biological process=cuticle biosynthesis (sensu Nematoda)
atgaattacgacacgcaagtgaaggcgtacaaatttgtcgcctattccgcgctgaccttctcgctggcctcggtggtggcggcgttcattacgctgccgctgatgtacaactatgtgagccatgtgcggcgacagctcaaccaggacatggtgttgtgccaggtgaattcgggcaattactgtgactttccgagaaattttttatggccgtaaaaatttgggtattgggaaatgagtgattgaactccgtccatgcctagtgtttttgacattgaatgatttcgaaagtaaaataatatttagacaaaaatttatggtcataagcaaaaaatttttcttttggagactcaaaatatgagaaaaactgagtctaataaaaaaaaaaccaactaaagctgttaggggctaaatcaatcctttagtgattttggcccattaatcacttcttccttgcccattaggattattcgaaaattgatcagcggaatttccggcaaatttggcatttcaatttttgtaaaattagttttctaaaattaaaatattttaattttttgaatttaatcgctatacattgaatttgccaaaccaagatcgtgttaacgtttgggtggtctaaaacaggggcataaataactccgagtaaaataaaacttttttcggtctacgaaaattacaaccaatcaaaattttgtgattttgtctatttttaattatattttctaattttgataattttaatttcctttttttcttattcgaaataccgaaatttgatggaattatgtcataattttgtgtccaccgaataaaaaatgaattcaattacattgttttcacagggctcttcctccgacatctttcgcgaggttgaggtgctgaaaaatgcaccattcgtcgcgcacggaaaccgaacggcgcgccaggccggctacgaagcgcatgcagcaggcgcgccttctggcgccggcccctctggctcgtcggtgggccgtgccggaggcgcaaacgtggctggtggcggtggcgcgtgcaaaccatgctgcgtgccgggacctccgggccctcagggacggccaggacgacatggaaagcccggcaagccgggcgcgcccggagtgcctggcgccgccggcgctggaccggcaattt

SEQ ID NO: 64664 - DNA, 832 bp, Heterodera glycines
  Genomic contig location: Contig_ID=SeqID_7383; Location=324..1155; Strand=-
  SCN-specific regions: Sequence locations=1-394,448-578,604-832
atgcgccccttccaagtgccttacttggaaaacgtggtcagcgagttgggcatctacggctccatcatcgcggatagttccaacggcaaagtgttgtggaattcggccgaaggctacttgtcccgaagcaaggtaatattaattggtcattaaatgacagtgtaaattgggcaggctattatgatacggtagcggaaggaggaatactgtaatattttaccagaacgaaaaggcgtctattgtagtatttaacaactgtataagtattctttaattaattgcttataattctctctttttattaaacaattaattaaaattggcccatagaagcattgattttgaccacagagtccctaagtgggctgttttttaagggctagccaattttgtgaaaattttattttttacagtaattgttattaaaagatttaaaaattttaaaatgtgattatttttggcaaaactgcgaaaaatttaacttacttttccactggtgcctttcggcaccgccggccaccgcgccgcaaaactttatgaaaagcaaaaaaaaaaaaaaaattcgtaaaaccgttgacacaaaaaattttaatttatttgattgaaaactcgaaattcaagccttttgccctgaattaaaaaaaactgagaaccctgggttagactaatgagtaaatttcggctagggaagaatacggtaggactaagttttgtaatttcaattgctcaatttaagccggccaacttgaaccagggcggtgtttgcgaagggtccggcgttgttgactcggtgcttctgttccccgacaacgaatttgtcggcaccaactga

SEQ ID NO: 64665 - DNA, 139 bp, Heterodera glycines
  Genomic contig location: Contig_ID=SeqID_7383; Location=1..139; Strand=-
  SCN-specific regions: Sequence locations=1-67,95-139
aagaacattttgttttgtgccacatttgtatgccattctccgccattgattagaaattttgattttcttaaaaaatatatttttttaaatttttggtgaattgttaccaccacttttcgttttggcattttgctgatct

SEQ ID NO: 64666 - DNA, 321 bp, Heterodera glycines
  Genomic contig location: Contig_ID=SeqID_34998; Location=281..601; Strand=-
  SCN-specific regions: Sequence locations=1-321
atgtcagcaacaataacactcactgatcaccaacaacgccatgccaatcagccgccaactggtgccaacaatttaagtgccattaccatcagcaacgatgccgtgttccggccaccgatcattgttgagcatcgtcgtggcacgactacgaccaacgcatcaactatggtgccaagaccgaaaagtgccgacggagaagcagctaatgacgacgatggaattgcacgtccaatgccaatccgaccaatgcacggcgccaccaacagtaacagactgttggaagaattggttcgtgaaataatttatggctgcattttatga

SEQ ID NO: 64667 - DNA, 712 bp, Heterodera glycines
  misc_feature (653)..(653): n is a, c, g, or t
  Genomic contig location: Contig_ID=SeqID_35001; Location=260..971; Strand=+
  SCN-specific regions: Sequence locations=1-300,322-335,358-439,476 -487,524-675,697-712
atgactgagttgccccatttggtgatggatttgcacgttcgactgccgaacagcttcaaatgtccggacgcatgttttattttgtccggctttgtcgacgctttgtcgttccgcgaattgtttccgcattgtgccaccgacgaatttatgcgccgggcagagaatgccaaaatcaaaacaataggacacagatcaaagcaacaaagtgccacgtccgacgatagtgatgacgaacaaggacaaatggacaacccatgggtcggctttttggtcgaaaacccaaacggaaccaaattcgagctgaaattgcactactcaccttcgaactatgacaaatggtcgaaaatggtgatccgacaattggccgacgacgaccatcagcaggcggcaaaagaattggacgaaaatgccgaaaattatgatgttagtagctaacccttttatttactttttgattttgttattgtattttcagaaatgcatttgcttttgcttttataaataaataaaaatcatgtatatgtacttctcaaaaacggaccaatgataaaatgaatttaaatcaaaatttgatttgtgaaatgaccgaaaagtaaattagcaaaattatggacaaaaactggcgaaatcttgttcaattttaaatagcgaanatatatttttctaattgatacaaaaagaaaaataattttccttatttttttattcccaa

SEQ ID NO: 64668 - DNA, 4227 bp, Heterodera glycines
  Genomic contig location: Contig_ID=SeqID_7384; Location=4044..8270; Strand=+
  SCN-specific regions: Sequence locations=1-924,949-1516,1538 -1566,1588-1969,1991-2253,2283-2675,2697-2937,2959-3538,3568 -3705,3727-4003,4046-4227
atgccaaattctcctcctccatctaaacgtccccgccgcttttttattgaagagttgctccgtgagccattcaatcagctttcgccaccgcgcaaatcaccaaaagattacgtaaaactgctcaactccgaaactgagcttgtcccaaaatttcaatggctgaaaaataagtcgaactttatcatcgagaatgtgcctgctgatccagaagcccttctaattggaatatttcaagaatgcatggatgaggcaatgaacgaaagccgcgtgaaaggaattaaaccaacccatctgggctgcaccatttccagtcaactgctaacatcagacatttggatcccaattcggcagcttactcctgacaccatcaacacaattctaaaccgatttaacgacgttgcgcaaagcaaaaagcaggatggagtgacactttggggcgagccctttactgtgtcagtaactacagtcaaccggaatgggctgccagagaaaagacaattaaaagggggagcagcacgtaaactggcaccagtcaatcacaaaatacatcaacaatgccttattaaggtgtataatacttaggttttgttgaatataaattatttaagatagaaaatgctgataattactgcttgttttacgcgatgcaagcaacaatggtccgcacagttggtaccatgacacgtcaacatttttacgattatctgcatggaatcaagacaatgatagggaagctgcagagagaaacaacagaaatgatgaatgctgtaaatgctccgctcaacctcctcaattatgatgcagaaatttatgttccgcgaatcatcgattggtggaatgacgaaaaatttgcgaggcagtggaaattcaaggcgtttattttcggatcagcagggcattacaagccattgtttaaatatggggcggatgactacgatgtgtcaattctgctgtattttgatgagggacactttaacggtgtgcagaaaaatggcaatttgtttgggagaccgtattgtctgagctgtgaaaaaacttatgatcgtccaaagcagcacaccaaaagttgtaaagcccgctgcataaaatggtataaaaaaacgtaatagcaaataaaaattctctattttattagctcccaaatgggaccgctttttccttgtaaaccaatcgatggatttcgtcaaaaatgcagcgactgcaataaaatgttcttcaaccaagtctgctatcagcatcatctttccctaaacttttgtaaaacgagcaaggaatgcaaacattgcggtgtggtgtgggacttgaacaacaataccaaaaatggaagagaggtaggttttgttttttcatcaaattttttgctttaaggaattgttttttttaagggtcacaaatgcaacgaaagatggtgtgaaaattgtcaaatttttcatgaatttgagcgaggctgctttataagaccgcttgaaccgaaccacaagaaggaaacaatgggatggcgtctggttacttttgacttggaaacaacacaacacacgcctatcgacccggattttccggaaaaacggaagcatcaagtcaatttcgtgaccgcaaaagtcgcgtgtccggattgtatttcatcagggagatggaaagagagtttgcgtggcaaattctgcaacgtttgtggctatcaccgaacagtcacattcagccagatgccttttcatgagacaacagtcgacaaacaaaatattgaccgtcaccctttggttgcatttgtgaaatggatactttacaagctgccaaaacaatacgacactattgcttactcacattttggagggcgattcgacatggtcttggtctttcgagaattattattggaaggattcaacccttcaatgattaaaaagggaaatcgattgtttgagatgaaagcaagtttttttttattgattaacgtaaataatcgtgtatttgtaggtgaaaagcaggaaaaagatgaacccaaatgtgactttccgagactcgtggaacttaattcctgggccactggcatcgatggtcccaatgttcggtttggatgtgcaggacaagcccttttttcctcacctggcaaaccggcctgaaaattatggatgcaatctcttccctaccaaagctgactatttggcagacggaatgaacatcgcaaagagaaaagaattcgacaaatggtatcaagagaacagaaatgcaccctttctgcttgatgaatcattggccaggtaaaaaaagtaaaaatttttaaaataaaacacattttagctactgcaaaaatgatgtcgatattttgatggctggtttaattgctttccgctctgaatttttggagatgacaaaaagatccgccggggcagatggaaaagctgatcgggctgcatacaccaccccacacaacggaattgatccaatacggcactgtattactatcgcttcagcatgtatgcggcattttcggacaaaccacttgaaaccagcacacttggctctcgtaccagaaaagggatatgacagttgcggggataatcaaagcgatttggcactcaattttatggagtggtatgcggaaaagtttgatgttcaaattcaaaatgcatattcagccaatggcgaaaaaaggtagaatttgtcgaaaatacaaaaaaatgggcaccaattttaagggttggaaatttccgtcttgatggatggattgaatctcagcaaaaggggctcgagatccatgggtgcatttggcacgcatgttccaactgttatccggatgataacgaagtgctgccttgcggcaaaacagcagggcgaattcgcgagaaaaacaaacgacgaatggaaatcattttggaacaagtcccaaacgttgagattttttggcaatgcgagattgagacaatgttggcaaaggacaagcaaatgaggaaaaaattcgacgaatataccggtgacgggggaccaatcgatatccgggcatcattcatgggaggaagaactggggctctgaagctttttcacgaggcagcggaagggcagaaaatcagctattatgacgtcacaagcctctaccctttcataaagtctattaattttcgttttttccttatcaattttttcagttttacaacggattacccaattggtcatcccactcttcacgtcccgtgtgaagaagttgattggcgacggccagaggacaatccatacccattggccattctcaaagtgttcgtcattccgccccgaaaaattgatgtgccagttttgccggtcaaagttgatgatcgattatgttttccgctgtgcatgaaatgctgcaaaaagttccccaatggtgccgtaaagctgtcttacagttgcaactggatttgatgagacaatccggggcaatgtcgaggccgaggagcaatttatcgcggaatgcaacgaacaattcggaattcaaattgaccgtactaaaatggtcacgaacaaaggaaagagagccttggccaaacttgccgtcaacaatttatgtatcaattttcaattttattttttgcatattttaaatataggggggaggttctctcttcgaaactttggcctttcacaaactcatatcacggacgatccatctgagctcgccaattatcttgacaacaagaaaatcgaagttacggggcttgacatgctgacaccagacagaatattaatcagctaccaacagaaaaaggactggattaaggagcatccgtgctcaaatgtggtaatctcccttttcaccacttcggcagcccgattacacctactaaaagcaatgcaaaaagttgtgcgtacgcctggttgtgtccttttgtacaccggtaaaaaaatataattatccaacaaaaatcatattttattttaagataccgattcattgatttacgcccacccaattggcttgaaccctctcaagactggaccccatttgggtcaatttacagatgaatttccagaggtcaaatttttaaatttaattttttaattcaattttttatttttagcacgaaattttggaatttgtgagcggagggtcaaaacaatatgggttgaaacttcgtcgcaatgactctgaccaaattgaacacgttttgaagctcagagggatcacactaaactatgatgtaacagaaaatcagggacttcgctatgacacattcaaagatagtgttatcaaatttgccc

SEQ ID NO: 64669 - DNA, 335 bp, Heterodera glycines
  Genomic contig location: Contig_ID=SeqID_7384; Location=8476..8810; Strand=-
  SCN-specific regions: Sequence locations=1-335
atgggcgcaatgaatgcagtcaaagtgatgggtattcgttatggtagattatagtttgatcttcttttttctaatattttagaaattgtatcttctcttcactaattcttcacatttccagctaaaaatgacctcttctcaagcttagttttttccaaattgtatcttcttttaactcattttaaaattttcattttcaatttactaatatttcagaaattgtatcttctcttcactaattcttcccttttccagccaaaattgacctcttctcagtcttaatttttttcaaattgtgtcttcttttgaattatttaaaattttcaagcaataaa

SEQ ID NO: 64670 - DNA, 759 bp, Heterodera glycines
  Genomic contig location: Contig_ID=SeqID_35002; Location=100..858; Strand=-
  SCN-specific regions: Sequence locations=1-575,700-759
atgaagtcacagacaaggcaaagcaagaatttactggtccaaatttatgacacccatcttggcattttgcactatatgaaacagaattggcattgtgttggatggtttggcatgactcattgtgaagaataccgcaaatatttgggcattttgtaccaacatttttccgatatttatgctgagattccgaccaaaaagccatcttttaggacaaaaaatggtgaaattcgtctgacatttgtccaagttatggaaagattggcaaacatttttaaattttgtcacggctcgaaattggcggaagaaaatgcaaaagaatgggaagaaatgggcttaattctgccaaacgaggaggaaataaatgcttataaagcaaattcggaagacaaaacaaaaggaaaagggaagcaaaaggcaaaaatggaagagtcaccacaggcaaagtttgacgaaatgatggaaaataaatttaaaacgattgaacaaaatgcacagagaaatgccaacagtggtggaagaggggcacggggaaatcagtcgggatcatcttcattggcaagagcagatcagtcggaatcattaacatcgtcgccggcattatcttcattatcatcggcatcggcattttcaccgttattttcatcatcgccattatcaccaccacctgcttcgttatcagtatcctcatcaacagcagcaaatgccgaacacatttataatatcgttttgaacatgccaatacatagcatggctgacgcg

SEQ ID NO: 64671 - DNA, 870 bp, Heterodera glycines
  Genomic contig location: Contig_ID=SeqID_35003; Location=117..986; Strand=+
  SCN-specific regions: Sequence locations=1-84,106-345,383-407,429 -702,740-829,851-870
atggcgaacatcattagtggtaccaattttcaaaaaaggcgaaaaactgatccattaaattacagaccggtgtcattaaccagcactgtctgtagagtttttgaacgaattttaagtagcaaaattttagaatttctgaacggtataagattttttgataaaaaacaatcgggtttttaaaaaataggtcgactacaacccaaatattaaaaacaatggacgatataataattctctacaaaaggatcaacaaattgacattatctatattgattttgtcaaggcgtttgattctgtaccaattgatttattacttcaaaaaatcaaaaagattggaattgaaggaaaaatttataaatttttaactaactttttaaaaaatcggagttttaaggttaaaatcggcgaagtattgtcagaaagtttcagaatattttcaggagtgccccagggaagtgtcttagggccattactctttttaatttttataaatgatcagccgtccgttattacaaatgaagcggcatcagttggcataaaaaagtatgccgatgatgttaaattatattatgccaatgaaaatgatgaccattcgaatcagttggataaagcaattgaggctttggaaaatggtcaaaaataaatgggttagaaatttcaactgggaaatgttttgttctttatttagggaaaaataatatgaaaaaagattatttaattaactcaaaaaagatttcagaatcggataatgttcgtgacctaggcattataattgactcgaaactgcatttttcagaacatattaacaaaattgtacgaaacgcttatcttagagttttccagattttaagagtcttaaaaaccagggaa

SEQ ID NO: 64672 - DNA, 676 bp, Heterodera glycines
  Genomic contig location: Contig_ID=SeqID_35005; Location=530..1205; Strand=-
  SCN-specific regions: Sequence locations=1-330,392-410,549-676
  Gene Ontology: Mol. function=SH3-domain binding; Cellular component =lamellipodium; Biological process=behavior
tattgttcaaaataataacggctccctaaaaattcacggttttgacgaatcgacaaatggcagcgtcaacattgcggatattttccctgttgtgcctatcgcaaaacacacaaggatggatcttccgtcttcaagcggtaccgtggagttgttcgaccgaggattggcattctctgtacaggaacaatacggtctacaaacggctgcgacattgcgacaaaaggacaaccagtttctcacaacatcacatgccttcgcccccactgaaatttctgctgatgctctatttaaatctgtcgttgctgcggcaactgtgcaaccacaacaaaaatcaccaccatcatcatcattatcatcggcatccccacaacaacaacaacaacaacaacaatcaccatttttggcatcggcaccaccaccaccaccaccaccaccaccaccaccatcatcatcatcattatcattggcaccaccacaacaacaacaacaacaatcgccatttttggcattggcaccaccaccaccaccagctccgccaccaccaccacttccttcaccagcgcaggcttcgtactcatctgtttttttgatatcaccaggagatgaacaaatatcatcatttttggcatcggtaccaccaccggcccaacatcgtactctccgatttattgattga

SEQ ID NO: 64673 - DNA, 495 bp, Heterodera glycines
  Genomic contig location: Contig_ID=SeqID_7385; Location=392..886; Strand=+
  SCN-specific regions: Sequence locations=1-188,210-495
atggaaaaacatggagatattcgaggatcggaactttttcaaattcaagaacaaagatcgacaatgagtccgagaatggagaaagaaaccgaggcgccaaaaaccaagaaaactgaccttttcaaatattcacggtgccacaaaagaaaggttgggcccccgtgggcggaagggattaagctgggattgcagtggaagaaggacagccggtcgtactcgtgggaaccgtaaccgttcttcatttggagccacgcgttgtgctaaatggcaaaaccgcctaatttctgcagaatcgggcaaagcccggcctccatcacaaaatatatcagcaatctccgagacccgttcattgtttttttgaattttagtcttttttggcatcccaaatgcagtgatgttggagtcatggcatattgtacaaaaaaagtcttttggcaaatgcctgaacctgtaaaggcattctctggtcgaattaatagaaactctttaaaaaca

SEQ ID NO: 64674 - DNA, 1387 bp, Heterodera glycines
  Genomic contig location: Contig_ID=SeqID_7385; Location=914..2300; Strand=-
  SCN-specific regions: Sequence locations=1-343,365-601,632-645,667 -842,865-946,969-1387
atgggtaaattgcgtgccaaaatccaatttgaccaaaccattctcttcgtcttgttgttgtttttctgcattactgtatatcttcggcacacggtggccacatgcatcgaggaaagcagcagcagtggtggcacacagcccacaacactaccaccgttgactgtagattataccgtatgcaaaagaatggcgccagatttacgccaagcatgcataatgaggctgcaatggtggcaagaggcacggaaggtacggtagtggcacaaggggaaggttgggtgtgcaaagatgtctgatttgtttttgtttttatttttcaaaaaaaacaattatctttttctcgaaaaacaaaatttgaattgtttagctcccaggaacaaaaaagtaaaaaaaaaactatgggtatatattaattcgttttcacaaagtataaattatgtcgaaaataaaatgataaaatttttttgtatccttacaaaatatagagtttaaccttaaaactactacagtcgagaacgaaaagtgaaaatttaggcggaaagagaagggcgaattgtgccagcgaaggaattgccaccgccgtcacaagggcttggtccgcttatttatagattttatttattatttaatagcttttgttaattgttatttttcaagaaaaaatatgcgacagataagaaattaccattaaaggtttgccaacccatcggaaagcgactccggcagaaaaagcagcccaaccgccgccgtcggtggcctcggaacggtacggatgcttaaacaccagctgcttatgcaaatacatgaaaggcaagaaaattgagaaatctaatagaatttgcaaaaatattataattaaaaaaacattttaggaatactttttatttattgttcaaaacatgagaatttttttatgaaatttttgaaaccataaataaatttagagttttaacttgtttttagatcagtgcatctcgacggcaaaagcggcaactcaactgtttgagaccagcagaccaaaacgacagtcgggcgagccggataagagtttggcacggtgtaagcgaatggagtaccgtatgctcagcgatgatcagcgagagcgatttgtaagagcattgattttatataggctttagctaatgtattgccactgtacagctgcatggaaactgtttaaactcaaaagtaataaataggaaccgagttttatctggatcagagaccggaaaaaatttttatatagaaaaatagatacaggttaaacctgaaaaaatatcagtaaacgttacaggaggtacaggcaccaatgactaaatttctgtctgatttaaaatttgttcatgaagcgataaaaattgattgtttcaagtaatcaaaaattaaa

SEQ ID NO: 64675 - DNA, 1662 bp, Heterodera glycines
  misc_feature (1543)..(1543): n is a, c, g, or t
  misc_feature (1645)..(1645): n is a, c, g, or t
  Genomic contig location: Contig_ID=SeqID_7386; Location=6..1667; Strand=-
  SCN-specific regions: Sequence locations=1-360,427-478,501-613,635 -653,689-1018,1040-1210,1236-1567,1591-1609,1632-1662
atgaccgaaattcgcgacacaaattcaaaaactttgaaaagttcattgagagagtctcaaaccgagactctcgaatattcattcaccacccaaacagttgcgatgcatttggatgtgaagccacacaattttttgtacgtgccaactgttgatgtggagagcggtgagtctgaggaattgctgaaactgatcgattttgacggagccgaaccgatcccggggaaaattcggtggggattatggaggaaaaggttggcacattacaagcgggctgactaccgaagagtgcccaaaaatccgctgtactcaccgttgtattcgagcccagaaagttacagaagaaaggtgagcaaatacaggaaaattttaattttaaattaaaaaagtttaaaagattttgtattaaaattatatttttattttattccttaaaaaatttagtgctcttcaaaagcggacatgtggtcaatgggtgtaattacttatgaaatcatttttgtgagaatggtcaaaaaggagttccccgacgcaaacgaagaaactttacgggtaattgattagtttgttggataatttaagggggcggggatgttaatgataatgataatgatgcaaatgatactcattaagaacacgatcgttttaattctttcttttaataattatatttaataattttaatttttatcctttaaatctgattgaattttagttggcaattgctaagaaactctttgacattgtgcccgtttacagtggcaaatcgaccgatattaaagcaaaatggccaaagccaaagcgatttgtgtacgatttgcgttggctaacttcctctgtcaaaacagtgaaaagcattctccgaatttggttaaatttccctcggcttgccgttctcatcacagtcagtcaaataacaaactttcattaaaatgcgctttttaatattcttaaacaagcaaagtctgggtttgacaggaaacaaaaataaaaaaactgctgagctcggcattttaggagattgataaaaccaaaatttttcagaaatatattaagatttaaatgccacaaaaaccattttttgtaaactaaacttaaaattaatgaaaacttctaaaataatagcaactttaattatttatgtcattttttgaagacctttttaaaatttgccacaaatttatttcgattttagaagacctatgacaaaacctaaaaatttttaattttttttttttgaagaatttgttggatgttatgcctcaaagacggatgacagcggcgggcgttttggagtatttggccggcaaatgctacccggccgagctgttccgcacggactacgcacgggacggcacgattttcaacaaaatttcattcaacaaattgtcagatatggtcaacaaacagcagaagcagcaatgtgacagcgacaaatgcactcaaaaatgggtaaaaataagccaaatggtggcgaaagtggcagaaatgcgccaagaggggattgtgaacaaaagtcaagaaatgttggacaatggtgacttanaagaatgtgcaacacggcatggcgaaggtgggaaaaagggaaaagtgattagtcactcattgatcagtcaaaacaaacaaaaaccagatcagccaaatcaancattaagagcaaaatga

SEQ ID NO: 64676 - DNA, 1021 bp, Heterodera glycines
  Genomic contig location: Contig_ID=SeqID_35014; Location=6..1026; Strand=-
  SCN-specific regions: Sequence locations=1-55,77-208,230-820,843-1021
atggagtcgccgccaccaactccaggaccagtgccgacgcccgagatggacgaggaaattttggaatttggcttttcgctgccgtcgacatctgtcacaccaatcggcgatttggtgccgttttcgacaacaccaactgcgccaatggacaccggggaaatgacaccgccaccgctggtcatcgacgagcgatcaccgcgcatcgaacacttggagaagcagctcaaggaccaggaggacatcatcaagtttctgcgcgagcaggtgcgcaaccgtgatgcactgatcagtgatctgcgttgccagctggagcaatgcgcggtaccaccaacggcgccaccaacgacgagcaaaagtgagtgaaataaaatccccctttactctttttcgaaatcttaatctttttctaattttagcgactccaacaggacgaccaaagaaaaatgttgatcatttgcagtgcacctcacgccgcaaattggctaagtcctcaaacgtgcatcggaaatggaacatctctttgaatcgacatgaccaaagacaatttggcaagctcttatgcacttaggccaaatccaaaatttcacaaaagtacacatttttagcaaatcactcccaaatttataaatttaggctcaaccactttcgccaaatgacttggacgcatttgaacaccaaattgaggagttccgtgtttttctggcccaagaacaacggatgcgcgacttcctatctcagaaaccgaaggcccacttattgctcaatcatttcgtcccatttgctcggcaacactcttttctcggcttgctggacgagcagggtgggcagcaaaaattaattaactcaaattttcaaaaacattaggggatgaggcgctgcactcggtttggcgaagactggagcaatggtggaaatgcatgccggatgccgaccaaattctacaacaattcgagcaccattttgtcagcaattggcttctcgacaccggcataattgctgagatgaagcaggcgagttttga

SEQ ID NO: 64677 - DNA, 521 bp, Heterodera glycines
  Genomic contig location: Contig_ID=SeqID_35016; Location=165..685; Strand=+
  SCN-specific regions: Sequence locations=1-68,108-194,216-340,363 -468,516-521
atgaaggcacgccaattcgcgcattgcataagctttccatcagtgagtgataaatggattttaaagaattatttttaacaattccatttttcagttttatattgtttcaaaaaaagatttgccgatgattgggaagaaagaaattatgtttctttccaacaattctacaaaaggtattcaaaaataataaaatattgttgtgtatttattaattaattcgtaaatccgctacaagaatttttcaatgaaaatttgtaaaaaaaaacttctgaaaattctaggtaaaataatttgctaatttcatttatcgaagatgaaacaattcgctaacaaattttcatctttccggattatattttaaatttttggcgccatttaagttgaccaaattctcatcgatggaacgcacgaactgaccaacaaaaatgcatttaacactatgataatgaatttaatcccctttttaccatttaatttatttatattgtttcaatattaatattgatttaaattttgcataa

SEQ ID NO: 64678 - DNA, 794 bp, Heterodera glycines
  Genomic contig location: Contig_ID=SeqID_35018; Location=62..855; Strand=-
  SCN-specific regions: Sequence locations=1-118,140-144,166-410,432 -497,519-794
atgaagcgcatgggttacattattgtgacggcggttgacaaaggcgaaattttaaaagcggcaacattaaagggtaaacagacgtccaaaagcggcttatcatgaatttgctcttcggtttttgtattttcaaataaatttcagcttctgtcaaactttggtccatcattcaagcaataacaattgacgagaaccaatccgccgacccgcggtccgccgctcctcccattgactatacgtccctttgtgtccgctttcccctgcccgactcgctggacaatgccatgtccctgttttttgacgacacgcggcacaatcggacgaatgtgccggttgaggacgaactgtgcgtgtccaacccgttgttggagctgatcaaactgttgttggactcgtccctgaaaagccagaaaattttgatggatgctttgacacaaaatgggacccacgccaatgaaagtattcccattgattcgtccctggcccagcttctcaactctctttcgttggattccctcggcaacggcgttcgcggattgctcggcggactctctttggagccggagactcggaagattgccggtgcaaaggcactgatgttaccgtatgcattgaaacacggcacagaggaggaagaagcaaatgccgagaaatgggagctgaaattggcacaggtggagaagaggagagggattaagcagaacagcaagcaaatagattcacatttttcttttagttcctcgaccatttctattcgcctcacatcaaagcgaattggtaaattcttggattaa

SEQ ID NO: 64679 - DNA, 968 bp, Heterodera glycines
  Genomic contig location: Contig_ID=SeqID_943; Location=218..1185; Strand=-
  SCN-specific regions: Sequence locations=1-134,156-935,957-968
atgcctgttctccgaacgccaccactaacccggacgagggcactcaaccagggaatcattgttgaccgcgatggaaacgcatttagggctgaaaattttggagtttcggggggcaggccgatctcgcccttagcgaacaacgaaaatcagcgactggacgacaatcatgaaaatgttttagcagagactgagattcgtcgtcgcctgctttacggaggaatggaacaaagcgcacctgaggaacaattggagtacgacgaaatggaaaacggcgacgaacaaaatgtcaacggtatggtgcaacaaaatttcgaaaatggagttgaagctggggatagagggagttttggaaacgatgcattggacgcacatgggttgcgagcgttttcaacgccgcttaacgagcaaaatctaagcgctctgcagcgagacctaagaatgcaacttccggaaaatttgagcgtcatccaaaaccaaattagggttatgaatttcatgcaaaatcaaatgccaaacccagtcgcgcataatttccctgcattgaatcacccacaagcagtcaatccgattgcttgccgacccaatggtcagttgtacgaaaatgctgcggttaattttgagcggcagagagaacagcagataaggctcacacagcaaccggttgttgaggaccaacaatcacacgttcggcgaattcctccgccacatgcctatacacaaggacaccgtcggtcccaggacgaaggatttgagtttcaccaaggacagcaacacccaaatttcaaaaaaaacctacctataagagccaatcaacaaaatcgtcctgagtgcaatcagcaaccggtcccccaccctgggctggtattcgatggcatgatggcacaggccattcgaagcctcgacggtttttcatacacgatgacactcaacgcaattccgaacctggacggcacagaggttctgattcg

SEQ ID NO: 64680 - DNA, 3278 bp, Heterodera glycines
  Genomic contig location: Contig_ID=SeqID_943; Location=2209..5486; Strand=-
  SCN-specific regions: Sequence locations=1-489,511-982,1006-1177,1199- 1602,1624-1798,1820-2095,2117-2969,2991-3278
ttttgtgccaagctgacgagaacaaacgagtccgtccaaatttcttcgcatcacgtcaatgcagtaaacacgaaagtaattattgcccaacggagctggaagctcttgcagttcgatttggtgcctggaaattcgcacaatttattaccggaattccgaccaaaataatcaccgatcataaagcgcttccgccaatgtttcggagtaagaaacaaacaggaaactctcgagttgaccgctggttaatggaattgaacgcacgattcactctcactgtcgagtacagtcctgggaaatccaacattgttgctgatgttttatcacggtccggtgctttaataagtgaagtcactgagaattttgacacggattcagcttttgtctgtaaattaaaagagaatgaaggcgaaaagaatctggaagtggatgagatcggggaaaaagagagaatcgattgggtcgaagcgacaaaggtcagcgaattcagcgaaatatacaacttcttgcaaaaacgaattttgccagacgaaatccggaagaaacaaaaaattttggatacttttcataaattttccataatggatggattgctgtattttataccatcgaaacctgaaggaccaaaacttttcgtccccagcaaattcaggcaaacttttattgatcagcgtcattcaggaatttgttcgggccatttcagtggaaaaaaactttttcgtcaattgtcggaaaagtacttttggccaaatatgttcggcgactgcgttaaaacctgtctaagttgtagaatttgtgcacacagcagaaaaccccggtcaaatgaaccgccactccggataatccagacgtccgaaccgttggaacttgtctgtgtcgatattttatcgatcggaatgtccgaaaacggtaatcggtatgtgcttgtctcaatcgatcacttcacaaaatacatcgtcgcaaccccaatcccggacaaaagcaaagacacagtctcaaaagcatttgtaaaagagtttgtgttgctgttcggggcaccaaaaagattccatagtgaccaaggaaaggaattcgtcaacgaaactctaaaagaaatttccgccattctaggcgtcgaaaagaccacaactgctgggtacgacccacaagcaaatggagctgcggaacgggcaaatcaaactttgcttaatatgcttaaaaagtctacgtcctcgcactggagttgggatgaacgacttcctttcgttgtgttctcgtacaacactacaccgtctgaagtcactggattttcgccatttcaactgatgttcggaaaaattgcaaattttccaggggaaatagactttaaaaagtatggaaacccgttctacaccgtggacgaggaaacatatttacaagcatttaaagaaaatttgcagttaattctcgaatatgcgcgtaaaaatgccgaaatttcacgggcagaaacaaaaaatcggtacgattctcgcccaaatgtgaccgcaaacaaatttgcgattggcgacaaatgcatggtcatttatcccggatcgaaatcccgaatacagcacaaaaaactgcattggaatcagttcgggccgtacaaaattgttaaaatgttcgaatcgtccgcagacgttgtcccagttgataaaagttcagctgaaccgattaccgtcccaatagaacgtctcgtccgtgtaccagtcggagttcccgacatatcaacgctcccacacggaaaaaacccataccggaacattttggctactattttgcttgcaaatttagaaataatagttcaaaaaagagaacaaacagacgaaactccggtgtcgagtgaggaatggcaaaaaaagggaatcacaaaaaactcagcagaaaatttcgaccaaaatcagttagggacaactgacattttaggtgggcggaagatgcaacaagacgaaactgccgggcttatttggaccatgaagtgcgaaggcgaaagccacgaattctgtggaaaacttctgtgcgcggagttagacccggttttggacgcaaaaacggagcccggaaacgtggaaattggcactcctctgcaggccattttgtgccttttcatcctccgttccgttgccacagtctcttccgcggcggcaaaaagccttgttcatcttatacttggctctgaatccgggatggagttggtcgtttacgagggagtccgaaaagacaacattcgtgccggtgcccttccacgagaagaagacgtcgagaaaatttggtcaatgtggtgtgaaaagtgcgcggtgaccaaaaagcttctccaatcgtcaggatttgagaagattcgagtgcaaaattccgacggagagcccaaagaaaagcccgaaactattcaggtcgaaatgccggaagcggtgcccaaattgcccgaatcagagcgtgacggttggagcacattgttcgaacagaccgggtggattctggaaaaagtccgttccatcgccattcatcgtagccgcacactagttgagactccacgagttctgatcggtgactcaacggctttccaactctttcccgaaatgcgggcacaaacgcaatttgttggcacggaacgagggctgttaactgaagtgatccgtccacttagcgaatgcgtcttctcaagcaaagtgcgcgccgcaatgatcatcctcggtcgtgattcgctggtcaaagacgagaccgttgatcagatcatggaacagtgccaacggatccaacaactgtgttcccgttttccgtccgtttcgttcatttggctgcctccaccgtatgttcgtcagtacgatttggcctatcacgaaatgatcggccgtctttccgaactgctcggcgattggtttgttttcgtgactccgtttggtaggagtttgattgaaatctggcgttatggcgattcctttgatcggagtcgtgtcaatgcagatggatggatgactgaaaatggcattaaagcattgtcggcgtggatcagcacacaaattccgaaatggccaaacaacagacaacttgggattcgaacggtccgctccagtgtttcggtcactaggagagtctatgggttgggtctatgcgaccgcccggagactgcggcttcttcttcggctcgtggggggttgggtctatgcgaccgccgcccgaattctcgttctcgatcgccgtttagacgccgcgacaaccgccaatcgcaaccattcgttcgaggaggacaccgccgagatgatgtgacacgcgaccgccggcactag

SEQ ID NO: 64681 - DNA, 3721 bp, Heterodera glycines
  Genomic contig location: Contig_ID=SeqID_944; Location=7..3727; Strand=-
  SCN-specific regions: Sequence locations=1-134,156-1475,1497 -1624,1646-2475,2497-2620,2643-3519,3550-3582,3604-3721
atgcctgttctccgaacgccaccactaacccggacgagggcactcaaccagggaatcattgttgaccgcgatggaaacgcaattagggctgaaaattttggagtttcggggggcaggccgatctcgcccttagcgaacaacgaaaatcagcgactggacgacaatcatgaaaatgttttagcagagactgagattcgtcgtcgcctgctttacggaggaatggaacaaagcgcacctgaggaacaattggagtacgacgaaatggaaaacggcgacgaacaaaatgtcaacggtatggtgcaacaaaatttcgaaaatggagttgaagctggggatagagggagttttggaaacgatgcattggacgcacatgggttgcgagcgttttcaacgccgcttaacgagcaaaatctaagcgctctgcagcgagacctaagaatgcaacttccggaaaatttgagcgtcatacaaaaccaaattagggttatgaatttcatgcaaaatcaaatgccaaacccagtcgcgcataatttccctgcattgaatccgattgcttgccgacccaatggccagttgtacgaaaacgctgcggttaattttgagcgacagagagaacagcagataaggctcacacagcaaccggttgttgaggaccaacaatcacacgttcggcgaattcctccgccacatgcctatacacaaggacaccgccggtcccaggacgaaagatttgagtttcaccaaggacagcaacacccaaatttcaaaaaaaacctacctataagagccaatcaacaaaatcgtcttgagtgcaatcagcaaccggtcccccaccctgggctggtattcgatggcatgatggcacaggccattcgaagcctcgacggtttttcatacacgatgacactcaacgcaattccgaacctggacggcaacagaggttctgattcggtgaatgctttcttcaagcaatttgatgttgctacagaagagtggcccgaagataaacgattgcgagcgctacgctccaaatgttttggaaaggctgagagagctttcaattcagctgtggacgcaaaccgtcatgattatcagctcattaaaagagcgatcatccgacaactggacgacactgacgcaaaacaattgacgtcttttgaccaactgatgcgaggaattcggcgtcgaccgaacgagagtatcgatgagctgggaaacagaatctcgggattggttcgccgtgcttatccgggtctaaccgaacaacaatacgacgagtattcaatcatgcactttataagggccatgtctaaccctgagttagcgatcactcttgaaatgacgcgtagaccaggcgcaacatttgatgagtttatcgcgcaagccgcacgagctgaagcaactcagttagctgctagaagtgcactgcgacctaatcaacagtatcaacgcccaatgacaaactcaacgggtccagccaataattatgcaccaaataatcgctcaaataattggcccaaaccggagcttggctcaaatccgtcatatcgggttacatgctataactgcggccaaaatggccacgtctctcggaattgtacgactccaccaaaattttgttcctttcaagagaaccgaaatcaaatcgcaaaacaccaaggttcaggggctaacgctgcgcctttaaattggaataggcaagcccctaacaaaaatggacaacaattcccggcgtcaaggaatttcctccgtcataattacctcgttgagcaaaacaacgagccaccaaaacggaatgatttactggctggtgccgtgaatgccgaatacgggccgcaaattgaaagtttctttcaaaatgcagtgaacaagacaagtgatgtcgatggttctgatggaagccctcttgttggaaagataatcgttgcaaaagtctctgttttcgaacgacagtcggatgcaatgttggacgggggtgcgcaaatttcactgatttcagccgaattttttgcacaaatcatggacaaagtggacaaaaatgatattatttcccatttggaacgacgcattgttgacataaatggtaaagaagtgaaatgtttcggaatcgtttgtctgccaatcacgagaggaacacagacggcgcgagttcgcatgtttgttgctcaatcctcatttggttacgaccttctcttcggaaccaatgctttgaatcaattgggatttaaactgatcgacaaagtcaacatgaatgttgttgaattctccccgatggaaacacatgcaaattcggcacatataatctatcgagtcacacttctgcctcaatcatccacacttgtcgaattgtcaatggccaatggacaagaagacaaagaagtcactgtaataggaagaaatgatttggatgagcaactaagaattgagcctactttaacatcttgcaaaaacggacaaatcgctgtgccgatcacaaacttttcgtcaattccaattacactggaagcgaatgaaagtgtcgcattggtcgagcatgtcgatgaatggcacgaattggaacattcgtttttccctccgttcttcgtcagcagcgtcacacacgaaaatgaaaacatacgcactgaacaaatcaaagaaatcttacgaactcgtattggcatgtctcagcaacacgaagcggacaaattggaacgtttaataattggtttcgaacaaatttttgcactcgatgacagcgaactgacacaaactgaaataactcagcatttcattaacaccggcgatgcctcaccaattcgaggccggatgcgtccactgccatttgcacatcgtaaaaaagtttcgtcaatgctccaggactatttaagcagaggattaattcgaccatcaaaatcgccatgggcaagtcccattgtccttgtgccgaaacgtgatggaagcttaagattttgtgttgattatcgagggattaattcggtcacagtgaaagacgcatacccactgccgaacattgattacatccttctcgcactaggagaaaagaaatacttctcgactctcgacttcctttcgggctactggcaaatcagaatggacgaaaagtccgttgaaaagactgcgtttgttactgaattcgggttgcacgagtttaccgttcttccattcgggctttgtaatgccgttgcgacgtaccaacggttcatgtctcggctttttgaggatctgattaatgactttgttttcgtctacattgatgatattttggttgcatcagaatcgtttgaacagcatttggagcatttagaaattgtgttcgagcggataaaagattccgagctgaaattgaaaattgaaaaatgtcgtttttctgcctccgaattgccatttctgggacatgtgttaactcgccgtggtttgaaaatgaatgccgataaagtaaggcctgtcattgaactgcctttgccgtcgaccaaaaagcaattacattcatttcttgggttcatgacgtattatcggaaattcatctatggctttggagagattgctgcacctctgtttcacctcctaaaaaagaacacaccatttgttttgggagagaaggaaatattggtagtcgagaaattgaaagaaaaacttcttgaagatgcggttctctatttcccggacttcaaaagcgcaatgaatgatgctgaacgatgtttcatcatcctcaccgacgcga

SEQ ID NO: 64682 - DNA, 666 bp, Heterodera glycines
  Genomic contig location: Contig_ID=SeqID_7388; Location=824..1489; Strand=+
  SCN-specific regions: Sequence locations=1-298,320-548,582-666
atgtatcaacaaagggtctatctccactctctggcgaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattgtgagtgggaaatgtttgtgttcaaattgatccatcgttttttttaattttcagatttgcaaggggagagcagcaagacggacgaggacctgccgatgagcagtgttccctattttccgatggtgcccgactcaatgattgcggaggagcacatggaagagcggtccaaaaagttggagaaatggctgcggtcgatgctcaaagtgccggtcaatcgcgaataccacgaaatggtcaaaaagcaaccttatttttaattcttaatatcattcggtagctcagaatgtctttattaccctgccaatttcaaaaaaaattgttaacttttcgaaaagttatgactaaaaaatctggaaaacttgattttttaaaaatttattttgccagaacttttttgaaagttaacgagtttttttgaaattttacaggctaatagagaacacttagggctatcggctaaatatcaataa

SEQ ID NO: 64683 - DNA, 3690 bp, Heterodera glycines; identical to SEQ ID NO: 7389
  Genomic contig location: Contig_ID=SeqID_7389; Location=1..3690; Strand=+
  SCN-specific regions: Sequence locations=1-1623,1655-2368,2392 -2890,2921-3122,3144-3690
  Gene Ontology: Mol. function=phospholipase D activity; Cellular component=plasma membrane; Biological process=RAS protein signal transduction

SEQ ID NO: 64684 - DNA, 351 bp, Heterodera glycines
  Genomic contig location: Contig_ID=SeqID_35023; Location=478..828; Strand=+
  SCN-specific regions: Sequence locations=1-47,69-86,123-324,346-351
atgggtggaagaattcatattgttgatgaattcccagccaatctcaaacacgctgttgctgaggtggagtttatggacagattatgaatttttaaatataatttttacttttttaaaatttaggcttttagaaaatagctatagatacacatttaaaaaaacatttgatcagaaataatacctttttagctattttctgaaaatctgattgtgggttttaatgggggaaaaagccaaaattaacaatatcaccgaatcaatggtgctctcactaattgcacattggcaggataagaatttgtttccctcattccttcaaattagttaatttcttaggagttttttagccta

SEQ ID NO: 64685 - DNA, 648 bp, Heterodera glycines
  Genomic contig location: Contig_ID=SeqID_35024; Location=13..660; Strand=-
  SCN-specific regions: Sequence locations=1-404,431-472,503-648
gtgtgaagatgcgcaatgcttctcagtgcgttgcattgggacggacaattcgacgcttttccacacaaaaggatgtgttaacatggacaaattgtgggatgttaaactgccacttaaagaatttggattaaatgaatgccaatcgatgaatgggacggcagagcgcaatttttgcgatgggaacagatgcaatgggcacaatgaaaagcaaagcgtaagccatgcttttatgggtgaatgacaaatgagattttttgattgtttttggcattatagaatccatttttaaagttgcatgggatggcacggcattcactgattttagtgccattttaaaaaaatagaaatattccctatcccaacatttgagcccagtcgggccatgctaactgaaaaaagagttcaaaaaattttatgtaacaaaaattttcttatggaaagtgaaaatatgattagggaaaatgaaagtgagaaaataaaaatttagataattattaattttggttctttacgggcggcataattaacttaaatttcctttattagtcatctgaagcgacaaacgctcgaagtgctgaaaccaaatcccgtgtcattaccggtgccgaaactgttgccgtttcatacgacggcacgaaaaagaacacc

SEQ ID NO: 64686 - DNA, 116 bp, Heterodera glycines
  Genomic contig location: Contig_ID=SeqID_35025; Location=273..388; Strand=+
  SCN-specific regions: Sequence locations=1-51,74-116
gacgatgtgcctcgtgtggttgccagcatgtgattgggtgtgtgttaagcggtggtggttgtgctgctgctcgtcaagagacgagagtctccacaaagctgatccgagccgcataa

SEQ ID NO: 64687 - DNA, 1338 bp, Heterodera glycines
  misc_feature (32)..(32): n is a, c, g, or t
  Genomic contig location: Contig_ID=SeqID_35026; Location=1..1338; Strand=+
  SCN-specific regions: Sequence locations=1-508,534-780,821-1338
cagagttgacaaatttattcccatcgtttttnaaggtattgcgaactttgctttgcccgattcggtatcattcagcagatgaagtactttttgttgctgaatttattaagatttttgaaaatatgtccttcattggccgttagaggcagtaaaatttgattgaattttttaataatccacacaaaaatgggcattgccaaatccaatttccaaagtttcattgctcttttagggaattggacgatggcatcgccgaggcagtgagcagtttgttgtgggtggcgcctcgcattggacacgaaattgcggaattcaaggcatactttgggcaatggcaaaatcagaaaaacaatgccgtggtgtgaaaagcttttgtccaccctagaaacaaaatttggtgccaccaaaattactttcgtgtggtataaattggccgattccaatcctaaagaatttaatggaatttttccattttccctaaaaattccttaaacattatcacgcttacaattaactaaataattcaattaaaccaaactgaaaagcatcgtccaaatgtaggtgatcaacgacgaactgacccacaaatacggcaaacaattcgcggaggccgcccgtatgaaccaattgccggagccgagccgagtgtcgaccaaattggtgcagaaattgtccgtcagcgcaccgtccaaattgctcgtcgaaaagtttgtcaccatttatttggggggtgtgactttttttgacaatttctcggtaattgcttaaatatttttctaatcaatgccattttgtttgctttttaaattccaattttttctctaggtatttggtcactattgcgcaatcggcgggcgtcgatttcgcgccggacgccaaagtgatgcgtgaagacgacgacgaaattgcacgagcggaacgcaacttgatcaacttcatgaacgaggtgtggtgccattggggttgggtgggcaccgtttaatcagccatcgaattggcgggattctgcgtttattgttaatcagacacgaaaaccgcgcgcaaaaaatggcacttttgcacccttttttgattttgtgccttatccgaaaaacccgcttttccgagtcgtacagcgattggtccaccttttctacacgctttccccccccccctccgtttaggagcagtacgggtggactgtccgtcacaacgacgacccaaacagcaaaggcggcggcggagggcatttcgctgctgccgtcggtggcgccattggctccgccgatccgttgatgaaccagggcagcaacaacgccagtggcaatggtgctaatgcaatgcctatgccgccaaatg

SEQ ID NO: 64688 - DNA, 437 bp, Heterodera glycines
  Genomic contig location: Contig_ID=SeqID_35031; Location=590..1026; Strand=-
  SCN-specific regions: Sequence locations=1-437
aaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctaaaatcgcctttatacatcccattatgagcgctaaaattatcagagtgccgaaaatcgc

SEQ ID NO: 64689 - DNA, 1649 bp, Heterodera glycines
  Genomic contig location: Contig_ID=SeqID_7390; Location=1246..2894; Strand=-
  SCN-specific regions: Sequence locations=1-181,208-347,378-932,954 -1058,1080-1150,1172-1195,1223-1466,1490-1526,1548-1575,1597-1649
atggcactaaaaattccatttgaaggcaaaggaaattcagaaatgttggcctcgtgttccacgccaaagtcaagtcaggaggatttgctctgtcactttcgccttttagacgaaacttcggtgtattttcgacctaagcccagcgatgataaccaacagcaacggcatgggaataataaacagcgccaaaaacgggcaaaatgccaacagaaacagcagcaacttcaaattgacgattattttaacgcaatccgtcggccaaagcatttgcgcggagcgaaacggcacagcaaaacgacggagagggcatttttggacatggaatttgatcatttggggaaaaccgaaatggcattggaggaggaaaagcagcagcaaatggacgatgagaagtgcagctcgccaattctgttggactttcggaggaattccgccggaagcaatgaaacggaaagtgagtaaagaaagaaaagccatgggaaggattagggacaagtgatcgccgctgatcagtgattgatcatttgaccattatcacttaatgttttggtattagtgactttttgatcacttatataccattcttatcactgattattgaccaaatgatcagtgatcaatggtaattggtgctgatcattagggctccaatttttagttttttacctatttttttctgagctccctatggcctgaaacggacgaaaaacatgttttttcggttgttattgttaagctagttttcgagttgttagcaactattttctagttttttattgttcgcacctaaaaccctaaaaaaattttgaaaaaactatttcaactatttattgttttgctcaaaatttattaacaaaatgcaataaaaacgaataacacactcttaagaagcgacccaaaaaattttaaaagatatacccccccccctaagaaaagaaatgaaaaattttctcaaaaattcatctacaaaatttattcttttttttcttgtcaaatttttttgaatttaaaaattatgtatctcattactgatttagcttaattttgttgctttttggataaaattttatgattttacacccctaaatttgaaactttttggtacgtattttcccatttttagcacctaaaaattggagccatactgatcatttattcatttatattttttcataattctttctccatttcgagatttccttcctcctcctgcttctcctgcggttggcctcaattgccaaatgttttctcctcaacttttgcctcggccgagtgatccttcggctaataatttctcgccctcgggccgtcattacacggtgctgagacggataaggatgaagcacaaaatgaagagggatgcactgatgaagaggaaaagcgaaagttatggggacgaacaaagacaacagtacaccaatttaccaatggaaccaatcggagggagcaaaggaagtgatcagaatgagaaggaaggaagagaagaggacgacagcgggaggaaaaggaccaattgcaacagtgacagcggaatggaagagaaatgtgagtggggactgatcggaggaggaagacgaagtgatggagaggaaagaaattggggagggagggaccgtggactgatcagggaggatggaagttgggattga

SEQ ID NO: 64690 - DNA, 283 bp, Heterodera glycines
  Genomic contig location: Contig_ID=SeqID_7391; Location=139..421; Strand=-
  SCN-specific regions: Sequence locations=1-55,79-283
tctcgactttgtcccttccaatgcccattcttccgtgcccttattaatcgtcgtccttcctcgtgttcttcttcctccgctgctctgctgatgttcccctacagttccttctccaccgtgcgtccccactccatctcttcccaaagttcgtccactttctcctcccggaatttcacccaatcggacaccgaagcggaagaggagaagaagtttcagaagcgaatcgtccaccgaagagaagtgctgacaccgtcgagaatgaaatgggactgggacagaagag

SEQ ID NO: 64691 - DNA, 299 bp, Heterodera glycines
  Genomic contig location: Contig_ID=SeqID_35039; Location=188..486; Strand=-
  SCN-specific regions: Sequence locations=1-299
gaatgccaaaatatgtgcttcacccaatccaactgttcacatcactgaacaacaccgaaaatgtcgaaaatgcacagaactcgccgcgctttgcacgcgaccgctttcacgttcagtataacgctaccgcgcgcgcgttcgcaccactgtttgtactgctcgcgcatgtcgtgtacgcgtcgccaccaacggcacagcacgacaacgacagcgacgttgagtttggattggcacaggacgctgcgggagctgccgaacttgtggaaatggcaccagccacgggcatcattgtgccaagg

SEQ ID NO: 64692 - DNA, 57 bp, Heterodera glycines
  Genomic contig location: Contig_ID=SeqID_7394; Location=1281..1337; Strand=+
  SCN-specific regions: Sequence locations=1-57
atgaagccaacattcaacttcaacctttttgcatccgtctttcttgtgctttgtgtg

SEQ ID NO: 64693 - DNA, 400 bp, Heterodera glycines
  Genomic contig location: Contig_ID=SeqID_7395; Location=162..561; Strand=-
  SCN-specific regions: Sequence locations=1-121,146-400
atggacgtgtcttggggatctgggcttaaaaaagcccctgccgagggtaagggacggcatggagacgtaccgtaccaatcacattattaataattttatctcatttttttcacttttggtgattttttaaatttattattattatcccattaacaggaggaggaaggggcaaccaatctctcatcgatctctaactgtctgttctcttatgtctccttccttttcccatacactctctcgccatttctcgttttctcaattaaacaatccctcccctttggtgcctttctcatagatcgtgccgcgcaatttcaccttgcacacttggacacaatgcttctttgatgggaaattgtttgtgttgccgccctgccctttgtagatgaattgcttaaataaa

SEQ ID NO: 64694 - DNA, 162 bp, Heterodera glycines
  Genomic contig location: Contig_ID=SeqID_7395; Location=614..775; Strand=+
  SCN-specific regions: Sequence locations=1-162
agccatgaatgagccgtggaaagaaggtgcagcgtgaagagaccagcaaaagaagaaaagcgaagaaattcaaagaaatttttgaaaaataaaatttaccgctaatagttaaaatgattttggtggaataaacaaaaaatttgcgtctgtccaaataaaaaa

SEQ ID NO: 64695 - DNA, 720 bp, Heterodera glycines
  Genomic contig location: Contig_ID=SeqID_7395; Location=890..1609; Strand=-
  SCN-specific regions: Sequence locations=1-44,66-126,148-302,324 -393,449-604,640-720
atggcggatgcggacggaggaacagaacgccaatttaaacttggcatgcgccaaagcatttgcaaatcgttcggcgagagacgcggtgacaagacaacaaatggcattgaggtgttcggaatgaacatgttcaaggagatgatggagaagcgaagcggccagcagcagacgacgtccgcctgtgaaattctggtgggaaaattttgcggaccgccaattttacagaaaaatggcaccgaaaaaatgaaattttatgtccaccggtgccgaaattggaccgctagggagagaattattttgaatggtttatttttataacaaaaatgggaaattatttgattttggctaattatatatataaattgtttgcttttggctaattatatatctccgatttaaatgtattttttttaataattccttttttattattttattaatttatttagaattcattctccgactctttgctgccctctgctgaacgtagtgctgaattcgtcattgaaaaaattgacgacgagaaatttttcaatttcggtttgaaagcaaaggacgcatcattgtcaccatattttggattgttcagtgacggcgaagtgtgtattttaattaaaaatatttttttaatttaatattgatatttcacgaaaacgctatttttttatttagaaatattatgccgtggtgcgcaatgccaaacaaaaaatggatggctag

SEQ ID NO: 64696 - DNA, 1635 bp, Heterodera glycines
  Genomic contig location: Contig_ID=SeqID_7396; Location=1..1635; Strand=+
  SCN-specific regions: Sequence locations=1-135,159-509,538-967,992 -1000,1030-1050,1072-1635
tgcagacaaaggtggctttctgttcatatttcgtgtctgctgccggctgtcttttgcagtgtgggcaaattgcgcggattgcgcaattttttgtgccaattgttgtgtccacggattcgtcgttgctgccacctgtgctgttgttgttgttgttgttgccggattcgttggttgggggtccatgaattggacaacccaaaccaagcgcactgtagtcattcagtccattggtggcaaggtactgtaattcgaatttttaaagaaaatttcaagaaaaaattttgaaaattatttagcgatttttcatattttttgatgaaatacaaagtttttttcaataaatttctccaaaaaatcggcagaaaatttttcttcttgaaattttcttaaatttagaatttttttttttgagaaatttcggtttgaaattttttaatttttcggggaggggatgcaattcccctggtccccgaccaaataagtcaccctctaaatcttaaaaatgtttctttaaaaattaaaattaaacaaaattttctgtatttttcaaatgcttacgtgcgcgtcttgcttcactctgtcggccaattgtctatacgcttccgcagacaattgcgcgaaaactcttttttccctttctgtaatacagtacccgacgcacaaggagaaaatcaagcggcgcttcaaccgttccgaagttgtttacaactatgtgcagcgtccatgtacgttttctggacggtgtaaaaattatttttgaattgttgcacttttttatgggtgcatattttcatcatcctcaaaaagggaacttttatttttccaaaaaaaaagaaagaaaaatatgttattttcctgaatttctcgttgaaaaaatattttgattcaattttttgaattttcggtggaaaaaaaataaacaaattaattgcctcttaacacggagactgaacttgttaataaattatgattttttatttcccaaaaaagtgacgggtctgtatttttccccttaaattttacattttttacaattcgcttttttttaattgcccctcccctccctttgccactgtcagtcctccactgctcctgggagaaggaggaggcgcgttcccgccacgtggactttgcctgcccaattgtgaagagcaagtccaacccgagtttggcttccgccgcctccgaccctttgccgcaggtgccattttcagaggagacaatttttttgaaatatgtgccgttttcttacaattttcaaaaaagagtgatttatcgcttttaaaagtaaattcaacaaagcatttgagtgctttttaagcctgcgccgttgcaaaacaacatcaacaatgggtgggcggcggagaatggtgccggcgaacattcggccaatttccagcaacggccgacgaatgacaacgacgggagcagcggaaatgagaatgaggccggtcaccacccaccaccgccctactcctcctcacagcaccaccaccattcccaacaaccgttgttcctcaatgtcggctcggcaccacccaactacggtcacaacggcaacagtaacaacattggcacaacgccgcagcaactaccgtaccatttgatcaataatggggcaggcggcacacagac

SEQ ID NO: 64697 - DNA, 249 bp, Heterodera glycines
  Genomic contig location: Contig_ID=SeqID_7397; Location=2486..2734; Strand=-
  SCN-specific regions: Sequence locations=1-249
gcggtgatgggcgcttacaacgaaaacaatggcaccatcgaagtgccattacatggttacaacgtcggaaaggcgattgttgaaaggattttgaacacggaaaacgggacggtgcatttgcacggaatgcgcgaaccaatgtcactggcaaaggccgtcgaaattggcttttttgacaacctgtcgctgactgtggttgacccgaacaccacgcaaaggctgtttttggacgaagcattggaacggaaa

SEQ ID NO: 64698 - DNA, 188 bp, Heterodera glycines
  Genomic contig location: Contig_ID=SeqID_7397; Location=1..188; Strand=+
  SCN-specific regions: Sequence locations=1-188
tgcatttttaagcgtcaaccattgcgctctccgcccgcaatcgtgcagaattcggcagcggatgattgaggcttaatggtttctgatgatatttttcaatttccactctcttctgtctcattgtgttcctttgacgcatttattttctatgcattcgtaaattgaaacttgtcataaatgaagcaaaa

SEQ ID NO: 64699 - DNA, 132 bp, Heterodera glycines
  Genomic contig location: Contig_ID=SeqID_7397; Location=547..678; Strand=-
  SCN-specific regions: Sequence locations=1-91,114-132
gaaagtgaaagcgattaaacgaaaaacggagaaaagtgtggatgatcaatcttctgcttaatcttaatttcttaaacatttaacctgtacgtattttactttattattttttcgaaaagaaaattcatttta

SEQ ID NO: 64700 - DNA, 1346 bp, Heterodera glycines
  Genomic contig location: Contig_ID=SeqID_35042; Location=222..1567; Strand=+
  SCN-specific regions: Sequence locations=1-128,151-156,211-382,409 -985,1048-1162,1185-1185,1223-1237,1259-1346
atgaaatgtccattaatgtcgaatttcgatggaagagaagcggcgggtgagaagagcaaacaaacacttaacaaatcaaggaattctcagcaggaaaaagtttttgaaaaaaagataacgaaaaatattggataaattctgctaacaaaattcgtgaaaaattgttaataaattttgttaaaatattttttggaaaatatttttttataagagaacgaagtggattcatctactgctattgttgaagaatattattattctgaggaagaaaacgacaacaatcatcgccagcgaagcgatggaaaaaggcctttgttttgcgcaatattcggacaggtgtaataatacttttatatcttcgaattatccgtggtttctttatcaaaattttttccaaattttttaattctttccatataaagcgattaatcagacgtaaaaagtgcattaattaatcagtcactctgtcttaatttagccattaatctgtgtctatcattaattattaatttataatctctttaagttgcatcttcgtcctttccatggtctgtccctctcccaaatcgatcagtgcgcttttgctggcgctcgaccactcattgaccatccctttttcttggtccaaatcaccgcttccgatcttttggccaatgacagcaaaacaactgatcaaagcaatgaaacgaaattatttggcattacaaaagtcagttttaacgcataaaataaagaaacatttccaaatttgaaacgaatttattacttaatgaatttttacgctttttctccaattatcaaaacccaaaacaggtggcagtaattattcgaccaaaaaagggatgtgtaaacgaccgaaaggtttatttggcggaagcctccgctgatcagcaaaatgatgctcttcccgccacatttgcggatggatcttcagaaactggcgctattctttcagggaaaaggtcgtttttcaaacaaaaaatgcattaaaatattaaatttttattaattaaatttttaagtgtatttattatttttcatatttttgttccattttagagctgttgaaatcgtacgaagtacaaaagaaactgcaaagatcagtttgaatcatatcgacacgcaaatttcaatcatttccattggaaatcttttcttcaatgtttttgtccgtcttcgttctccaaaaatagaaaatgtaaaagtaaatgcacaattatatacagtaattaatagtaattaattccttttattgcaggcatttcagtcatcgctttgtgtccaaaattgtccggacggcgcaaaaatggacgaatattcggcatttttaaacagcaataaagaaa

SEQ ID NO: 64701 - DNA, 452 bp, Heterodera glycines
  Genomic contig location: Contig_ID=SeqID_35043; Location=589..1040; Strand=-
  SCN-specific regions: Sequence locations=1-125,147-182,204-355,378 -389,411-452
atgaatggagtgatagcgcataacgacacaatttgttggctctacgaattgctcgactcgccggtgagttttgtgagaggggcgccatcggaaaacactgatcagcccgggagaactctgatcagagtgagaaagtgattatgatcagagaacggaccaatgggttgaatttctgatcaaagtttggaaataataaggaatttattagcggattaatcagcaaaaggaggggggggggcaggcagaacacccccagtaaaataattgcatttttgcggtgaatgaatgataaagtaaaaatgtgacataaaaacggaaaatgttttcgccgcataaagggcaaaagaatggctgaattattattattgcatttttctcagattttcattgatttggccatcgattaaacaaataattaatgcttttgtgatattttccttttaataattaaa

SEQ ID NO: 64702 - DNA, 112 bp, Heterodera glycines
  Genomic contig location: Contig_ID=SeqID_35045; Location=1..112; Strand=+
  SCN-specific regions: Sequence locations=1-14,38-112
cttctgatgcgcgtgccattgttattgttgttgtggttttttcctccacttcttgcgacaacgccgaatttggctgcgtttcttgctgccgctgctgtttttccggttgttc

SEQ ID NO: 64703 - DNA, 350 bp, Heterodera glycines
  Genomic contig location: Contig_ID=SeqID_35046; Location=367..716; Strand=-
  SCN-specific regions: Sequence locations=1-203,225-238,260-350
atgggactgaagcgacggagcacaaatgagggcgaaacaattgcgcttctgacgctgggactgaaaaatgtgctgcaaaccttaccggacacggtccatcattacgatgatgaccattggcacggcacggactatggcacagtgaaaatgggagaggatgacggacgagagcaacaccaagaagaagccaatcaatacggggtaaaattttggtgaatttttaattattcaaattgattttacaatattttatttagaatggctatgccagcgggcatccgtgccaacatctgactgttaataggcatcaagagaaaaatgaagtgtcaaagcgtgtgcattggcattaa

SEQ ID NO: 64704 - DNA, 520 bp, Heterodera glycines
  Genomic contig location: Contig_ID=SeqID_35048; Location=190..709; Strand=-
  SCN-specific regions: Sequence locations=1-372,396-520
atggaccatgtgctcaaagtgcgcggactgacgctgaattatgatgtgatcaacaaccaagggatgcgctatgagaacttcaaagaggaggtggtccggtaggcgacaagtggtgaatacgagccaataatagtcacgtacccaaatttccttcgacctaacatcagggagggaggccgagtcgtttccatgcctatgcaaaagtgctatcgtccgtttgtgggaaagggcataataggcgctgatttcaatgtgctgaattttggacacacaccgtaatttattgtacattgtctctctctctctctctcacacacacacacatgactattcttttgtacctacgtgtacattttataccattttattcgtttttaataaaaattaatgcataattaaagaattgaagataaagttttaaaataattaagcattataagaagtcaattttaggttgaaaaatgcacaattaagcaagcgaagatgcaatctatattgaaaatgaggaatggaaaataaa

SEQ ID NO: 64705 - DNA, 266 bp, Heterodera glycines
  Genomic contig location: Contig_ID=SeqID_35053; Location=1..266; Strand=+
  SCN-specific regions: Sequence locations=1-120,142-266
taaacagttcgaacccggaggacattgagtcacttaaacaagcattgaaaggagcactttacgaacaagaggaggagggacagtcggaccatttcaaggcggccatctgatgacagagggaaaaatggcaaaataaattaagacggttaattaacaatgggtagatcattaacataatatatcttttggttattttggcacatttcactatgaacatgtcaatttttaaaaaggacggacaataaagttaaacagcaacattgaaa

SEQ ID NO: 64706 - DNA, 585 bp, Heterodera glycines
  Genomic contig location: Contig_ID=SeqID_35054; Location=289..873; Strand=+
  SCN-specific regions: Sequence locations=1-472,494-585
atggctcaaaggaaatgcaaaattgtcaattccgatgaaaaagctttgccaaatccacaaaatccgttgccgaacaaagtcatcggattcagtggcattcagatcatgtaaaaaaaattcaatttttaatgattggtaccaatcacactttcttatgttttcagcttcatcgaccaaaatgtgctcattttccttcgccgttttgactgttttttcgcctcttgtgcaacaaaattggcaattcgcactgaaaatattcgtatttcggagttccttctgctcagaatttggccaatgttcaaagacaccacttatctgttgtgtttctaccctatcgcttttcgtctaatccgtcaattggcctcgtccattctcaacgaatttccatcccttcgcattgttgctttccaaggcgccattttccccgcttttccgcctgatgacagtgccaatgcgttggatggccaagcggtggccaaatggctgtttactcctcatcccagcaatttgatgaaggcgttgtatgtcacaattgagaactcatcggttgaccaattgttggcaacatttgaacaaatcaaagcg

SEQ ID NO: 64707 - DNA, 984 bp, Heterodera glycines
  Genomic contig location: Contig_ID=SeqID_35056; Location=211..1194; Strand=-
  SCN-specific regions: Sequence locations=1-121,148-234,257-340,362 -443,468-483,505-583,606-743,766-919,941-984
atgaagtaaacgttttggcagttcggtacttcgtcaatcagtacgaacgggcaaaacgtgctaacaactggtacaatgagaaagttgtggaaattgcaaacgtcatagagtaaatttatgcaattatattaaaaataattttttaaacccctagcagtttgaacaaaagaaatagaagttttagttggcttaaagagaaaaaattgttttatttagcttaaagagttttaaattaaaacctttttgaaacagtttgggatttctacgatgactttatatgattttggaaaaatccttaacaaaactgaaataaaaaacgaaaaatacacccctagctttttatttgaaaattattcttattcgaaaaaactaaattataataatttcatttacgattgaaatataaaaaaattaatcttcttgattctttatgggttttgctgtaaaatatttaataattttatttacaactgaagtataaacttttgttaattttttatgagttttactactaaaaataggcaattaaaaatttatttgacgaatcagttgcatttttttaacaaattgaattgtaagataagtattttaaaacaataatatttgatattcaaattagcataaattttttagagagtggcataatgaaaacagcagccaagtcttggaaaatttaatggagatactgcaagaaaggattgaaggttttggtgacccggacctattcaagaatgccgccatactgaaaaattgggcctttttaaagagtgactccgcaatcacagttggtaaggttgtttgaaatataaataattttagtggttttgttttaaaatatttttaggcaacaatttatttgttttttcctcatcaggtcgtccagcaacatttgcgaatggctttccgacgttccaatcattctttttgatttttgatccatttttcaccgattcggtgcgttattatctgcacgttatgttttaa

SEQ ID NO: 64708 - DNA, 666 bp, Heterodera glycines
  Genomic contig location: Contig_ID=SeqID_35058; Location=81..746; Strand=+
  SCN-specific regions: Sequence locations=1-199,221-343,375-392,414-666
  Gene Ontology: Mol. function=GTP cyclohydrolase I activity; Cellular component=cytoplasm; Biological process=neurotransmitter metabolism
tgcaagaacgactgaccaagcaaatgctttcagcaattctccaagctgtgcacccgacgggcgtcggagttgtgattgaagcgaggtgaacatatatatttacattatataacgggctttggggaagggcacacaaaattcaagacggcatttgtttgctttttctattcaaaagcaattctcgaactcaattggctatacaaaaccaaaaaccatatttttacgctttaaaattgagccaggtttaattcatgtgagatttatagatttttttacaaaaaattttccaagtgtagacttatgcaatgctttagtatgatatgaaagttgaaaattgaggtgctttttaaaaattaaaaatgtaatttttatttgcacaaattatgtcgctattatttttcttggggaaatttatagcttttttggttactcaaatttggatatatattatattgtttgtatgaattcccattcttcagccacatgtgcatggtgatgaggggcgtgcagaagatcaatgccaccaccaccacctcgtgtatgatgggcgtttttcggtaattttttttttcaaaaattcagaaaatttattgttttagtacccccttatttttcagcgatgatccgaagacgcgcgaggagtttctcactctgatcaaaaaatga

SEQ ID NO: 64709 - DNA, 2967 bp, Heterodera glycines
  Genomic contig location: Contig_ID=SeqID_7400; Location=78..3044; Strand=-
  SCN-specific regions: Sequence locations=1-146,250-303,340-691,738 -786,843-867,890-1068,1109-1128,1163-1352,1395-1395,1418-1572,1623 -1773,1816-1872,1894-2107,2136-2241,2263-2357,2407-2705,2727-2967
atgccaaccgtgttggattaccacgggttggacatgttgcttgagcgcgaatttgcgccctgcgttggtccgatgtcggcacaacaaaatgacgacgatgccgccgccattgtgcaaccgaagcgtaaaggcatgaaaaggtaaagaaaaaatttttaatttttgaaaataaatgaaatattttatcaatgactttttaataattttattgaaaaatttttgaaaaaaaataaaaataaattaatttttgatggaaatagttttcgatgtgcgagcggacgagttttttcatacagacaaaacaataattttttttactattttttgaaaatttaaaatgaataccgtatttttggcgcatttctcccaatcgatttactgttattttttggcaatttgtatccgtttttttcaagaattttttaatactcttaaaattacccgtaattataacttcatttaatttccgctccctttttgaggccatacgacgaatttatcggggacgaatcggctgtcggaatggtcaagtcgccgtcatttgctgaacaaatgcagcacacggcgccccccaacctgaacgacttctgcatggaacactacggctttgacgagcagtacattcgcgctcagccggacagagtctacgacattttgtttgtttttggacatttttcccaaatttcaacccaaaaattaaatttattagataattttttatttttttctataaaattggtgtgaatgatgactacattatttggaatcagcttgcccccccccccgaattttttaaaaatttttttactaaaaattttcaaagaaattataataattattttctaacgatattttgaaattgtgtgatttttggaacagttttgaaaaaataattgttaattgattcaaaataatattttgagaaatcgcaaaaaaaaaaaaattctttagattttcctataaaaaagttttctgtttttttttgaaaatttctgtgaaattttaattttcgaaagcgaaggtggttgtgtgctgaacccatatcaccccaatttaaaaatgaggaacaatttaaagaaattaaaaaaaaaaaaattattttttaattgccagtgcgttctctgatatatgtgtttttgccatttttccctcagattccattcgtccggtcgcgttgagttgcaactgtcgcgcaatttctagtgccaccattttgtccattccatgcccgcccgaggaggagcacaactggggcatggtccgccagtaccgtatgaccacccagaaccgggagggcgacacactgtactttcgctgttcgcgctgcgagtcgctgatgcgttacacaaatgtaataaataattgaatattttatttattttttaaaaattataccatttttagactttaaaaacagcctcttttaggaaaaaatgaaatggtcctttcaaattatatgaaattataagaaaaaaaaattgagaaatttttatagtgcttttttcaaaattttatgatgcaccccaaaaggttgtcgccgtaacatcgccgagacataatgaatgtcgcggcaaaaaaaaaataaaaatttcaaggaaaatttaaaaatttttttatttattcccttttgcaggatgaatatcggccaaagttgacgatgaaggacggtgatatccaaggcgattgcttcccggctcatcacccgcaatgctacccggtgaaaaaggtaaagagagagagagagagcattacgaatcagtaaaattaaaacagttaaattttttgttatttagaaaaaaaaaaatttttttttttgatcaaattgttgtttaatttctttaaatttggctattttctttcaaagaaagacttcaaaccccgaaaaattaaattcaaacattttttggggttactagcaaaaacccctttaagaaatgctgatcaaaaaattcagttagttttttttttaaaataaagaggaaaataattgcttcccattctttgaattggccatgttttgctttaggaatgggtgattctgcaacagttggaccgccaggcacgcctttacatgatgcagtttgacatggcacaatgggaggccatgcgccagcaacaacagcagcagccggcggaggacaacgacggcaccgcagcggcggaattcgacgcgtacagtggcaggtaaaagcagacactcgggcgacgatcatatttcgggtgcactacgttcttaccccctaaaattttttttttaaatttcaagccaaaattttctttttttcaaaaatcctaagcaaattttttaattaagttatgagaaaatttattaactcatgcaaatttgaaaaaagcgcaaaaaaaattcaaaaattttttttgtaaaattttctttaaaaattttttcctccgaactcgaacgaaacgtcgggaaagaacattgcattatacagcatcgaccatgatggtggagaagtcagtgctggtggtaatgtgccgccggcgatcgctatgctgtcaaacggtgtgtccgcggtcggagtgggagaggaggagtacggtgacattggcgacgacgacactgtactgccgccatcagccacagcgatgctttccaacggtggtgtcatcggaagggagtacgatgacgacgactttgttactaccgtaccgcattcgacgtcgatggcatttgtgccgaacggtgccgcaaccgccgccgccatgccgaggggctacggtatggacgaagtgatggcaacaacgacggcagcgcagcagaaccaccacccggtcctgctcggtgatcggcaaatggggtttggtggtggcactgcgggcggcaaaacggcggcatcaaatgcgtcacggtttcgaaaataccgtatcatccgtaagcgtggcgctgcaccgaacatggcgacagcatttgattggcgcaagacggatctcgacaataagcgctga

SEQ ID NO: 64710 - DNA, 444 bp, Heterodera glycines
  Genomic contig location: Contig_ID=SeqID_7400; Location=4367..4810; Strand=+
  SCN-specific regions: Sequence locations=1-444
atggctgagcaaaattcttttaattctcaaaagggcgaaaatgtggtcctacagggacaaattggttcggatttcgatccaattttctttacccctgaggagaaccaaaatctgaacaatgtactgactcgaatgcgaacattcgaatccgctatttgccgtcaatttcgtaaattggagcgagaatttgcagagttgaaaattgtggctcaccaatcagatgataccgatcgaatggtcaaaattgaacggtcaataattgatttggaggatcgagaagaaatggacaattttcaaatggaagaaaaagtgataaaaatggcagaaaaggctgaaactctcgaaatacggcaaaatgcatttgaaagattgaccaaagtcaaatttaacaaggtggtggagaaaatgaaagtggaaatggcgaaaaataacagaaaacattga

SEQ ID NO: 64711 - DNA, 96 bp, Heterodera glycines
  Genomic contig location: Contig_ID=SeqID_7400; Location=3460..3555; Strand=-
  SCN-specific regions: Sequence locations=1-96
gaggatcccgctttgcgtgtccatcttgttggtgatgacccgcgacgtccaaggcgaggacaaccgaagcaattggtttcgtacgaagtgggggtc

SEQ ID NO: 64712 - DNA, 606 bp, Heterodera glycines
  Genomic contig location: Contig_ID=SeqID_7401; Location=138..743; Strand=+
  SCN-specific regions: Sequence locations=1-371,393-606
atgccgctgagagttttgccgcaaattatacatccgccaccaaatgtgccggtaattttgggtcgtttttggttgttttttctcaaattcccaagtgcatttttcaggcatttcgggtccaaccagttcaacaaccgataccactgagagacgtgccgctatttgtcaacccaccaccaaatgtgccggtaattttggctctctttttgttgctctttcaaaatcccgagtctttttttcaggccgttcgggtccaaccagtgtaacaaccgataccgctgcgagacgtgccattatttgttaacccaccaccaaatgtgccggtaattttgggtcgtttttggttgcgttttctcaaattcccaagtgtattttttaggaaattcgtgtgggaccaaatcatgatgggcaacaaccaatgccgctgagagttttgccgcaaattatacatcggccaccaaatgtgccggtaattttgggtcgtttttggttgttttttctcaaattcccaagtgcatttttcaggcatttcgggtccaaccagttcaacaaccgataccactgagagacgtgccgctatttgtcaacccaccaccaaatgtgccg

SEQ ID NO: 64713 - DNA, 364 bp, Heterodera glycines
  Genomic contig location: Contig_ID=SeqID_7402; Location=499..862; Strand=+
  SCN-specific regions: Sequence locations=1-325,347-364
aagacccgacttaagccaattttcaagggagaaggtgttcgaagaaatgagatttgtgtgataagagatggggaccacttggatggattaaaatcggtgtcctggtttttctgtgttcgcaacttttgcgtgggttgtgaagtgacgtacgatcgacctgaaagacacagaatggagtgtaaggaaaaatgcaagaagtgctgtagaatgggattcgggttcccatgtgcggatgtgtgcgataagattcactgcgaggagtgcaaccgcaacttctataacaacgaatgttttgaagcgcacaagaaggcggcttgtaacgagtataataaatgtgaaaaatgtggagaagtctaccaaacag

SEQ ID NO: 64714 - DNA, 568 bp, Heterodera glycines
  Genomic contig location: Contig_ID=SeqID_35063; Location=155..722; Strand=-
  SCN-specific regions: Sequence locations=1-7,31-97,120-245,269 -335,358-568
gactcaatccaccagcattccaatcactggtactcaacccacagcatttcaatcgccaggactcaatccaccatcgttccaatcgccgggactcaacccaccagcattccaatcactgggactcaaatctccggcattccaatctctgggactcaaatctccggcattccaaacattgggactcaaatctgcggcattccaatcactgggactcaacccacagcatttcaatcgccaggactcaatccaccagcattccaatcactgggactcaacccacttgcattcaatcactgggactcaatccaccatcgttccaatcgccgggactcaacccaccagcattccaatcactgggactcaacccacaggatttcaatcgccaggactcaatccaccatcgttccaatcgccgggactcaacccaccagcattccaatcagtgggactcaacccaccagcattcaaatcactgggactcaacccaacagcaattcaatctctgggactcaattctcaagctttccaatcactgggactcaaatctccggcattccaatctctgtga

SEQ ID NO: 64715 - DNA, 924 bp, Heterodera glycines
  misc_feature (9)..(9): n is a, c, g, or t
  Genomic contig location: Contig_ID=SeqID_35064; Location=29..952; Strand=-
  SCN-specific regions: Sequence locations=1-187,211-247,270-281,307 -878,902-924
  Gene Ontology: Mol. function=ATP binding; Biological process=feeding behavior
aatactggnaggagcgtaaattggttcatcgcgatttggccgctcgtaatgtttggtgggcgacaaaattcgggtgtttccggtcgtcaaggtcgccgattttgttctggcacgaaagcttatggaggaggacatttacgaggcacatgctggtgcaaaatttccattaaaatgtttgtcaatttggttattattaatttaaaattttaaggctcaataacgggcgcagttcgcccccccccctccgaaaatttattattttttaaattcctgacataagcgattttttataagaaaaatttttgcaaaaacttagaaattcatttcaaaatgataaaaagcgttttattaattcattttaaaatgataaaaacgctaaaaaaattttcaatacattttttttgaaattttcataaaaacttctattctaaaattttttaagaccaggaaaaagcaaattgtaaattaaaaattccattacaaattcacatcacaatttcttaatctgttaagggactgctcctgaatctgcagttcaaggaactttcacagtcaaatccgacgtgtggtcttatggcgttttgttgtacgagatcttcacccgaggtgcaactccatatccgggtactaattaacgaaataattaattttcatgtcccgttttttaaaaagaattgaacaacaaggaagtggtggaacaagtcgtcattggttatcgcatgagttgtccacgttcaactggtcagtttgggatgataccaaaaggtttacagggttgctaaacacgaattagacatttaatttcgaccaatttcgaaacccgacccggactcgaacaaaaagtcgaaaatccaaaattttttttagtttcacactttaatcaaaattgattttaaaaaatcaatcgcccattacagcattaaa

SEQ ID NO: 64716 - DNA, 519 bp, Heterodera glycines
  Genomic contig location: Contig_ID=SeqID_35065; Location=447..965; Strand=+
  SCN-specific regions: Sequence locations=1-519
atgctttcaagagtagcagcagtagaagtgaaatgtttgagaatggaacaactaaaaataaaatttccatcgcccgaggcggaagaattgaaaatgatcgcctcgaagacgtcatcatcactcatatcatattcttttaatatgatggaatgtgatgaagatgaatgtcagtggtaacggacggactaacagatgctttaaaaagaccaaataatcaaaacgccagagaaaggcatgacaaaaatggaccaccacaatgaaacaggtgggtgatgggcgattaggcaacattcgttttttgaatgccgttctttgctaataatcacttcagatcaaatgtccgtccgtctaaaaatgtgtctcgaatccacgccacagttggccatgtgttgaaccaatatttttggacgcaaattcatctgatcaatgatcaaatcagtccataaatttgtccttgaaaattttgggtataaaaggcgggaagaagtattccatcgaaacaaatattgtagcagccaa

SEQ ID NO: 64717 - DNA, 111 bp, Heterodera glycines
  Genomic contig location: Contig_ID=SeqID_35069; Location=586..696; Strand=-
  SCN-specific regions: Sequence locations=1-111
gggaggaagagggaaaagagggctcttgacagagcggtccgcgagaccatcgacgaagcgacagagaaggccaaagagttccttgaagaaaattggagcgcatttgagaaa

SEQ ID NO: 64718 - DNA, 3042 bp, Heterodera glycines
  Genomic contig location: Contig_ID=SeqID_7403; Location=1836..4877; Strand=+
  SCN-specific regions: Sequence locations=1-99,121-126,150-179,201 -218,240-403,425-693,715-818,841-962,984-1440,1463-1883,1909 -1952,1975-1981,2011-2257,2279-2359,2382-2561,2741-3042
  Gene Ontology: Mol. function=hedgehog receptor activity; Cellular component=integral to plasma membrane; Biological process=regulation of mitotic cell cycle
tttagggcaaaaaaatgtactaaccactactgtcctcgttctttcgctgttcacctttttttgttgcgggctgcgctatgtgtacattgagacggacattgtcaagctgtgggtttcaggttggtgtaaaaatttaaaaaaatatatttgaccgggttggacaccgtccgtcagtttttaataaatttaaagggaaaattggaaaaaaaacgaatgaattttttgggtaatttttgaatcttgcatggttttcttattaaaaatcctatgaaaatttctttttttccacacggcattgccgaaaaatgccatcagagaacccaaattttgcaatttcagtccaaaagtgcccataaaacgttgaatttttttctaattttttagagggtggtcgtctgaacgaggagctgaattttctgtccactctgcagcaggagagccgccaacgtcgtcaaaatgcgacaaaacggcacagcgacgaggacgaaccgacaaccgcggcatatgagcaacggcactttttgcccgaggatatggacgaacggttgttcgaaattccggaggacgaagcgcccatttcatcgtatcaggtgggaatgggggtgcgggaggtgcccaaaaaaaaacgaaagttttagagaatttcgaaaccttcccccaattttccaaaaaatagtatttgccgcacttaaaccaatccaaatccgggaaaataattaagatatttaaaaattaggtctttttcctcatattgaatgtttgtaaaaaaaattttagaaaaaaatcatgaaattttgaaaatttttcgtttttttttgaaaattttcaaaaatgcaaaaagtgattttgcatttgccttttatctgcactgaatttaaaatttacgccttttcaggtgctcatccaaacggcggaccattcgacgccctcgcgaaatgtgctgaccaaaaaggagttgctgcgccatgtgcagctgatgcttgaaatcacgcagctcagtgtccacaaatttggattgtacggtttttttggcaaatttcttaaattttctgatgccaaattattgcgttttcaaaaatttacggttttttttaattttctgccaaaattaagcggcaaaatttcggatggtttcataaaagtgtacctgtttttcatacatttttttcaaaatagtctataatttttccataattctgaatttaattactaaattttattgccagaaattggacgctggacgacatttgcttcaagccgggcgccctggacatcagccccgactcgatggcctatgtgctgaagccgaccctggagcggctgatcccgtgcatttggatttcgcccattgactgcttttttgagggcgcgaaaccactgtattaattttgaaattacttcagaaaattcttgcaagaacccaaacgctttcaaaaattgagaaaatttttgatttcctgctggcaaatcctcttggaattttgaaaatcatacaaaatattgtttttttttaaatattggggaggtaagaaagattcacgctctttaaaacccaaaaaaatccgataaattttgaatttttgcaataaattttttaacccctcccttttttaaagcggtccgtcgcccccaattgacatacaaaacattccgttgggtcccctgctgcaactgatggtggacgacattccggaccaggtcagctggaccaacctggacccggagcacgtggtcagtcaagtgaccgccaccttcgacctgggcaccatgcgcaacttcttcatgcgagtacgtctcggatttttggaaatgtttttttcaaaaaaaatgtcggctggtaaaaaatgcaaaaaagaaatgttttttctcttttttgaagtttgaaatttaaaattttccttaaatgctcataaaactgataaaaaaaatcattcggacaggttcccctcgagaaaatttttaaaaaatttaaaacttctggattaaaaagatttttcttgctttttgaaaaatgcctgtagacattatttcattcattttccagtccggcatcggcaaaggctacttggaacggttgtgcatcgacccgcttgacccggcatgtccaccgacggcaccgaatcactacggcggcaccgtgttgtgcgatgcaattcggcattttgagcagcgaattgttggcgtcggacaaatgaccaaccggacaattgtggacattttggcgccgtacaaatccgtcgacggcacaaacaatgccgggaacaaacagaagaagcagaacacatcgccattcgacattttgcaagcattttgtgagtattgtttaagggtttatgtgtaaattcgatggaaaaagggcagagaatggagaggaggatgagagacagtaccataaaaggagcaaagagagagtaagagattgggaaaagagtgcgacaaaaataaagttgttaatagagaggggcgatagacttttggtctggaaaggaaaagaatataagacaaaaagaaataggatagcaattctagagagagagagggtgaattgagaatatcgaacaagagagagtatagggaaaaggtgagagagagcgagagagttcggctagtttataagggaatggagagaaagaaagggagagttcggcatggagaaagacgagacggaaagagagaaagaattaggtacagagaaatattgagttaaagacagagagagagagagagtaaaaatagggagttggtggaggttgaaaaacttcttttttaattttgggttgaatttcagttggtgacgctgatagtggcgctggtgctgataagtctggccagtcgagcaatgccaccgcaaccaacacctcttccacatgttccgtgcacaaaacggcattcatgcgttggctgtcccacaacttggagacgttcgggggccaattcccggcccatttgttgccccgtttccccaactatggccaagtgatgcgccacgggtgccgcggcgttgcctccagcgtcatgaaatggccggccagaatggttatt

SEQ ID NO: 64719 - DNA, 677 bp, Heterodera glycines
  Genomic contig location: Contig_ID=SeqID_35074; Location=8..684; Strand=-
  SCN-specific regions: Sequence locations=1-138,161-677
atgccatcagcaagatccatcgatacggaaattacgcagccttcacttgttgacattattgctacgccgttagcgcgacagggaccgattaagccatttcgacaccgagagccggagacaggcagaaaaacgaattcgtttgctgtggatgaagatatcttaactgttgaggaaaaagaaaaggtactattttctgaaaaatattccataacaaagtatcaaaataggagttgatgagcaaagtgcaacctctggacgcaccgaaagctggttttctcggaacgcctcctcctcctcttgtggatttgttcgaattttcggacattattgtgcgtggacctcaacttgaaacaaaagacattggcacgcaagtttcattccctgaaccgagttccgcttttggtggacaacaacctgcaagaaatttcaacgggttttctgcgccagtgaatgttgttgcggccactcaagtcccgttctctgaaccacagtcaacttttgggggatttggcggacaacaacaacagccgccaagcaattccaacggtttatcggctccagttggcgtagttgcggagacagtttcgtcctcacaaattcgactttcatggactgatcctaatggaagtgcatttaaccaaatgtacaccatcaaatacggaataaggtacaactaa

SEQ ID NO: 64720 - DNA, 49 bp, Heterodera glycines; identical to SEQ ID NO: 51181
  Genomic contig location: Contig_ID=SeqID_35076; Location=659..707; Strand=-
  SCN-specific regions: Sequence locations=1-49

SEQ ID NO: 64721 - DNA, 413 bp, Heterodera glycines
  Genomic contig location: Contig_ID=SeqID_35077; Location=176..588; Strand=-
  SCN-specific regions: Sequence locations=1-413
gcatatgccgggaacaacattcgagaacaccgaaatatgatccattcttcgacagttaactttcctcaaaaggtgcgggcacttaaatgagcaccaaaggaaaattattactccgataatttgcatttttattccgtccgcttccaaattgtaatttttgtttttgtttttcagtcccaggacccgcagatgaagccgttgttcctctcttatgccgatgtgttgggcttaccgtcgacagtctcatcgtcggcttcatcagcttccacttcgttttcagcaagtgtgaagccgaatttccgaccaaaatctgccgcaaagtcagtttaaatgtaaaaaaaaaatgtttccatcaaatgaatttaattttcagggatcgaaacgcggctcggattcgcgctttgttggaatga

SEQ ID NO: 64722 - DNA, 56 bp, Heterodera glycines
  Genomic contig location: Contig_ID=SeqID_35079; Location=604..659; Strand=-
  SCN-specific regions: Sequence locations=1-56
taatcactgttgtacctcttctaatcacttttgtacctcttctaatcactattgta

SEQ ID NO: 64723 - DNA, 108 bp, Heterodera glycines
  Genomic contig location: Contig_ID=SeqID_7405; Location=327..434; Strand=-
  SCN-specific regions: Sequence locations=1-108
ccaattcttatgcttaatttttaaacgatgcaaataaccaaattaccaaatttgcaacaagagtatatgtaaattatgtaattcatgcataataaagatttgttaatg

SEQ ID NO: 64724 - DNA, 145 bp, Heterodera glycines
  Genomic contig location: Contig_ID=SeqID_7405; Location=1408..1552; Strand=+
  SCN-specific regions: Sequence locations=1-5,28-67,89-145
aaatgaaaattattttcgtcaaaatattcactgccggcactttgttggcaatgctaacggtggcggtaatcgtcacaaaattttactttatcgaggaatgggaggagagaagggacggcggaggacgccatcgaaacaggcaaaa

SEQ ID NO: 64725 - DNA, 1022 bp, Heterodera glycines
  Genomic contig location: Contig_ID=SeqID_7405; Location=3080..4101; Strand=-
  SCN-specific regions: Sequence locations=30-35,82-126,191-222,244 -263,289-289,340-377,440-522,544-725,747-957,979-1022
caaggcatttccgctggattatcccttggcttggaacaaatctgtggttgctggccaattcatcagtttcggcctctttcggttgccttttgtcacaactttccttcccattttatcattggtttagtgacgatttgttaaccgcgttaattgttgctcaacggaaacaaattttcgagtgcgaatatgaggtgtttttttattccatattttgacttgtcaatttcattaaaacaaattatgtaattatcaaatgtttgtcactccaaaaacattttaattttttaaggaccgaaatttgtacaaagacccaaatgcttctgccatttatattctcaggtgttttgccttttgctattcctttcactttccaaatgaattaattttaatttgttcagtttggctgtctccgataggtatagacggaggggcattggtacgctgttgctaaaccatctgatcactgattacagcggtgggtcattaggggtcatccaatgatccattcaatttaacgattgaaattaattggggctaaactttgatgttgacattgtttaacaacaaagttataaaatcttgttccaatgaggttttcaggtcgctttgatcagaataagattttttggaccattttaagctcggacccgagtttctcttcgcatggtcatttgttggcgtttttatgctttgtctccactttttcagttcccttggcttcaaaactgattttcctgcatgttcttagtgacaaccattcggccatcgttttctaccgcaaaaacgggttccgccatcatatgacactgcccaaatattatttaatcgacggccaataccgcgacgggcaaactttcgtcctcttcacttcgcagggagtgtttggcgaattcgtctcgtcagttggcgattggtgtgccatggcgatgagtttcctcacttcgccattttggcggtgctttttcaacaaaaaccaaacactcaacggacggacaaatgcaaactgtcgacatgtgaaataa

SEQ ID NO: 64726 - DNA, 472 bp, Heterodera glycines
  misc_feature (291)..(291): n is a, c, g, or t
  misc_feature (323)..(324): n is a, c, g, or t
  misc_feature (344)..(344): n is a, c, g, or t
  misc_feature (353)..(354): n is a, c, g, or t
  misc_feature (361)..(361): n is a, c, g, or t
  Genomic contig location: Contig_ID=SeqID_35082; Location=1258..1729; Strand=-
  SCN-specific regions: Sequence locations=1-89,111-162,184-253,275-472
agcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattanagtacaggctatagggaagctattcccgaggnnatcggtctccccataaatcntggcgcatnncgttcgngggaatgccccgaaaacaaaaaatcgattttttttcagtgtccgttttgggtactcaaacaattatggggagcaaaaatccaacgcagaattaaagtacaggctataggaa

SEQ ID NO: 64727 - DNA, 1013 bp, Heterodera glycines
  Genomic contig location: Contig_ID=SeqID_35084; Location=111..1123; Strand=-
  SCN-specific regions: Sequence locations=1-3,27-215,237-251,273 -452,474-565,597-1013
atgtttttaaaacaatataatttagaccaaattgactacactaagcgcattttcaaggcattgctggtcaatgtgctttttgtgtctaccggttactttctgaacgccggctttttaattttactccgaaaactttcgctgagccaagtccaaattgtgtttggcacttacatcctcggcattttcacctgcatttcggcaattagcaacccattaacactttatctcttcaggtggtgggcaattcgaccttttaatttgcagaaacaattgaaattcagttcggattatcgaactgcgttcaacaaacatctttttggacgataagcattcattttatacgagagattctgatgcgatttgtggtggaaatgtcatggcgaaacgacaaattgaccagcgaaatggcagagttggaaatgttcggttggcatgaacaaaataagaaaaaacctcattttttaaaacattttcaaccatttttttgtgaatttgttaattcttgacagaagagattactgaaaaggcaaagaaaatgtgaaattctgaattcacaattattaccaaaagattaaaaacaatttattcatttatcaggtataattgtaaaaatttttgtcaggcgcatcgaggattcctttggatattgctacgttgactcttcatttaaaactatgtattcgtaagtacagcaatcctaaatggtaaatttatcacaaggagaagtaaggataaatttgaatattccgaattctattttaggtactatttcggacagatcttcttcggattcgcagtcaaacagcagataaaatgggaagagacaattgatccttccgactttgggaatttatttcatacgtaagccaaggcaattttaacatcaatggcgaagcgatggaagttgattcattcgacgaaaaccgatactgttggacgtggcattaattgggccacccgacaggttttttacaccaaaaatggacgacttcacggtttgtaaaaaaaataaa

SEQ ID NO: 64728 - DNA, 515 bp, Heterodera glycines
  Genomic contig location: Contig_ID=SeqID_35085; Location=98..612; Strand=-
  SCN-specific regions: Sequence locations=1-200,233-384,406-438,460-515
atgaagttaagagccagaaagtgcgcgaatataaagaggaggtagaattttttttttctcaaaattatttctttaatgaaaaaatgaaaaaattttgttcttatataaaaattagtgtggttttttcaaaaaaaaaaaattcatcattttcactaaaaaaaatggagccaaataagtacttcgattttgaattcaaattcaaaaatttttgtttgaaaaatgatcaattttgcaatgtaatttgagtggaaaactgaattaattaatgaacaaaaatgtaaaattaaaaaacaaattttccatcttagaaatttcaaaaacaaaaaatcctgtaaaattattttgtaagtaatttcaagaaaaaataaaaagattttttttttgggtaaatttttcttctattttttggaaaaacttagtaattcgtcataaaatttgaaaaagcgcaagaaaattggtaaatccatttcagattgacgcgtggaaagtgcagcaccatgctcgtaatgaagtga

SEQ ID NO: 64729 - DNA, 303 bp, Heterodera glycines
  Genomic contig location: Contig_ID=SeqID_35090; Location=168..470; Strand=+
  SCN-specific regions: Sequence locations=1-20,42-303
atgattgtcagctataattttaatcattttaattttgtatgtaaaaaactcattacaaaattattggcgaaatcctctcagatgatgttgaaaaattattaattgcaaacaaatttgtgaaaaaatgttaaacgactaaatattttaaatataattcagaaatatttggctcttttttccagggccgaatttgcggaattaataatgcaacacacaattcgcaaaaaatctagcttctgggttcgtacccaaaatccggcatgggaagcgtcccatgccgggctctaataatccaattgctaa

SEQ ID NO: 64730 - DNA, 247 bp, Heterodera glycines
  misc_feature (28)..(28): n is a, c, g, or t
  Genomic contig location: Contig_ID=SeqID_35091; Location=743..989; Strand=-
  SCN-specific regions: Sequence locations=1-117,160-247
atgagcagaagcgtaccaaactatgcanggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaa

SEQ ID NO: 64731 - DNA, 235 bp, Heterodera glycines
  Genomic contig location: Contig_ID=SeqID_35091; Location=1..235; Strand=+
  SCN-specific regions: Sequence locations=1-235
ggtctccccataaatctggggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaatttttt

SEQ ID NO: 64732 - DNA, 697 bp, Heterodera glycines
  Genomic contig location: Contig_ID=SeqID_7407; Location=55..751; Strand=-
  SCN-specific regions: Sequence locations=1-72,103-259,282-507,531-697
atgggcgaaggcgaaacgcctcaaactgtgctcaaccgccggcaccgccccagggggttcgtttaattttggtttaaaaattgtttttaatatttttaaattcagagaatcaaacggaaatttgccactgcgaatcgaacggcggtcgaagtgaccttttgtgtgtgtctcagaatttgaccacaacggacgccgatttgccggcgaatttttcgccttcggtggtgcacatggagcacaacttcataaaatatttactcaaggagagagattcatttttcgattcaatgggagtcaataaaaatttaaatttaggacaaaattttgcccggcaaagagacaaatgttttgtctttggacctttcgtccaatttaatttccgacattgaaccggcaacttttgataagttcgccaaattgcaagtgctgatgttgacgcacaacaaaattgacagcgaacagatcagctagtaaaacaaaatgccagagaatcactgccacaaagcattaaatttattttcaaaattttacagcgatttactcacggccaaattgggacagagattgcatcagttgtacttggactacgacttcatctccacccttgaccaaggaatctttgacaatttagatcagctgaagaaattgccgttggacggaaatcggcgcttacaactcacgaaaggcgtcagccatt

SEQ ID NO: 64733 - DNA, 302 bp, Heterodera glycines
  Genomic contig location: Contig_ID=SeqID_35096; Location=185..486; Strand=+
  SCN-specific regions: Sequence locations=1-270
atggcggtgtatttgacgcatagagaccaaaaggccaacaacagaagcagtgagtgccaagtgccaaacgaaccaaaagcataaaagcaccgcttttccctcgagggaccaacaaaaaaagttaaaccccgcggggaaagaaagggcaaaacgatcgaaaattatgacgcaattatgatcattttctttctttttttattgtgtatatcgatttttcagagtttttcgaacctcatctgatgtccaacccaccgccgatggcggaacaggtaaaattattaaattaataaaaaaaaataata

SEQ ID NO: 64734 - DNA, 546 bp, Heterodera glycines
  Genomic contig location: Contig_ID=SeqID_35097; Location=158..703; Strand=-
  SCN-specific regions: Sequence locations=1-349,371-392,418-511,544-546
atgcgagggctggaaaggaaaagctgggatagaaatagtgcagggaaatgggagctttgtgagggacggaaaggaaaattttgtttgggtgaatataggaaaatggtaattttagaagggaagaaagggaaaattttggttgaaaatagtgcagtaaaaagagaggtatgtgagggctaaaaaggaaaattacgatggaaatagtgcaggaaaagggagctttctgagggacggaaacgaaaattttgggtgaaaatagtgcagtaaaaaaggggggggggatgagaggcttgaaaatgaaaaatttggggtgaaaaagtgcaagaaaatgggagatcagagaggacagaaatgggcaattttggatgaaataattcagattaactgataaataatgggaaagatgaaaagaaatttacgaaaatatttcagaaagtgagagagtgctaattggagagatagaaagagaaattgcgatgaaaatagtgcgtgtaaattagagaaaatggaaaagacagaaatgaaatttttgatattgaaaataaa

SEQ ID NO: 64735 - DNA, 1068 bp, Heterodera glycines
  Genomic contig location: Contig_ID=SeqID_35099; Location=125..1192; Strand=-
  SCN-specific regions: Sequence locations=1-239,262-558,580-876,898 -1068
atgaattttaaaaccgccgggggcctgggaaataaaattaacgaggcattcagccatcattacaaaatcaaaaaacaacgtggaaggagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactacgagaaacaaatcctcaaattttagaagagcctgatataaaaatttggtttgacaaaatggttgagatgggaaccgaaattcaaacatcacgaaatgaacttaaggcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatatacaagtatctgaagctgagaaaggaccacaaaaaagagaaagactagccaatgaggatgttcaatttcaatatgacagcattgatcaaaaatttattgtctatctttccgctgctgtctcccacatagatttgtcaaaacacctcgcctatgtgctcggttttaagaacacaaggctatttcatgcggaagaagcgaattatatgccagatttgactggcggcgtaaggcagctatacatttatgcaccaaatttaatcgaaaacacaattatcggcaaccagatggccccactcttaagaatagttaacgtcgtcgatgacccaggatcgattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaa

SEQ ID NO: 64736 - DNA, 997 bp, Heterodera glycines
  Genomic contig location: Contig_ID=SeqID_35100; Location=1..997; Strand=+
  SCN-specific regions: Sequence locations=1-14,36-218,241-503,526 -679,701-849,871-953,975-997
  Gene Ontology: Mol. function=ATP-binding cassette (ABC) transporter activity; Cellular component=membrane; Biological process=transport
catcaacgatctgtttttatacaaaatgaaataatagtcatttcatcttttagttttatttcttcgaacctgacaatattccgccacctgtcattatggtccagcatgtctctttccgatacaatccggaatcagtaattgagttatggtaatttttcaatatattttacaatttagccatacatttacaagaatttggactttggtatcgacttggacacacggggtttgtttcccggattttactttctaaccaactaacaaataaagtggcacttgttggtccgaacggggctggcaaatcgacactcctcaagctgttcagcagagatgttgagccaactgatgggatgatccgacggcatttgcactgcaaaattggcaaatatcatcaagtaattgcaatggacattttttcactatttaattatttctagcatctcgttgaagaacttccactcgaactctccgcgttggaatacatgcaaagagagtttccggacgtaagagagaaggaggaaatgcgaaaaatcatcggccgatacggtcttacgggtcgtgagcaggcaattaaacggatactcacttttattgacacaatgccatgctaattataggtgtgtccgatgaagcaactgtccgatggtcagcgctgtcgtgtggcgttcgcttggttggcatggcagcaaccacatttgttgctcctcgacgagcccacgaatcatttggacatggagtcaatcgacgcgcttgctgaggccattaataacttcgccggtggaatgattctcgtttctcacgacttccgactggtccagcaagtcacggaagagatttgggcaagcaaattttacttttgttttctttacaatgacgtatttaataggtttgcgacaaacaaacaattactaaatgggacggcgatatattttcctacaaagagcatcttcggaaaaagattgaatcgaacgaccggaagggcacgatgacagaacgt

SEQ ID NO: 64737 - DNA, 653 bp, Heterodera glycines
  Genomic contig location: Contig_ID=SeqID_7410; Location=11..663; Strand=-
  SCN-specific regions: Sequence locations=1-486,508-653
atggcatcccgtaaaaacgttgaacaagcggccaacatgaaaaatgatgaaggagaagaaacaacgacaaacgttgccgacacggtaaaagctaagacggaggtcgctgttactcactcaactttcacatccgatgaggagtcaagcagtggccgaaagcgacggcactctttcgatggaaccgcaacctcattgcttggagcaatgatccatgcacgaggagagaagcgtgaaaactggtaattacaaaaaaaatgtgccaaagcagtactctcatataacaggttaaatgcgctcgaacaaaagtatgcaaaaatggaaaaagaattaggaatcgatgacaatgcgtctgacgttgtcgatttcgaggaagattccatggaaacgattctgaaaaagtagaaggagagaatttttgtagcccaactcatgcatgcaagtattttataaaaagggttgagcgttctgaggaaaaagttcgtgcatgggaggaaaaagaggcaaacgccgcaagcacatcggcatcaacatcaatgcgtaaataaatttgaattggcaatgtgccaaaaaaaaaaaattttttttctcaagaagcgcctaccgacgaatggaatcttgaaaaggaacaaagttcggatgactcacaagctgaa

SEQ ID NO: 64738 - DNA, 876 bp, Heterodera glycines
  Genomic contig location: Contig_ID=SeqID_7410; Location=823..1698; Strand=-
  SCN-specific regions: Sequence locations=1-129,151-272,294-730,753-876
atgagaaatgagctaggtgcaaatcgtgttatactaaagccacaagaattttataagcttgcgcttgatcataaagttgtgagttcatcgcttcgttattaattaactgggtctaatttcttttttatcttgctcaggaaatttctgcaataattcctcttactgacgatgttattcgtgtgtcctacaaacagaagaagaattttattgatgagcatgctacaagcaacattgttctcagtttatggacaaccagtaaacatttaacaaaaatggcggataaagtttaaaaacggtaaattaaaggctgcgcccgcctcaaacttcttgattacatgaaccaggtggatagggcagagggtgctgagctactttatacggttggtctatagtccctcccggttgagtttccaacaccttttgtttaggacactgatagtgtaattgtgaagcatcggtgcgaccatgttccaattcagacgggtgaatttatgggacaaatgtctcaggaatatgtgggattcgcgatccgtagcttcgtttgtggaggtgattgattaatgaatttttttaccaagttaatgttgagcctctatttgtgtacaaaggtgccaaacagtatgccctaaaaatggtggatgagagtaccggcgaatgcaaatatgtacaaaaaattcgcggaataacatttgatgtgcagaatagtcaagcgctccagtttgagcacttcaaacagaaagtgttaaactatggccgtcatggagagcgcccggcggtgtttagctatgacaaaatacaaccgaccaagagcagtcggatagtgacaagagagcagttgaagcgctatcttccagtctgccagaaggggataataaa

SEQ ID NO: 64739 - DNA, 1733 bp, Heterodera glycines
  Genomic contig location: Contig_ID=SeqID_7410; Location=3282..5014; Strand=-
  SCN-specific regions: Sequence locations=1-233,271-1652,1674-1733
atgaccagcaatagttatagcatgaaaagacgctggaatttccgttcagtaagtttttttgaacaaaaacatcccatcggaggacgacgacgccgatgacgcagaagaacaagcaggcgtctcctcctcttctcaaataactcaggatcaacgccgcctacaattaggagagggaccaagtagcagagatgtagaaagtgaggcggcacattggcagagccaaaacgctccgctatttgaacaaactgcttaccatgtgcacaaattggaacgcttttccctgtcgcgtcatgtcacagaatttgtgctgaacgctagcgttgaggaacctgaggaagccttacgctccgcgtttgagatgctaatcaggcaggctgttgataacacgcaaaaacaaagtggacgtcctgttgccaagattggcatcagtttgcatggcagaggtgtgcgctaattcgtccattcattaattatcatccacatttcctctgctttacagggttgtacgagccaattgtgctcccacttcgtccactggaacaaaacacttgcgacgtgcttatggctgagctcgataaacttggccaaagtgatggagacgatgctggagatgaggaaggagcgggaatggacaagcgcacccttttgttgagcgaagcaattcaagtcacagtcacctgctttgcgcctcctgctggcgctcgacctcgacattttccccatcaattttggggatacaacgagaaacaccgtatacggatctgtaactgggacgacaattactgtcttttctacgcattaattggctcccgtgcttatcacgacccggtactgttcaaagaatggacacaagcccgacaacaaccgcaacaaaatatggcacagctaacgttgctgcaagatttttgtgaaggccaagaagcatttcgtctactgttaaccaatcgggcgttgatgcgctcatccgctgagcgtttgctgaatggagcgggcattcgagaagccatgaatgcttacggcattgatcagctccagcccattcaagacttttgagtttcgtttgcaacactcacgcggaaattcgctcctaacatggcgggactcatgtcttctgttcccaattcggctcgacggactgaaaagtacctttagccttgattgtgcggataaaccattttttccctatggctacaatcgaaggttgtcccaattggaattgtaattgctgaaaatggctggaaaatgatcaaaaaaattatagggaaaattatactatccgactcgaaaatttgccagccagagaacattactttcccgggtcgatgaaacaggcaaagctagataagtttgagcaatggtaatgagtttaagcaaaaattgtaatgtgataaattggctcaacaaaggtacgtggagaactggcgaaacacccttctttttaccggatcagttacgcatttactgtcttaatgacaccgaaattctgatgaaatccgttctgaaatttcgtcaaattttgatgcgatgagataaccaacggttttgatgtgttgccgatcagttgcacgattgccaggtgggtggtaaaaaacattatcgagcatcggcgccaccgtttagcgtatgcatgaacatttttcgtgctctgttcatgaaaaaagaccagttggccattgttcccgaggctggttatgagcgaaatgaccgagccagtgttttggtgaatgaataaa

SEQ ID NO: 64740 - DNA, 454 bp, Heterodera glycines
  Genomic contig location: Contig_ID=SeqID_7410; Location=5120..5573; Strand=-
  SCN-specific regions: Sequence locations=1-454
atgggcgacaacgagccggatactttagcaaaaatattagaaaaaaaactggaccaacaagtggttgttaagctgaatataaaggtcagtgtactgtcattgccatcaggaaaaaactgcatttttcgtgctcttaggaggctaaaggtgaatttgaaggccaagattttgactggatcattctcacaatcgctgcaaatgacgacatggaggaggatgaggacggtggcgataaaaagaagatgaaaacattagagtcagaaggagctgctaaaaaggtctctgatgcttatgatgaagaaatacaatttatggggcattcgacatcgtccaagcaaggggccagtatcgaaaagaatgattgagcgggcggacactatgatccgatcccatacaagttcatggagcactgtgttaaagcatagaattagacattctttttggagacaataaa

SEQ ID NO: 64741 - DNA, 316 bp, Heterodera glycines
  Genomic contig location: Contig_ID=SeqID_35102; Location=665..980; Strand=+
  SCN-specific regions: Sequence locations=1-316
atgatcaatgaaatttgggataaatggtgggcccataaaaattaatttggcattccattgaccgaaaaatgtccgaaaatggacccttaagaaactgaccgcaaatttccgattttcagcaggccgcaaatttcatataacattttaatttcctttcttcagctgccttgccaccatttcatcgtccgatttcaagaaagcgcttgtcgaggcgaacggaggagaagcgaacgccgacgacgacagccaattgaaacatgtcaccgttgaggaagtgatctcgcgcataaatgccatggtaacgtttgttgattga

SEQ ID NO: 64742 - DNA, 1144 bp, Heterodera glycines
  Genomic contig location: Contig_ID=SeqID_35103; Location=1..1144; Strand=-
  SCN-specific regions: Sequence locations=1-642,685-1105,1131-1144
  Gene Ontology: Mol. function=ryanodine-sensitive calcium-release channel activity; Cellular component=integral to membrane; Biological process=calcium ion transport
tgaccgtgccttacctcagctaccaaatcaccggttggcttctcggccaggtcggcaaatgtcccttcgcttttgcttcatttcccctcaggcactttattggctgagtgttttccatgcgatcgcttctttcgcgctgctcatttccttctatcagctgaaaatcccattgatcaccttcaaacgggagaaggaagtcgcgcggaaattaatgttcgacggttgttggataacggaggacgaagcgggcggagaggacaggggactgacggacacgtgcttttggtgggcggggagggggggcaaaagcgactgattgacgcgttcactttcaggtatttggaccgaattgtgattagctcaaagtctttcccgatgaaatattgggacaaatttgttcgccggaaaaccaagcaaaagtaccgggaacaagtcgacgaggaaacgctgaacgcccttttgggcacggaacggagtcccggggacacgtcgtttgactatcggtgagtgctgacacatccgaatactcaatcgggacgaacggtggggccgggggcattagggctgctcaagagtcgaaatttccgagactcaagacctagaattgtccccggtagtcgggaccgagacccaaaacccccgaaattccgtggtttataaattgccattcattcttcttccctgtcattcttccccctccccccccccccattatccccggctgttcagttacaactgttggctttggaccggcgtcattctgaccaatcggcagttcctttaccgcgtctgctatttgctgtgctccgcctccggcgttctcttctccccctttttctacgctttccttctcatcgacgtcgttctctccttccccatgctcaaggccattcttcagtcggtcacccacaacctccagcagctcatcctcacaattatggtaattaattgcacaccgaagttcgagagttacgggagagaattggaactcggccaaattcagatgactctcgtggtcgtttacctttacactgtcgtcgccttcaatttctttcgcaagttttacgttcaggtgattaattaattggccatttgtggggaattgccccccccccccccccctccccccctttttttgtgaatt

SEQ ID NO: 64743 - DNA, 351 bp, Heterodera glycines
  Genomic contig location: Contig_ID=SeqID_35107; Location=46..396; Strand=+
  SCN-specific regions: Sequence locations=1-2,263-351
atggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagaggggaatggaaaaagatcatgaatgctgctgtcctgtgctgtcaatttctgttttttgttctctttggtcacattttttttcttttgatttaagttttta

SEQ ID NO: 64744 - DNA, 1139 bp, Heterodera glycines
  Genomic contig location: Contig_ID=SeqID_35108; Location=136..1274; Strand=-
  SCN-specific regions: Sequence locations=1-301,326-531,554-646,671 -776,799-1139
atgtgcctggaggacgtgcaaacagcggcgagtggccaaatgccacactcggacttggccatcacgcgcaccggacagaacggtggacagacgagtgggatgtttgaccaacaaattgacctgcgaacgtatggattaaacaatttgaaaatatacgaagaaatgtaggtaaatggggatacgaaatgccaataaaaaatgaaatgccaacaccaactgaccgcctcattgtgcccatcaaaggcagccagaaatggcttcgcgaacatgcgctccaactttgccgcgttcagtgctcgcgtgtactccacctgctgctgaaatgggtcgggcggggcggcgtaattccgaggcactaatttcggatgcgaaaaatcaccaaaaatatcttcataaagctcctaacccttgaatatgtcatgttttgtctcgcgttggtattcatccggatgtctggagatcactttgactttcatctgaaagaaaacgcacaaattaatataacagtgaatttatttgccaaaataaattaaattttgcatttacagtaaataacgcatcataaaatagtcagttattattatcatgatttatttgtttgaataactatttaaaatggcaatgaaaaacggaaaagggatgcaccaatttttctcattaaaaaccaattttcggcacatctctgacgatactgcagacaatgctggaacattgaaacatcacaatttatacaaaaaaggggcagagattgacaatgattgtggagtcaaaaaataatcattcttaattcttatcctttttgcgaccgatagggggagggggggggggggtcctcttctccctttaagttacgttttgtcattccatgaaccagcaatgctttttaatacaaaaaaatatatacacaaatttggaatatattttcaaaaaaaatgtttgactattcagtaaaatgggaattggctgaagggtgtaatttgagaacatgacagaacggaaatattaaggaagtcgcccaaaaaagtgctcaggtttcgtccagcatttcgccgtccccattcattgttacgccgatgccgaaaatgtcatgagtccgctgaaaataagcaagagattgtgagttgaaatcatctaataaa

SEQ ID NO: 64745 - DNA, 69 bp, Heterodera glycines
  Genomic contig location: Contig_ID=SeqID_35108; Location=179..247; Strand=+
  SCN-specific regions: Sequence locations=1-69
cggactcatgacattttcggcatcggcgtaacaatgaatggggacggcgaaatgctggacgaaacctga

SEQ ID NO: 64746 - DNA, 146 bp, Heterodera glycines
  Genomic contig location: Contig_ID=SeqID_7411; Location=123..268; Strand=-
  SCN-specific regions: Sequence locations=1-146
atgcttttaaaagtaacaccatggctcctcatcagggtaaggcggtgctgcgctgagccgtgcgtcgcctgggcaccgatgcattggcggcggcgccgcgtgagatgtgcggatgatggcactgccgacgagcaatgtgatcggcg

SEQ ID NO: 64747 - DNA, 810 bp, Heterodera glycines
  Genomic contig location: Contig_ID=SeqID_7412; Location=1876..2685; Strand=-
  SCN-specific regions: Sequence locations=1-147,174-353,375-810
  Gene Ontology: Biological process=regulation of protein activity, epigenetic
gtaattacaaaaacgtctttttcttagcgatttcgtaattgttgtgcccgactcggcgacgggtgccaacaactgtgcagctatgatcagaacttgggcacggtaaattttttgttaattaggattagcgtaaaatattatcccatattttgattttaaaatttttatctattcttgaaaatctataaaatctcttaccattttcattttgcctttttcagatacaattggccgtgctgaccggaagtaagaaaaaacaaagcgtatacagtatccactgacactaatccaaccccttccctcctactgtaagggtgtccggtgagtcgcgtcggtgaaatgatggtgagaaaatgaggcaaaaatgaacaaattatgaccaagtttaaatttaggtatgcgctagtggaaatgaggtaaaaaaagggggaccaattaaaaaaatcacttctgaaaaagtaaaaaattaacgaaacaaaacattgtttagtgattttttaaattgttatttttagcgctaattggcataatgacttttttatacccgcctctttttcgcatgaaattgaaaaaagattttcaatttttcaaggacgccaccgcctgttgccaagcatttggcgtttttgagtccggcttcgaccattgtcgacgtaaattttacttgattgattttctttagaattttttcatttagcgtactgtaatccgtccggagggttgccaaatgatgggatgttagccgagaaatacagatgccttcagaagcttactcagatccaaaaatgcttctatttgacccaacggccc

SEQ ID NO: 64748 - DNA, 1829 bp, Heterodera glycines
  Genomic contig location: Contig_ID=SeqID_7413; Location=6..1834; Strand=-
  SCN-specific regions: Sequence locations=1-287,309-332,413-468,492 -619,641-898,920-1175,1200-1224,1247-1305,1362-1371,1393-1572,1597 -1730,1752-1829
atggcactggtactcattttgcttggtttcatttggcatgcgccggcctcagttggtgccgatttgccaagttgcattcgcgcaaaatgctctcattgccgggtgccgttcatcgccgaaatgtgccccggggcgtgtgccgtctgtgggcccattggcaacaaacttttcatcactacggtcagcagaagtcaatttcattcaaaaatttctaatcagtaactaacaatcccttttcgaaagcttactcaatagtttggatcagtgatggcacggaacagtcggaatcccaatttttaatttccgaaaaaattttggacgtcgaaattctgattttataatttttaataaaaggtcggaaattttttttttataaattcaaactgatttattttaaattattaaataattagtgtccatctgatcaaaaccctgttaacgtctcggctagcattgcgatcagtcgaaattgactgttaacatattcgccacaattttctgtttgatcacttctgctgaccattggtgttattaattgcaggcacaacagtcggcacaagtgccggacgcaagggcatttggccaagcgcaagtcaaagtgccattcgcgcaacaattgcccttcccttcctcagttggcggagcaccgcaacaaagagttggtgaagcagtaccagcagcacaacagagacaacatcaacgccaagtgaactcacggggtgtaaacaacaacaataacaatggtggaataaatttaaagaattaacattcttatattgatcaagaaaaaaaggatgatttatttttccattttatcccaaacttttttttttgtggatccaataaggtttttaatttttgaattccaaacactggttggcgtgaccggaaagtgcgtcagtgatacaaacattttaaaataaaattctgtagccttaagttttcggttcaaaataagtttatgtaaatacacggaaacaaactgaaaggcaccaatccctcaatatgagatcatttatgccatttggaccataaatgctaaaactacgaaaattttaacattcggttttttgttcgagttcgggtctggggttcggagctggcccaaatggatacatgggttcgtgatcaatgacctcgaaaccccaaggaactagtttttatgacaataaaattttcactgacaacattttctactgacgcattttccgggagccctggttggtctgatgtacatggaaaggcaccattattttggaattctggtgatccggttttagatcataaaggaatagtgtcaaaaatagtttattccaataaatactgaaaaaattttcaattataataaataaactaaaattgttttagggcgtcaaaaggcgttcagaaaccaatatggcactgattttggagccggtgctgctgaacaaaaccattaccaccaccagcaacaactgccgttccaaaatgggcagcaaggcggtggtggccaattcgtgccagccgatcaccaaaatcaaggcggccaattcgtgccagctggtggccaatttgggccgcttccctatcaaaatcagcagcagcagcaaggcggccaatttgtggcacagtccggccagtttggccaatttgtgccgccgggcgatcagggtgggcagcaatttgtgccacaaaatcagcaaggcggtggccaacagtttgtgccggctgatcagcgtcagggtggacaatttgctgcgccacaacaacaacagaccaccagctttggtggcttctacaaccagcagcaacagccggatgaattctttccgcaagccggctttggcccg

SEQ ID NO: 64749 - DNA, 96 bp, Heterodera glycines
  Genomic contig location: Contig_ID=SeqID_35116; Location=78..173; Strand=-
  SCN-specific regions: Sequence locations=1-96
atgcgcaaaatgttgcgctcggtgtttctggttctgttcgtcttgctgatcggctggctgatcagttcggctgcccgcaatctgatcaccgcattt

SEQ ID NO: 64750 - DNA, 207 bp, Heterodera glycines
  Genomic contig location: Contig_ID=SeqID_35118; Location=1128..1334; Strand=+
  SCN-specific regions: Sequence locations=1-87,109-178,200-207
atgaatcccaacggttttttctttgttttagcggtactttttcttgtgaaagtcgactttttacatggcgtttacaatggtatgtcaataaaatatttctgatttttaaacaaaaataaaaaattcagaaccaatggcacgacaggtgctgcaaaagcatgcatcacaatttcagcagcattgtaaaaatcccgcagaggaagtgcc

SEQ ID NO: 64751 - DNA, 798 bp, Heterodera glycines
  misc_feature (784)..(784): n is a, c, g, or t
  misc_feature (797)..(797): n is a, c, g, or t
  Genomic contig location: Contig_ID=SeqID_35121; Location=194..991; Strand=+
  SCN-specific regions: Sequence locations=1-273,309-409,435-536,559 -585,608-623,645-798
atgaccgttgcgctaattggcaatcggacttccatctttatgatgctttttctcggcatcgaacggtgcgtcgctgtgctcttcccaatttggtaatcaattagataattgactaattattatcaattttaagtgaaaaaaaattctcaggtcaaggagtcgcaaccaacgcaaatatgctttttggacttgcatattttctgtgcttctccatgcaccgttcagtatttaccaatgcttatctgttgggttcaacgcaccgaaaaggcgccgatttatttttatttaatattttaattttaattttagattacttttgtgctcctcaattgatgttgtggcgggaggtggaaacaattttatcatcacaattttgaacaacggagtgatgggcggcacaataattgtgtacactttgttgtggttgaaaattaaatttgcgtcttctccaaatggtaaggcaaaggcaaaggtcgaaaattgagtgtcaccaaattacagtattccgagggaaattgaccaatttccaaaatggcaattttaaaaatattatgactagggtagcaacttttcgtgacgaaaaatcccgaaatagttaactaaaatagtgagtaaaaatgccaaaatagtgaagaaatagtgacaaaaagtccgaaatagtgacgaatagtgacataattttcagccaaaaattaagcaaaaataatttttattcactgattgcattgcaaatgagtagggctgggatttttaagggcaaaaaaacaaaataggtacataaaanaataatttttaana

SEQ ID NO: 64752 - DNA, 342 bp, Heterodera glycines
  Genomic contig location: Contig_ID=SeqID_947; Location=294..635; Strand=-
  SCN-specific regions: Sequence locations=1-116,140-155,178-311
atgggacaagaccagggttcccggatatttgcaggtgacctcagggtgtatcaagtaaatttattatttaaatgcataaaatgtacatttatcgaatccctggttattcccaaaaaacatttgaattttcattaaaaaattcagaaaaatcgtgatttgtttgctaattaaattttttgtcatattgggcgtaaaatgatttagaaaaattaaccacaaaaaagtaaccaaaatgcatttttttgcaaaaaaaatacccaatgggcttaaaaaccccaaatttattcaaaaaatgcaaaaaaaattttcggattttttattttgaaatttttttaaaataaa

SEQ ID NO: 64753 - DNA, 105 bp, Heterodera glycines
  Genomic contig location: Contig_ID=SeqID_947; Location=706..810; Strand=+
  SCN-specific regions: Sequence locations=1-105
atgttcgcctgcgtaatcgtcgacattcgcagcaagcacacctgcgctgagttcatcattcgggacgacattcacaaattttttgggttccagctcgaggagaat

SEQ ID NO: 64754 - DNA, 6759 bp, Heterodera glycines
  Genomic contig location: Contig_ID=SeqID_948; Location=1959..8717; Strand=+
  SCN-specific regions: Sequence locations=1-513,538-779,801-1712,1735 -1926,1948-2243,2265-2538,2561-2674,2696-3127,3149-3625,3651 -4126,4149-4462,4485-4586,4608-4661,4683-5002,5024-5650,5672 -5941,5964-6039,6075-6592,6614-6759
atgactctgcaaaatgacggttgcagttgtggtttttttgtttgcttatatgctgaggcatggctgattaataatcaatcgcttattttaccaaaccttgatataaatttggaaaaaagaagaattctttggcatataaacggtctttataatcgtgataatgtagtatatcacccgtgctcattgtttgttggcagcgaaaatgaaaatttgggttctttgcatgattcgcgtgattcatctatgtccattgattcaaacataaatcaaactccagtcaaaagaagaggacgcccagctaagaatcgttctgggtcaggacggccaaaaaaaacagagaataatcaaatattaatgccagttttttcgcacaattcttcccttgcaactgatttaaattattcggactgctctgattatgttagtgtctcttcaaattgtagtagtaacagaggaggtcgtccaaaaaaaaggagtggtggtccaggaagacgacccaaaaagactgttcataccaatttaaaagaaaatattaatccggcccaagaaaatcacacatcgaatactcaacctgtaatttctaatgaattattgagcttattgaattctgattctattgatgtccctgactcgcaacctgtagccccaggacgtgtttgtattcaatcaataaataaagatctcattaaagagacgtggtcttctcctactgatatgttcagtgatgatttaatctactgttttcaacgttatcttgcatcaaaaatagctaacaaaattgttgcagtagtcaacccacaatacacagacttacaaagttttcatgttggtcctattgctttcccatacaatgtgattgataactgctttaattattcagcgaactatgacattttgttgatgactattttctttaatggtcattttgctttaatcatttttgaccgatctgaccgagataatttgatttgtctatttattgattccttgcctcattatgatcggctttttgatcctcaataccctggctatgatgtgagaaggattgaaataattaaaaacggaatttgtgaattgacacctggtctgactcatgatgatgtggtaattagggctttaagttcatcagaatttacaccccaacatgacggaattaactgtggcgtatttgttctgctttattcggaggcctatttaaataattgttctctgaaattcccaaatttaaacattaactttgagaggcggagaattttgtggcatttggcccagctgataaataatgataatgtagagtatattggaagaaatgctaatccacatcctcaatcccttcctttatataatgtggagtctaatattgaacaatcatgcccaagggatggagatggagcgtttatttgcgtagaacctgatatagatagaacccctgatgttattttgaggccaccttccacggtttcttcgattacggcaacccgccgatctatccgacttcaaagaagtgttagtactgaaaaatcttctgataacaatgtgaatactcttccaaaaattgagcgaaatgacattacacagcgttgttatgtgaaacaccaaggaaacccatgcgcagatgtgcgtgcaaagcacactactgagtattatgattcaggaaatattggtgacaaaatatgcgaatattgtaacgcacttttattgaacagcgaggcagaaaaaaggaatgggaaattttcttcgagtttttgttgtaatcacggttcagttgttttgccctcctataaagagcatccaccaacacttcaacgatttttgtcagggcaagattcagagtcaaaagaatttttatcccatcaaaatgtatacaattcattgctggcctttgcatcaatttctgttggctattacgaatcgtctcttgatggtgacaaatgttatttattgaatggagaatttacacgaaaaattgggttattacctggacaatttgctccgtcttttgcgcaattgtatatacttgaccctatggcggcatttatgcaaagaacaaaaaatatcgaatatggtggggatagagtaaatgaaaaaacaataagaaagcttgattttataattcgcaaataccatccgcttgccaaagagctattgaatttccatgcacaataccaaaagactttagacgaacacggtccagaatctgttctcaatttccgtttgacattggttgaagctcgtgaagcaccattaaatataaaggaccctttcctccatccaagacaagccaatttacccgacgaggggaattctttattttccatctgggctgaaagcgatcagccaccattattaaaaggtatttggatcactacagatgaaggaaagcttcaaaaattccgtccacatcacccacaaaccgattctctttgctatcccttaatatttccaaatggcgatgacggtttccatccaaaaattccttacaatatcacaaataaaaaatgcgaggatgaagctatggaacttgatgtcgaatctgatgaaaacacttctgattctgacgaaaaagcatccgatgataatttatctgttgcaagttcagttgattcggttgaaaagtgcggaaaacgtcaattcttatcagttaggtcttatatccgatatcgtattgcgctgcgaaatgacaagaagcttcaccatatttggagtgctggtgggggcctgagtcaaaaatttattttggattattcagctcgtatcgatacaaatgttgcaaattatttgcggaagcctgaattaaatttacgcagtactttacctgaaaatgcgcttcgctggctttctcgtaatgcggggcttaactcaaccgaagaattaggtagcgttgttatgttccggagatctgcgcctggaacacgggcatactttcaacataaattttacgatgctaccactattatgtcaaggtttaagaggccagggtttgcatcattttttttaacttttacgacaaatcccagatggccagagatttctcgaaattttcttcaccaaggtcagaggactgttgatagacccgatttaatttgtcgtgtttatgaggacaaactaagacacttgcattttttgctggatagtaaaaatattttggggaaaatgattggccaggaatgcagggaatttcaaaagaaatacggcggtccacatgcccaccgcgtttatcataccgatctgctcgcaattcctgaaaatattgacggattgatatgggcacatattcccgccgagccaaataaaaatgacagatctgattgggctatttttattcgtaaagtgcgtgaattattgccaaagtatcagtttcatgactgtgggcgtcattgcttaaatcgtaaagggaaatgtaaaaaaggttttcccaaaccgtttagcaaatttacaattttacatgatgaccggccagcaatatatttacgcccaagccctgaagatggtgggcaaacattgactgttaaaagaaaaaaaactcaaataacatatgataattcgcgagtgtccgcgtacaatccttatattttggttcactttgaaacccaccataatttggaatatgcatatgggcaaagcacaaatttgaaatatttatacaaatacccgttcaagggtcccagtttctcatacgtaaagactaacgaagtaaatggaaaaattggtattgacgagccggcatattacgccaaaatgttatatcgttcatctcctgaggcctattgtaggatcatgtcgctaaagtatgctaaattatctcataccgttattgctttgtcaattcatttgcctggtcagcagaaaatttattataagaaaaatgaaaaagagtcagtcgctcaacaagtacagtcaggcattttgcccgaaactcctttaacagcgtattggaaaatgtgtgaaacggatcctgatgttaggaaaattctttttgaacatatgcccgagcaattttcattcaacagatctggaaaatattggaagaaacgaattttttcaacgaatccaaaacggcaaaagaaccacgcgaggaagccaatcattggacgaatttacccggtttcaccacgaaatcctgagttatttgcattatatttattgacaaaacattttcccggaaacccggagcaattaaaaatgttaaaccccacgcatatctgtaaaacatttctggaaacagcccgactcaggggacttattgatgacagcgatgtgtgggttcggaccatggaggagggtgctgcctcgcttaccccagcacaaatgcgtcagttgctggctaatattttaatttttggttcaactgaaaattgtctcattgatggagcactactctgggaaaaatttgtttcacacatgtttgacacacgctgcacagatgctgagcgtcctgctcgtattgaccatgctcttgctcttttagaaaaattattagttaaactaggaaaacagtgtaaagattatggactgccaaccccaacaatttcaattataaatgatccacagcgggggcttatcgagtttttcttcccccagcacttaaatgatgatgatgttgatgacatagttgacacaacagcatttgagcgtggaaaattgaacgctgaacaacagaaattttttgaaatgataaaaactgcttttttgaacccatcgagttctcgactattttatttatgcggcgatggcggaactgggaagacatttttgctgaattacattttatatcaattgcgaaagatcggtgctaaaattattcctaccgcatcgaccggcatggcatccacgcgcttttatgttggtggtactactgttcattcagcgtttaaatttggaataaatgttgaggccggaatattgccttcaattccctttgatagtttctttggtcgacgcataatagaaagtgatatcataataattgacgaaatgacaatgttggagcggacagtttttgaaaatattgatttagtctgccgtcaattgtgcactcaaaaacagcatttacctttcggtggaaaatgtgttataatttctggtgattggaaacagtcacttccagttgtaatcggttcttatgggagtgcagcgcaggttgcagcatgcatacagtcctcaccgctttacccaatattctcaaaatataaactgacccaaagcatgcgagttaatccaaacgaaatagagtttcttaaatggcttgatgatgttggaagaggagtaaatggagacacggttgcaatcccaaaagatatggttgtcgattcacgagaagaacttattggttgggtgtttgatcaaggatttaatatgccaagtagcgaaatgcttaaacgccttcttttggctactacaaatagaattgttgacataaataattcccaaatttctcagtccatgtatggaaattttcttgaatatttctcggttgacaaggcaacagatgaaaacccgctttcggtaaatgcagctgactttgatgtagcccagctaaaccagctgaatccaatgggaatgcctacccatttgttacgccttaaaattggatcaattatcgtcttactcgtaaatttaaatacttcaaaagggctttgtaatggcacacgtcttcttattaaaaaattaactgacaatctaattgaatgtgaaaccattggtaccggatcttctggaaatggtataattattggaattccccgaaaccggcatacatataaagacaaacgtccggacggtgtaagttttgaaagatttcaattccccattcgccttgcttttgccatgacggttgtgaaggcgcaaggccaaacggcagttcgcttgggaattgattttacagaagaaccttttgcccacggtcagttgtacacggcgctttcaaggtgtacaagtcgtgataatataaaaatttttgctcccaacaagccaaaagacgataatggaaaccctttgattagaaatgttattgcccctggtcttaatttggattaaaccttttaaatttaatatcaatacattttaaaaattttctcatcaatgtgcgaagagccccggtaatgcgggaggtgccgccacccttaaagtgcaaggagccccggtaacgcgggaggaaccgccacccttaaagtgcgaggagccccggtaatgcgggaggtgccgccacccttaaaatgcgaggagccccggtaacgcgggaggtaccgccacccttaaagtgcgaggagccccggtaacgcgggaggtaccgccacccttaaagtgcgaggagccccggtaatgcgggaggtgccgccacccttaaaatgcgaggagccccggtaacgcgggaggtaccgccacccttaaagtgtgaggagccccggtaacgcgggaggtaccaccacccttaaagtgcgaggagccccggtaacgcgggaggtaccgccacccttaaagtgcgaggagccccggtaatgcgggaggtgccgccacccttaacatgcgaggagccctggtaacgcgggaagtgccgccaaatcttcagagcttagctcctcgccgggggcactaaaaattaaaaataaattaacaaattacagtaaaaaataacacacccccggcgagtggggtccatggtttttgccagtttcccaccgtgctcctccgcgtggtggaccctgggggttggacaatttaaatttacaaaaaaaattgtccaaccgctaatgacggtta

SEQ ID NO: 64755 - DNA, 645 bp, Heterodera glycines
  Genomic contig location: Contig_ID=SeqID_35122; Location=146..790; Strand=-
  SCN-specific regions: Sequence locations=1-448,470-507,529-645
atggacagcagcacatcttccggcatgagcgaaagtgccaatacgccgagggcaccgtcgtcaaatttggcggaagagccaactcaacattcagatggaaagctggtacaatacccacaccagtctttttctgattacacattctgttgcataagtcttcgggtcaaagtgccgtcgccacttttgctccccgttttgaaaacggaaaaaatttgtccgtggatcattttgcaagccgcgctcgtgaacttaaaaaaagtggaaataatgaggtaggcgaggcaaaggcggactgaataggacggatgaacccaaaaacatttgcatttagagggataaggtgcatcagattctgctttacttcgaatccgtcgctttttacataatgacagcgtcttcactcaactcaaagcccgaaaaaatgcactcatcattgactgacgtagtcaattttttaaagtaatgttttgccaattattttcataataccctcaaatcatttttagctcttcttgggcatctttcaagaacagcaaaacgttgagttcgtcgagtgctgccatttccattcggaatcgactcaaaaccatccaactgatgatctcctcttgccttgccttccacctctattccatccacagcaca

SEQ ID NO: 64756 - DNA, 76 bp, Heterodera glycines
  Genomic contig location: Contig_ID=SeqID_35123; Location=1118..1193; Strand=+
  SCN-specific regions: Sequence locations=1-76
aattactggagttagcatcatagcagtgcttttccttgtctttttgatgccctcgcaaaatctggtccgcttctga

SEQ ID NO: 64757 - DNA, 532 bp, Heterodera glycines
  Genomic contig location: Contig_ID=SeqID_35123; Location=402..933; Strand=+
  SCN-specific regions: Sequence locations=1-192,216-532
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattat

SEQ ID NO: 64758 - DNA, 1111 bp, Heterodera glycines
  Genomic contig location: Contig_ID=SeqID_35124; Location=10..1120; Strand=-
  SCN-specific regions: Sequence locations=1-487,510-693,717-943,966 -1111
  Gene Ontology: Mol. function=ATPase activity, coupled to transmembrane movement of ions, phosphorylative mechanism; Cellular component=endoplasmic reticulum membrane; Biological process=calcium ion homeostasis
gtgaacaattcgctggttgctctgcaacggctcgacattttctgcaccgaaccctttcgaattccgttcgccggcaaagtggacatgtgctgcttcgacaagacgggcactctgactaaggacgagttggtgatggagggcgttgccggactgcccacaacaaaggcagactccccgaacagcaacgggtgagcacaattcgaactcgaacgcccctttcagccgatgaacgatcattgacatttgtcagcaaattggaaacctaaaaaatacaagatgaaattaggggaacgacgattttgaagaagataatctcggggatcggatttgggaatcctccgaaaacaatcaaactatttgggatgggtcggagtttcaaatccagtttaagattattccttcatccaaactgtttgtagaagtacttcaaacgatgcgatggcctctgacagccgctccacagaaaatgacacgacgccaagcgacaccacagtaactgttgttcaaaatgttgccgagtgcggacccaacacaatcaacgcgttggcctcctgccactcgttggtccgttttgagaacgaattggtgggcgatccgctggagaaggccattctcaaatggttggactggaacgtcacgaaacgtgagagttatttttggctctaaggggcggaattcagtgccaatctttagaatttttttataaaaataaatttctccattctcagaagacgctgtgatgccgaaccggcgaatgcccaaaatggcgccgctgaaaatcttccgccgctttcacttcaccagccaaatgaaacggatgactgtcgtggcgggctatcagccggttgccggctccaacgacacttttcacattgtcagcgtcaagggggcgcccgaagtgcttaagccaatggtcggtgagggaatgctaagggaagtggaagaggtgggagaaatgcttgagcaacggatgaatggcattttgaaaaaatagtgccaaaaccgccgtaattggaattgaaaagtcagtcccttttcagttctcgaatccaccgtctgactacgactcgcactaccaacagttggccttggccggcgcgcggattgtcgc

SEQ ID NO: 64759 - DNA, 87 bp, Heterodera glycines
  Genomic contig location: Contig_ID=SeqID_35128; Location=369..455; Strand=+
  SCN-specific regions: Sequence locations=1-87
ggtattactgattctccaatgccggattttctcgcgcgacatttggccgatatcggaaaaagttccgaaaggaccgatatccacaag

SEQ ID NO: 64760 - DNA, 144 bp, Heterodera glycines
  Genomic contig location: Contig_ID=SeqID_35129; Location=674..817; Strand=+
  SCN-specific regions: Sequence locations=1-144
atggttgacaagccctatgagttcgtggatcggaactccttgcctggggaccagtgtgcttgcattcgaaaaaacacgagacataagcgcccgaaggcctctggcctgaggaagtgtcctaaccgggaaatccggaatgctcgt

SEQ ID NO: 64761 - DNA, 205 bp, Heterodera glycines
  Genomic contig location: Contig_ID=SeqID_35130; Location=618..822; Strand=-
  SCN-specific regions: Sequence locations=1-155,189-205
atgggcaaacttcaaagagaaatcaaagaaatttttgaaaatcagcaaaatgaatacgaaaataaaatttatgaattggaagaaatcgaagaattggcgaaggaagagatggagcagatcgaaagcaaaattgagcagaacaaaaccaaactgagcagcaggacagagcagcagaggcggaagaaaaataagaaaacggaagacg

SEQ ID NO: 64762 - DNA, 555 bp, Heterodera glycines
  Genomic contig location: Contig_ID=SeqID_35131; Location=580..1134; Strand=-
  SCN-specific regions: Sequence locations=1-555
actctctcacagggaccagacggcaaactttcatgcctcgacgaagaccaacatccaaaaaatgcaacccgtgctgacaatgagagcgaattggaggagtgcgcgcaccagcccaatcggaacatcatttgagatggtcgttagggaatagaataagacggacgttcttgcatagatgccgatgattgtttgacatgagttacctttcggcaaatgtccgtacactttgaccgaaaattgtaaatttacgaaaccgttaaccccatttgcctattctgttcgttttttgatacatttgctcgttattttatcgttagctatctatttattacattgcaatttgtctttttcattttcctccgttacttccttatcgatcttcatcgctacagatatgtcataaacgaatttatccataatatcagccttctatgtttttccaacatatttatctttgacaacgagaaaacgtattgaatgtacaatcagagcaccccattactccaattagattaaacccagccattcgatcgcgggtcccctcaagttaaccaa

SEQ ID NO: 64763 - DNA, 357 bp, Heterodera glycines
  Genomic contig location: Contig_ID=SeqID_7418; Location=991..1347; Strand=-
  SCN-specific regions: Sequence locations=1-357
gttcaaccgatgttggcaatggcaacggcgcacatttaaatggacatttgacggcgccaaaaaatgaacagcaacagaatggcaatgatgaatgcgaaacggcgcaacaaaaaacggatgatggcaccgaaataacggcagaaagcaacaatggcaatgaaagtgccaacaaaccggcggatggcaatggcatggaaaatccggcaccaccacaaggcactcctcaaaaagatgctaatgatgctgagggtgatcatgatgatcaacatggatttggtgccgatcagaaacagggtgccaacaacgacgacggcggaggaagcattgccaaaatggcaattgtatgcggacgggcaa

SEQ ID NO: 64764 - DNA, 2517 bp, Heterodera glycines
  Genomic contig location: Contig_ID=SeqID_7419; Location=219..2735; Strand=-
  SCN-specific regions: Sequence locations=1-84,125-164,197-292,315 -691,713-843,878-923,945-959,1018-1019,1041-1065,1087-1504,1558 -1706,1796-2011,2035-2517
atgatgcaatttgcacgaaaacattcgagcagttcattggccgagcaacggatggccatggacagagaccatcgtgagaatttgtttaaatttgttaatatattttataattaaaaataaaaaacaatttcgatgaaaagtttgttgagtattttgagcaaaagttaataaaataaaatttttaaatataatttaagaaagaaattcttgctaaacattgattttgttcatttataataaaataacggatggataatttatcatcaaatttttaaaatatttaatcagctcttatttttatttgcttgtagttttggcttttcaaaagttcaagacaacttggtttttcgcttcagattcttattctcaaatgccaagttttaatttttctatttttatgccaaacagccggcttttggtcattttcatttcataaaaatttttgtttgacattcagtcgatttggcattccatcatggctccaccgtgtcgctgtacgccggcaccggcgtccgcaatcagccgatgcttccgctgagtaacagtgccaatcgcatggtgccattgacaacaccggcgtcgcgtgcaaaacagcgcaagcagcacattatgaacgcctattttggcggttttggctcggcactgaacaaattggcggctgcgaataagtgaaactcaatttttatggggcaaattttttaattttttttttgcttttaaatgaatttgtccgggaaatttccgtaaatagcggctaaaaaatcggaaaccaacccgagaaaaattgttttttcggttagattgaccaaaagttttagaaattccctaccagcagtagacctaatttttcttaaatttttaaaattttggcaaaaatctcaaaaaaattcccggtttcgattcggtagggtttagaaaaagacagtaagactttgtgtataaagtataaattaatcgggaaaaatatattaaaaatacatttagtttaatttttatgcgttttttaaattaaaaattccaatttttcctttcaaattttcgttggacaattaacggcgtgaaaatgatgggcagcaacgaggaagtgtcttcatcggtcgaaaaccaccaaaatcatcctgcttctggcatcaatttctgtccaaatccgtcgcagccattgcgccaaacacggggcacgttctcacagcgaaaggtgcgcgatatttgaatttggcactaatttgggaatagctatcccctgatcatctctgatcagtcccggtttgatagcctctgatcagtgatttggaagatggccagcagataattaatgattaggaacacttttttttggttgctgaattcttcgtgagggaggcattcaaattttgagatcgagtttttcaatttttcgtctcggtttttctagacaatgccgaaaaaccaaaacacagtggaccctaaaagccccaaatccaggctcagatccatcagacgaagttcggttcggcctcggatttagattttaaaatttaattaattcttcataaaatcaataaaatttttgaattttttggggttgttcaaatgctttgctgtttttggctaaaaatagcggaatttttatggtttttagtctcccaattatgaattacccctcacacatttgaagctgcagaatcaccagcaaatggactgcccgatcggtggtcggcatttacacggacgaggaggacgaggaggaggacgacgacgaccaatgttgaagaggatgatgaggatgcggatgatgatgacgacattgcggatgatgtggacgtgtcaaccgaggaacagcagacggacgtcgagcagtacaaggagacggtgagcaatacgaataataatgctgatcactagcatttcatgatcagttcagtatttgatcagactgcttttattaatgctgatcactagcagtttatgattgatcaatagcattttatgatcagttctgtccttgatcagtctgcttttttaatcaccacctatttctgatcaataaaaatggaaaaaataatttttggtttgatcatttttcaaccatttcttcttttttgatctttctgctgctcagtttgttgtcttttttcttgattagtctgaaactgattcgaagattcttggtttaatgcattagtttcttaatccaaccctaataaatttgatcaaaatttgtgcgctacaattttcaggttgacagcgatgagaaaattgcccctctgatcgaatgtgagcaactgaaaaacttcttatctgggccgccaacaacaaaatgccaaataaattcggatgccattctgtcggtgtcgtcgactacgacgaagacaccggcgacagcccaaaatggtggcaccattgagttggtggtggtctccaaacagaaacaaccgccgcaacacaaccagcccaagcccaacaaacagagcggcggggccgaatcgcgagcaaattcggccgaaaatgggacaagaaagtaattaatgaacaattaaa

SEQ ID NO: 64765 - DNA, 1489 bp, Heterodera glycines
  Genomic contig location: Contig_ID=SeqID_7420; Location=1233..2721; Strand=+
  SCN-specific regions: Sequence locations=1-108,169-191,213-631,654 -787,820-820,854-881,924-1268,1291-1382,1405-1489
atgccattgtgggagttcggcagactgctcaagctggtgttgtggtggtggctgaaccggtgatggttcgggtctcgcttcacaaatggtggacgccgttgcacaaactgttgttgttgttgttgctgctgctgttgttgttgttgctgttgttgctgatgttgttgtgccatgccgtcggtcaacgcgtccagcttggactcgatgaagtacagtttgctgttcagctgcgtgtgcaacagttccatgcggccaagcacattgcgctccaatttctgttaaaaaacaaaaattttagcaatttaaattcgtaaaattgaaaaaactcggacaaatttagaggaaatcggcctggattggatccaggcctggatttttcctggatccaggcccaggtccatttttggcaacttgggtttttcctgaacctggggtttcctgggtttttgtccagaaaatccagatccaggcccaacatggaaccaagggccagttccaggtccaggcttttttcaaaatgccgatctcatctcttctatgagtatattcagtgacattccaacacccaaacccagtcttaaatctaaaatttattgcatatgttttcaaattttaaactaaaatcttgtaaaaattaagtgcctttgttttgatcgaaatttcttatagcaattccttgaaattaattttatctcccaaaaattgaaattatttaaaatttggttactgtacccgcatttcggtcaatgtccgttgctcaagctccaacaaggctcggttcatgttcatattttttaataatacaataataaattatttgtgttgcttaattatttttaaataaggaaaatttctcaaaattttttttagcgaattagaggttaattttatttaaatattttcattaaaaacatttattataagacttttttaattgtgagatttggtcaggggcttgaaaataaatttggcctaatatttatacaaaaatgtcgaaaaaatctttggctctaagagtaaaaataaaagtcttcggattgtccttccgaaatttttttcgggcctatgggcctgcgcgtgccctgcatgtcccccccccccctgctcgaatgaaaccatcaaccttccacggttttggtcgggaattctcgactcgctaagtgccgttccaataatattttgccaatttggttggagaaatttgaacctcccagcaggagaatacattatcgcatttttgttctatttttacaaagaaatgctttatttgctctcttttagtttgctgtttccaacactcgtacagttttgggttatttgaatatttgccgttcactttcaatgtttggcattgtgacacgtaatattttagttgtaaacgaaattaatttaaatatttctagggtttttccgaaaaaggacatttccgaaagtccagcaggcaatgcttatcggcagaaaaggaattgaaaaattgattaagatttaa

SEQ ID NO: 64766 - DNA, 462 bp, Heterodera glycines
  Genomic contig location: Contig_ID=SeqID_35133; Location=718..1179; Strand=+
  SCN-specific regions: Sequence locations=1-33,55-462
atggctgatggcaacgaatggaaacgagaaccgcttttccattttgctagaattgtttgtttggatttgatgaaagcggtgagttttaggtcaagggcgtagccagacccttggcttctgagggggtgggaggggggctcaagtcaaaaactcgatttttggtgtatttttctgtttttattcgattttagggggtgtatttttcgttttttgaaatcccgaagtagcgagggtgtattacagaatttttagctttttttcgccaaaaaattactgttttttgcatggtttttcacacgtaattaatttcttttatgatgaatttagtctttgatcgcgtcacattgtgccaatgttatttatgcgggcaaacaaaaagatattgatattgaccataggaacatcaaattaaggctgcaagaaattactacccatatggctgattggatagccaaaatgctg

SEQ ID NO: 64767 - DNA, 606 bp, Heterodera glycines
  Genomic contig location: Contig_ID=SeqID_35135; Location=1..606; Strand=-
  SCN-specific regions: Sequence locations=1-11,33-606
aatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaa

SEQ ID NO: 64768 - DNA, 660 bp, Heterodera glycines
  Genomic contig location: Contig_ID=SeqID_35136; Location=487..1146; Strand=-
  SCN-specific regions: Sequence locations=1-535,557-660
aacaaaaaaatcgattttttcaagtgtccgtttggggtactcaaacaattatggggagcaaaaatccaacgcagaattaatgtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaac

SEQ ID NO: 64769 - DNA, 135 bp, Heterodera glycines
  Genomic contig location: Contig_ID=SeqID_35137; Location=504..638; Strand=-
  SCN-specific regions: Sequence locations=1-135
atgttagtcatagaaatgttgtcaatattcaaacgtatttgcattatttcttactcgatggttgtgagtttattttcaccggccactgcgtcacctaaatttttctatttgctgattttataaaattttcagtga

SEQ ID NO: 64770 - DNA, 58 bp, Heterodera glycines; identical to SEQ ID NO: 50987
  Genomic contig location: Contig_ID=SeqID_35137; Location=802..859; Strand=-
  SCN-specific regions: Sequence locations=1-58

SEQ ID NO: 64771 - DNA, 729 bp, Heterodera glycines
  Genomic contig location: Contig_ID=SeqID_35139; Location=94..822; Strand=-
  SCN-specific regions: Sequence locations=1-159,436-476,502-517,697-729
atgggtcaaatcaaaaaattaatgtgtttgtgcacatctacaaactcttggctttcgaatgacccagggttgtttgggtccggacccgggaagtgccctaaaaagggaggacaagcgacaagcactttggtcgcgatttctgtgtgtcattggttcgatttcttatttttgttttctgttcacttttgttttccgttcaccttttttgtttgccatttttaattttatttatttaattttagttttttcattaattaaatttattaaaataaataataatattgtatttctaattagatttgaattaattaaataaaaaatacaaatacaaatacaaatctatataattaataagaaaaataattttttgagttcataaacgtttttaagttatattattattattttatgaaaacaaataaatttttataaattcttacttacgtgaattgtgcaataattcaaaataggaaaacaaagaggagaggaagagaaagaggacgggtaacagaaataggaagatgagagcaagacgaagagaaagataaaaaggaagaggaaagggaagagaaagtggaatggaaagagggaccgatagaggaagttgaagagaatgtggaagagttaagagaagagaaagtggaagcggaaagagaagaaaaagagaagggaagagaaagtgtaagaggaagaaaaccaggaaagttaatagaaagtggaagattttag

SEQ ID NO: 64772 - DNA, 637 bp, Heterodera glycines
  Genomic contig location: Contig_ID=SeqID_7422; Location=604..1240; Strand=+
  SCN-specific regions: Sequence locations=1-1,45-74,148-256,331 -407,439-637
gttattttaaaacatatttttatcaagaaatatttttaaaaattgagacgttggtatttctataaatgcatatgtataattgaatattttattaaaaataacttaaaaatgaaatgaataatttaagataaataaactaataaatttctgattatagcaaataaaatgaaagctttaacaattaaaagtctagtcgattatatcactcgacaaaattaagttaatagaattaagcactattcaattgcactttgagaaaattaattttttttaacttataatttttaacaatctttaatcttaaatttaattataattaattaaaaataagagatttaatgaaaatacaaaatcaatttaatatgcgatttgccctattgagctattaatatgtgattcctattagctattaattcttataaataaaaaataattaatgagaattgatgttgaacaatacgatcgttaatgagaattcgttaaaataagttaaggtatgaacttaaatcttcattgggataatcgcccaatgaatcaaaatattcaatttctgtcggcaaaacagcaatccagtgttcaagtatcgtgcccgcccggtcggtattcgccacaaaacagtatggaaaatgcctgttcc

SEQ ID NO: 64773 - DNA, 1276 bp, Heterodera glycines
  Genomic contig location: Contig_ID=SeqID_35143; Location=57..1332; Strand=-
  SCN-specific regions: Sequence locations=1-42,67-83,105-185,443 -452,540-721,743-1150,1217-1276
atggactgtgaaaatgcggaaaattatgacaaagtttttgagcaagaaacaaaaggaaataaaattctaaaactacatatgtcaattcttttaaacctcattgatgttcttccggatttttacactttttcgaaagaaaaagcgaatgaatttgcaacaattaaaaaattatgtaagaaaaggcgaaaaaggggaataaaaatatcgaaattgaaaataattttacaattaaaaataattagccaaaattaaaaaaacatttattaattataaaaataattagccaaaattaaaaaaacatttattaattataaaaataattaaccaaaattaaaaaattatttattaattataaaaataattaaccaaaattaaaaaattatttatttaattaattaaacataattatctaaaattaaaaaatatttatttaattaattaaaaatatatccaaaattaaacattttttctttaattaattaaaaattatccaaaattaaaaaaaaattctttaattaaataaaaaaataaaaaatattcagctgaagaaaaaaaggtggccagtttttatgaaaatatttttgacgctcaaaacaccgaagcggcacgtgccaaagagatggaattggcactgatccgtgccatccaacacattttgctaaatgatcagcgtgaaaagacggcggtacaaagtcaaaggcaaaaggacgagccccacattatgtatttgttcatggttttgagtgtgttggatctgttcgacgacgaagtgccggcccggcggactgcgcgaatgctttgcatggcattgccaagtgccaaagagacgacgcccaaggggaaaaggcaacggaatgccatacggggcaccaccattagccaactagtcgaaaagtgtctcgacaacgacatacaaaacattgagcggcaaaccttcgccgatcagcgggaaatgtcagcccaatggcacggccaattcttcgcccattatttgcccaattttccggccaatgatccgctgctgaaacgcattcggcaaacggtgggcgcactgcacacactgaatttgctgatggggggcgatgagttggacaatttgatggccaacaatgaatttgtgccggcgaaattggtggacaaaaattgttggttttttttattttattaaaatatttttataaatgcttaagaattataataatttaaaattttaaatgagtatctaatgcagatcattatggacgggaatttaagtcatatagatcatgaagtttga

SEQ ID NO: 64774 - DNA, 559 bp, Heterodera glycines
  Genomic contig location: Contig_ID=SeqID_35150; Location=384..942; Strand=+
  SCN-specific regions: Sequence locations=1-116,232-559
atgacatttttccgaaccaaagtcttcaaaaatgttcaatttcttttttctgctgatcttcgcttcttctgcccaaaatgcgtttcaacaaaatgtaaaatattgtaaattcgacattattttgtttaatattttattttttttgtctttatttttgatttagaattttacattttagcctcaaaatttgtccatatatttatattttaataaaatttttttttttattttgcagataatagatgcttcgtggggggtatcgaacgataccaagaatgtcaatcgatcactttgtcaatccgttcatccgtcccatctccttaatccatccatcaattaggcccattcgccgtgccgttgttgtgctgttttggtacatttggtgttgccatttcttaatttaaagaaaatggaggacgaatttatttgcataggccaattcatgacaagtttcacgatcgtttttaaaataatttacccatatttaaattatttttaccgataaacaattccgaaatgcctcaaaacgagatcaagcattaatttgcataatcggaaa

SEQ ID NO: 64775 - DNA, 315 bp, Heterodera glycines
  Genomic contig location: Contig_ID=SeqID_35150; Location=958..1272; Strand=-
  SCN-specific regions: Sequence locations=1-101,128-315
atggccattgatcagcaacgtgttgattgcgcaacccgtctcgatcaaattcctttggagacatttgtcagaccgttgccgtgtaacgtaagataaaatcatataattaaatacatgaaattaatgacgctattttcagcacattttccacaaccattgcattgaaaactcggtatttttaaggcttttcgggtctatgttttcatacatgtgcatatatgaagaaaaaatcttttataggttaagaagcggacataaaacatgtccaatatgccgccgtggtaagaccttaatgaatttataattttcaataaa

SEQ ID NO: 64776 - DNA, 804 bp, Heterodera glycines
  Genomic contig location: Contig_ID=SeqID_35151; Location=171..974; Strand=+
  SCN-specific regions: Sequence locations=1-1,23-91,113-301,323-804
cgaattatgaatgaagttttgtcggacattggacatacatgtgcatatatagacgatatcattgtgtatacggacacatttgaagagcacatgtttattttggagaaaatttttgaccgaatacgtaattttaaattgaaattgaagcctcaaaaatgtgaattttgtaagagcgaaattgtttatttggggcataaactaaactgtaaggggtacgagccgtccatcagcaacaaagaagccatacagcatttcccagaaccaggaaatgttaaggaaataaaaagatttcttggactggttggattttttaggaaattcataccaaattacgctgcaaaagctgccccattgacattattgttaagaggaaaggaaaacgagacgaattttaagtgggagacagaacaacaaaaagcatttttggctctaaaaactgagctgacaaagtccccaagcttacgacccccaaattataaaaaagagtttcatttatttactgacgcttcacaaatcgcttggggaggggctttgatgcaaaaagataacgaagggacactgtacgcagttgcatactgcagcaaaatattaagccaaactgaggcacgttacccacccacccatggggagctggcagcaattgttcacgcgattggtgttttccattcaattttttacgaatgtgacattaccatttataacgatcacaaacctttgactttcctgttatccaaaggaaagaccaatcccaaattgaacagatggcttctaattttccaggatatcaacccaacaattaattaa

SEQ ID NO: 64777 - DNA, 88 bp, Heterodera glycines
  Genomic contig location: Contig_ID=SeqID_7424; Location=967..1054; Strand=-
  SCN-specific regions: Sequence locations=1-88
atttgccaatgcgttggaacgtgccctgctggacatgcgcgacttggtcgactgggccgggcgattgaagggacgggcaaagctttga

SEQ ID NO: 64778 - DNA, 380 bp, Heterodera glycines
  Genomic contig location: Contig_ID=SeqID_7425; Location=744..1123; Strand=-
  SCN-specific regions: Sequence locations=1-380
atggcgtccaaacactttgtggaggcggtggccaaaatgccggccaagacgaccatgtccattggcaccattgtggacggactgatggaggcggccattgtcgggcacaaacgctacactggcgaagtgatgaacggtgggcaaattggggggggggaattgttattttccaaaatcataagtataatgacaaggataattcctcgggtacctttatttccaccccgagctcgttttcctctccaatttttttttaattttcaaacacaaatgttcaaaaaaaaataaaaatctatagctatttttatgatgaattgctatactagcaattagtttttccaaaaattttttcaaaaacttgaaattttcttttaaataaa

SEQ ID NO: 64779 - DNA, 443 bp, Heterodera glycines
  Genomic contig location: Contig_ID=SeqID_35153; Location=235..677; Strand=-
  SCN-specific regions: Sequence locations=1-299,322-443
atgtccgcttggatttgtcctgggtttttgctgttttttgtgctcattctgatcactgatcactgtccgatgacccaagctgtcactcaaccgccctatggtcaattggctgtcagtggaaaaaatctagtacaaaaaagtacgaaaaaagccgtggcattgcacggcctgtcaatgtactggagccaatgggtgccgaagttttgggtgaaacagaccgtcaacgtaatgttcaatttttcatttatattaaacaaattgtccttgaaaaatgataagaactaccttagaaatcgaaactatgagttttgtattagaattctgcaatgaaaatttttttcaagaaattgggaatcggggatccgggcctaaaaatggaaaatagaatttgtgcttccatgggttataaatgcattaaaatcggcatatattctaacaataaa

SEQ ID NO: 64780 - DNA, 225 bp, Heterodera glycines
  Genomic contig location: Contig_ID=SeqID_35153; Location=453..677; Strand=-
  SCN-specific regions: Sequence locations=1-225
atgtccgcttggatttgtcctgggtttttgctgttttttgtgctcattctgatcactgatcactgtccgatgacccaagctgtcactcaaccgccctatggtcaattggctgtcagtggaaaaaatctagtacaaaaaagtacgaaaaaagccgtggcattgcacggcctgtcaatgtactggagccaatgggtgccgaagttttgggtgaaacagaccgtcaac

SEQ ID NO: 64781 - DNA, 503 bp, Heterodera glycines
  Genomic contig location: Contig_ID=SeqID_35154; Location=1..503; Strand=-
  SCN-specific regions: Sequence locations=1-192,216-360,382-503
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttttaaaaaatttttctccatcttcctttttgatactaaagcatcagagtgctaaaattaagttgtaaaataaaatttggtgcgctttagagcactttctgaaaaaaaatatttatgaaacaaaaaaatcgattttttcaagtgtccgtttggggtactcaaacatttatggggagcaaaaatccaacgcaaaattaaagtacaggctatagggaaactactcccgaaggattcggtctcccccataaatctgggcgcatcggttcggggggactgccccgaaaacaaaaaaatcgatttttt

SEQ ID NO: 64782 - DNA, 439 bp, Heterodera glycines
  Genomic contig location: Contig_ID=SeqID_35157; Location=394..832; Strand=-
  SCN-specific regions: Sequence locations=1-439
aaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgc

SEQ ID NO: 64783 - DNA, 758 bp, Heterodera glycines
  Genomic contig location: Contig_ID=SeqID_35159; Location=232..989; Strand=+
  SCN-specific regions: Sequence locations=1-395,424-758
atgaagtgtgccagcgatcacccgacaggcggagttgatgaaaattaccactgcacacataacgattcacaacgtggttgggtcagcacttgcacatctttggaactgaatgctgccctggacgagggttatcgggtcaccaaacttttccgcgtattggaataccaaagcagcgatgatcaattgttcaaatcgtacattgcggaatttatggcgctcaaaatccaagcatccggctttgacaccagtatcaaaggcaatcctgagcttgaggaagcgtttgtgagggagtgttatgagaagtttggcattacaatcgatccaacaaagatggagccgaacaaagggaaacgatcgatagcaaagctctgcttgaataacttatgtatgttgtctttaaatatattatttttaaataaatttctagggggtcgattctctcttcgcaactttgggctgtcgcaaacactcatcacagatgaccctgtggttctcgctgaatatttggacaaccgatcgctcgaggtcacagcgatcgacgaattggacgctgaacacatactgatcagttatgagaaaaagaaggagtgggtcgaggaacatgcatgttccaatattggtataataatttatgaaaacaaaattcataattaatttagtaatatctctttggacaacttcggcggctcggctggtattactaaaggcaatgcagaaggtgaaaagggaaccaggctgtgagctactttataccggta

SEQ ID NO: 64784 - DNA, 99 bp, Heterodera glycines
  Genomic contig location: Contig_ID=SeqID_35160; Location=112..210; Strand=+
  SCN-specific regions: Sequence locations=1-78
atgctctcattggtaggtgttgccatttcaactcttcccatggatgccattcaattggcaatggaaggaactaattaagtcaaaatttaaattaaaaaa

SEQ ID NO: 64785 - DNA, 966 bp, Heterodera glycines
  Genomic contig location: Contig_ID=SeqID_7427; Location=155..1120; Strand=+
  SCN-specific regions: Sequence locations=1-160,182-212,242-966
atggtcgaaggtgtagaatattggagatgccctcatgtaagcgctaattttcgagctgtacacacctattatttaagcgccccccatattgtcccggtcgcatttatgtccactctcgttggcatgaaagaggcgaattacgattcaaattaggatggaccaaaaatgaaaaccattctcacaatgaaattttggacaaaaacaaagtaaacaaaaaaaagaattttttatttatatttatcccaaaaattaggtacgaaatgcggctgagcgtttgaggcaactagccagagaagctcatccgcttcaaactagggatgccatagatgaagcaagggccgcactgtctgctgaagctcgtgttactgccccttcttcttctgccatgggaaaagtttttcggcgtgccaagcgtaaagctgccgaactacagggtgaccagggattggactcagttaatcctttggaaatgattgtgcctaattatttggagccaataattttactgaatgagaacatcgaaattgccggtcaacaacgaaaacttattgcctttgccacacaagcctcactccgaatgcttggtacttaccgcagtgaaatttcaatcgacggcacttttaaagtaagtcggagttttttaattacctaattaatattataataacagacagctccgaagggatttggacaactatttaccgttcatactgtaattgactcctgtgccattccttgtgtgtttgcctgtttaccaacgaaacacatgcaaggataccttcgcgtttttgatgcattgcgaatccgaatcggaaactggtttcctcaaaaagtaatgacggactttgaagttgcaattacggcgatgggtgtgatgggtggctgagagctttggatcgaaaatgataatttggctcaaagacaggcattgttcacgattgaggcaattccgttttgtctttttca

SEQ ID NO: 64786 - DNA, 426 bp, Heterodera glycines
  Genomic contig location: Contig_ID=SeqID_7427; Location=1667..2092; Strand=+
  SCN-specific regions: Sequence locations=1-426
atgcttataaaatttttcttaaacgatcattattgcttttcaccgtggtgcgacttttggggatttgcaacttggggacccgacatttggggacccgacatttggggatcccgacatttggggacccgacatttggggatcccgacatttggggacccgacatttggggatcccgattggggacccgacatttggggatcccgacatttggggacccgacatttggggatcccgacatttggggacccgacatttggggatcccgacatttggggacccgacatttggggacccgacttttggggacccgacatttggggatcccgacatttggggatcccgacatttggggacccgacttttggggacccgacatttggggatcccgacatttggggacccgacttttggggatccgacagttag

SEQ ID NO: 64787 - DNA, 687 bp, Heterodera glycines
  Genomic contig location: Contig_ID=SeqID_7429; Location=385..1071; Strand=+
  SCN-specific regions: Sequence locations=1-113,142-350,372-617,673-687
atgacgaccagcgaagggaaagcgacggcgatcacttcgcccggccccccggggttggacgagggcgactcaccgccccaggcgccaacagaacaacagcagaagggcggaccacagcagaaggagaaggacgagaaagagttgcactctctgctgaacaaagaaaaggcacgcgcctgtgagtggtgagttcgtgaaattcgggtcaagaaaggtcggattgttcggttctcgagtttcgggcggcaaccctattttggaatacaacccacttccaaatttatttgcacaattcttttatgataaggtcgtcaatctccgctgtcccgatcattggcaccattctgctgatgttcttctttttccaatgcacatcagcaatgcaaacgaacacggcgggcacggagggcaaacagtgtgtgatgcgcgggatttgtggaaaggatggtgaactgcgtcagaattgccggtcagtaagtcagtcagtcggtggtgtatgtgtgtgcgcatgtgtcaaagtgcaaaaaattcagttaaaacacaattcaaaactaaaaattagaaaatttgttttcggctgggctcgaggtgattttttgtaaactttttgccaaaaataacaaaattttcagtgtttttaattaaaaataatgtgttttatttcaatttcttcaacgatttcattaa

SEQ ID NO: 64788 - DNA, 527 bp, Heterodera glycines
  Genomic contig location: Contig_ID=SeqID_7429; Location=1287..1813; Strand=-
  SCN-specific regions: Sequence locations=1-26,69-223,245-268,290 -356,392-412,438-527
atgaggttcgtaaaaaattttctatcttaaaaagaaaagttattaggtacataaattttggaaaaatttgaaaattaagatcactgttttaaaaaaaaagtatatgaaaagaaatatacataaaaaatcagcaatttttagttaaggattagtaaaaggctcaataaccattcgttttttgactctcgtcagagggaaataagaaaactgagttgcacggttggttaaaatgggtttttgggccatgagttcgattccacttggctgcaaatatttttaaaaattgtttcacgaagttttgggaccaatgatcaagcatttgacattcacttcgactaattcagaaccctgacccgaactcaaaaaatccaaaataattttaaaaagatttacaggcaagcggatctgaacccttggcacaaaaagcccatttttaaccaactgtgcaattgtttcacttagttgcctctgtcgagaatgggcaaattttcggtttttgaggccctttcaactccgaactgaataaa

SEQ ID NO: 64789 - DNA, 430 bp, Heterodera glycines
  misc_feature (412)..(412): n is a, c, g, or t
  Genomic contig location: Contig_ID=SeqID_35164; Location=454..883; Strand=+
  SCN-specific regions: Sequence locations=1-8,32-430
  Gene Ontology: Mol. function=glycogen phosphorylase activity; Biological process=glycogen catabolism
ccctcgcccacaccgtccgcgaccatttggtcagccgatggattcgcacccaacagcactattacgagaaggacccgaaggtaaggccattcattcccacgttcgattgcatcgttttcaattggtttcagcgcgtttattacctttcgttggaattttacatgggccggactttgtccaacacaatgctcaatttgggaatgcaagcgacggtggacgaagcgctttaccaggcgaacgaccgcattttatattacgaattaagtttatttggcattccatttcagctgggcctcaacattgaagagctgcaagagattgaggaggacgccggccttggcaacggcggactcggccgactcgccgcctgctttttggactcaatggccacgctcggcattcccgcctatgngtacggactgcgctatga

SEQ ID NO: 64790 - DNA, 266 bp, Heterodera glycines
  Genomic contig location: Contig_ID=SeqID_35168; Location=518..783; Strand=+
  SCN-specific regions: Sequence locations=1-12,44-45,67-228,251-266
atgattggccctccaccgccgccgccgccgccgccaccaccgcaacaacatggcaccggagggggcgctgctggtggtggaccgccaccgcaacagcaacaggtgttaccgccaccgccgaagaaaaatgtgttggatggtgacgggaaaaggaggcaaaatgccaataaaaatgatggcaaaaatgccaaagatgaagcagctgcacgaacaaagcacgtcattggcagaaattagcttttatttgctaaaaatgtaacaaacaa

SEQ ID NO: 64791 - DNA, 160 bp, Heterodera glycines
  Genomic contig location: Contig_ID=SeqID_35171; Location=274..433; Strand=+
  SCN-specific regions: Sequence locations=1-160
cgattccctttggctgttgaagagggctccgctcggcgtcgtcgctggtcaacaaatggacgaagcgggtcaggagatgaacacggcgcactgttggcaatggacagccgggcacagtgtgctccgagtgcaattcgaagaccgggacattgggtactaa

SEQ ID NO: 64792 - DNA, 2191 bp, Heterodera glycines
  Genomic contig location: Contig_ID=SeqID_7430; Location=217..2407; Strand=-
  SCN-specific regions: Sequence locations=1-350,372-1251,1275 -1322,1353-1613,1642-1663,1685-2149,2171-2191
  Gene Ontology: Mol. function=lipoprotein binding; Cellular component =integral to plasma membrane; Biological process=receptor mediated endocytosis
atcccattaaggcgttggattgagagcaaaatccatggacatttgggagaattggctgtacctcagtgatccgttgtccaatggcattttccgcatgaacaaattcacgggcaatttctacgaaagtgtggcacctgatcatcgcttgccgggaactgtgcgcatttttgccagcgaatcagacatcaaaacgcgtaatcaatggtaaaaaagagttgattcaacgtattttatttaattttatcgattaattaacggattatttttaattaccgactaattgacatttactgggtaattaccgatcgattaattgaccgatttttgtttaatcaccaacttattgacattactgagcctaattaaaaggtgcaatgagcggaccagtcatttgtgtgccaaaaacaacggtggatgtgatcagatttgtcatgtgatctccgatgatatgggcactccggcacataaagtgcagtgcagctgtaatgacacctatcaattggtgggtgcttatcatcattttcaatggcacaaataaatgccaatgtgggtaatttctgtagctgggagaatgtatttcagaaaaaaaaccataatttccaaaattttaacattttctagaatttccaaatatcattaaaattttttgttttccttacttaaaattttaagttaactaggtagtatcaatattttagtcctctcctcatccaatacttcaaaaaagtcagaaattttttttaactccaattttctcaaaattagacttttatctttctatttgtttttgttttttgagggaacgaagggaatcgagaacgaatttaggctgaattttaaaaaataaacttgtctggtacttgctgggtcaataagcgcccgtccgataaatttttttagtgagtttcttaaattttaaattagaaaaatgctcgagggtcttggcatcgagtcacaaaatggtatctcttggcaatttttacactgatcacttattgtcaggtgaagcagccgggcgaagacattgccacccaatgtgtgccgaacgaagcggcacgcgtcagctgcgaaggcccgtacaatttccaatgcgcgtcggacggccactgcattgcgctggacaaaacgtgtgacgcgcgggcggactgcgcggacgggtcggacgaagcgcccagctactgttttgtgcgcttctgccccgagacgtactatctgtgcgcaaacaggcgctgcgtgcaggaacagttgcgctgcaacggggtcaacgactgtggcgaccggtccgacgaaattgattgcagcttgcccactcaaaaaacgggccaggaaggcggcggcagcggaagcggcggcattggcacgggcacggcaatggtggtcaacacggtgtgcccgccaggtgattcaatgtttaatgatgggatgataattaattgaggagggtcaaacgaatttaaaatctcgactcggtgggcataccgtgattcaaatccccgggatttgaatcccgatatgttgtcaggatcctcaagtcggcatcaggacgaggaaagcccgacggggtccctgtcccatccggattctatagtcgaattcactgtttcaatactctcgaaccaattaattaattaattaccccactcccaaaaattcatcaggttcatttgcctgcatgaatgggcattgcatcaacagttcacgcgtttgtgacggccacaatgattgccatgaccaggaagtgtcggatgagaatgccaaaacgtgtcctggactgcctattgattgtcgcggggtgcgcaagaagtgcccgaacacaaacatttgcatacaggtacggtatgaaagaaaaatatattgtatattgaacaaaaaaatcctgtatttcctttattattaaaaaggttaataactgtaattttgagagaaaacatattttaacatatgaatcctatatcatttaaaaggattactattatttgaaatagttactgtaatagtgagcatactgtatatacaaattcaatttttacattattacttatttcttttttttaatatacatatatttacagcctgctgatttatgtgacggatatgatgattgtggcgatcgtgctgatgagcaacaactgttttgcgtaatgccaacaaattaattaattatttatttccaaacccaagggaattgcct

SEQ ID NO: 64793 - DNA, 1643 bp, Heterodera glycines
  Genomic contig location: Contig_ID=SeqID_7431; Location=1049..2691; Strand=-
  SCN-specific regions: Sequence locations=1-45,136-352,381-497,531 -663,686-713,781-871,905-985,1018-1088,1112-1124,1146-1378,1421 -1450,1472-1498,1520-1643
atggaaaagaaggttaaacaacgagttataattaaagtcattttgtatttaattatctaaatttattaatccaattattaatttaaataacaaataagtaatttttctgctaaaaatttaaataaaaaaaaaaaagcaaaatatttcaaacgcctctctctttgtttgatatagagaaaaagcgttttattcactcactcattggggcagcgttttaatatgatatatagttttctcaaatctcaggggtcagaaaacaatgctcataatcagccaaatccctacacataaagcccgaaagtccaatgggggggggggtgttttggcactatatggaaagtgaccagttttgaaaagtttttcaaaaggggggacccttttattttgcaaaattttttttgtgatagtcataaaaatttattctctggagtttttggggtccccgatcacgaatccttcaattattttgatcaattccgatttcctaatctaaatttgaacaaaaaatcataattttaaaaattcaaaatttcgatttttattcgagttcgggttagggattagaaattagtcaaaatacatgtcagattcgtgattagcgacctttaaaaccccggataaaaaatgatcatggttttttatcttaaaaaaattttgcaaaacaaaagggtccccccttttgtttcaaaaactgtcactttccatatagtgccaaattttttattaaaattaaatttataaatttcactattcataaaattaaaaaataaataaattattcagaaacaaaaaatatatgtttgagaatttctatttttttatagaagaaataatttgaacgacttaaaactgtcgaacatttcaacaattgtttataataatttgaataatttttttttaaattgcttactaaaaataagtcatcgttgtcaaaacataaaaaaaattaatggaatttttttgtcgcaatttaatttacctatgcaatttccattaaaatatttttaggaaaaatttacgcctacgacacgcgaggagaccatagtgagttttttttatcgttagtacaattaatttaatagaatcacaattatatttaattttaattaatggatgttggctactttaattaaattaattattttctatcaattatccccaaaggaaaaatagttgtactttgacgccttaattaattaagttgtgacaattgccaccggtgattggacatatgcgttggcattggacccgtgtgctggctatgtgttctggtcggacagcggctataaggtggtgattttagtaatgatgcacgagatataccgaaaatttgccgagacttgtgtgactgagactaaatctcggacatcaaatcacgatttaaatactttaattacaaatattttaataatttttaattggagagaatttggtttattctaaaaaaaattccataaaataaaaatattttaggtttttcttaatcattgggatttcatgactacaaaattgcatttaatattcagcaatttatttggtacacatcttaatataattattaaaaaagaattgttgctattaaaaattttgttttgtggttcattagagaaatcttataagaaaattgtaaaataataaataaa

SEQ ID NO: 64794 - DNA, 1734 bp, Heterodera glycines
  Genomic contig location: Contig_ID=SeqID_7431; Location=2969..4702; Strand=-
  SCN-specific regions: Sequence locations=1-43,65-106,145-158,193 -459,482-601,624-1058,1080-1126,1148-1242,1265-1266,1289-1311,1347 -1626,1667-1734
atgcgctcgcacattaatgagtttaagatcctgttcatcaacatcctcgtcctttacttcttccattctctgacttggttcgtctactttttgcgatatcgggtaatagttaattaattattaattaatgaattattaattaataaaaaatgatgacatcattttccaaaattaaaaaattcagttgcttctcttcttttacaccagtacgtgtgatctgctgagccccgtttggatggtccccgtttttatgggcccttaccaagtgtattccgtcgcttatccgtctctccatttcgctgttactttcgaacgcattcgagcattgtttttggtgagaaacttcgcaaaatgccccaggctttctttgtttggttccatcccaaaaaaacattcataaaaaaggcaaaaagcattcatttgagagattagggacacaatctctgagtaccaaatgagaaggatattcacatacaaaaaaggagacacttgcttggataattaattaggtgcacaattatgagcagatgggcccgaaactgatcatcgcaatcatctgcgccattgtctgttttaccaattgctgttaattgtttcggttattaattaaccattttgaaatatcccaattcagtggcttgcttctttgctgtatttggcgtgcattgtcggcttggcacttgccgaccctcaaatctctggccacccccaaggcgtcgtttacttgacctccgattacaatgccaacctgattttttgggccatgcttttcacgatgcttttggtcgttgcgacggcattgtgcgattggcgcatttatttgctgaacaaaaggctaaaccgggtcgggaatggcccatcgactgagtacaacctcagtctgaagtaccaaatcaacgaaaacaccctctccatgatgctgatcttcccgatggacttgctttacgcattgatttatcccatatacaatgttattgtgctggtccttcgcgcctaccggcaaatgctttcaaccgccaattacgtctcctattaccatatggcgaatacggtatggtagagacagaaataaactgacaataaagcatacggtaagtttataaaacaaattcccatttttcagttgcttttcctgcattctctggtcacccttgtggtgtatattcgatttatcaaatatgtcagccgcgttcgaaagccgagcattgtaaaaagtcaaccgaatgaagaagcaaatatacacttcaaacaattgcaagcgcaatggaaatgaatttttaaatgttttcaattataaaaagttgacgaattaaaagtcattaggcatttttcatttaatttgtttttgcaaaaattaatcaattcgaatcaaagaaagtgccatttctgtcaccttaacaattgtttttgtgccgttctcaattcttttctgattggcattgggcaggccaaacgcattggtccgtctgcgaattgcgcagcattcccggcacacaatcgcacgagcaaaagcagtgcatttgcgtgcaaatttcgggcattgggttgtcgcaggtcggctcgcacccggcgcaacgcaattggccaatttgttcggaagaagagcactgattgaaaatatgagggaatattataataatattgtttattattagtttataaaaaagattggatttagtaggtgaaatgccgcaaaaaatgacaatttttttaaatagattacacataaataaa

SEQ ID NO: 64795 - DNA, 396 bp, Heterodera glycines
  Genomic contig location: Contig_ID=SeqID_35172; Location=35..430; Strand=-
  SCN-specific regions: Sequence locations=1-50,124-187,305-375
atggttgagacatacaccgacttggaatcaaagccaaaatttcacacatgtaaataaattaattaaaaataaatttagaaaattttaaaataattttaggaaaatgtaaaataaaaatatattcaggcaacatcaatgcaattgcattgcatctacagatcaaagctgaggagcggtaagttctttcatatttttatttttatttaattgaaaaaatttatttataattaaaatattactctttttttttgtaatttgactgtttttttattcattaaattaattttaagtaaatttttaatttgcattttttagctttaatacttcattcgaaactgtggcagcctttgacgattttgcacaaaaagttatcacaaaataaatatttaaaataaa

SEQ ID NO: 64796 - DNA, 761 bp, Heterodera glycines
  Genomic contig location: Contig_ID=SeqID_35174; Location=1..761; Strand=+
  SCN-specific regions: Sequence locations=1-89,111-289,311-713,737-761
caaatgttttcatgccagaaaacggtttcgtgaactgactgagcccgtcaaggcgttgttggctctgctcaaatacccgttcatcatgctccttctcctcctgctcactgtttttgtcccctctctccaaattgctctcattgtcaatgtttccctttagcttctcactgtgacgatggtattgctcaacactcttcagttgttttttggcttcaaagctcttcccgcctatgtgcaatatatggagcagtatcgccacactttgggcattttcggagcgttgggcgaaattgccattattttgtgagtttattttggccatccccttcactttctcttccccccccctattcaggtacattatgctgtcttcgcttgtcggcctttattctgtccctttgatccgtcgccttcagccacgtcgtgggcacacttcgatgactgccataatcactaattgtgtgatcattctcgtcctttcttccgctcttcccgtcctcgtcagaactttgggtgtgtattcactaccctccccaaattgtttcccttttttgggtatcacttcgtttgatctcctcggcaattacggccgaatccattggatctccaacttctctcttgtctgggggtacaaccttctcttcgccgccgcttccattttctgtttggccaacaaatttactcagcccgtccgtcgagaattgcttcgccggttttttctttgtttcttatttctcttctaatatattttaggttcactg

SEQ ID NO: 64797 - DNA, 324 bp, Heterodera glycines
  Genomic contig location: Contig_ID=SeqID_35175; Location=169..492; Strand=+
  SCN-specific regions: Sequence locations=1-324
aaaatgccttctccgtccgtctctcttctcagcatcgtcgcaattttctgtttgctgtgcaaatgttgcgtttcggcaccgcgtaattaattgcttttaattagctgtaattataaggaattgcttttctgcagatccgtgctgtcccggcagccaaaaagtggcttcgttgttggttaattacgttggtattttccgccatttctcttccaagtcatcgctttgttcggatgtcgacagtgttgcggggggattgaaaggccgtctgatcggcggcacgaacgggggacacgccactcccttggccgacatcgaatcacctct

SEQ ID NO: 64798 - DNA, 279 bp, Heterodera glycines
  Genomic contig location: Contig_ID=SeqID_35176; Location=679..957; Strand=-
  SCN-specific regions: Sequence locations=1-279
gtccgatcacttctccggacaacatttctcagctttgcactccgtcaaacccctcaccccctcagggcattttaagccttccggaatttgccaattcgtaaaatcaaacattctctcatcataatacattttctcataagctaccaattggacattatctccgcgttgcgaggcaatgagcacgatttcctggcaaaggcagccattgcggacgcaattcgagcagttcaaagtgatgaggacaaaatggaactaattgatttcattgcgtcagaagaa

SEQ ID NO: 64799 - DNA, 283 bp, Heterodera glycines
  Genomic contig location: Contig_ID=SeqID_35181; Location=336..618; Strand=-
  SCN-specific regions: Sequence locations=1-123,147-244,266-283
aaaggatatatacctcattatatgcgatgaaattcttgaaattgatgaagtcaaacgccacaagaaaccaatgcaatacaagttacgcgatgcaaaaggagagaagttcaatggatttttctatccggaagaattggcccccgtacgtagagatgctgaaacaacttacagaattgaacgcgtttttcggaaacggaaaatgcccgacggaacaatggaagtgctcgtgaaatttgtaggatacccagagagagaatggattcatgagactcaacttgtataa

SEQ ID NO: 64800 - DNA, 474 bp, Heterodera glycines
  Genomic contig location: Contig_ID=SeqID_7432; Location=1735..2208; Strand=+
  SCN-specific regions: Sequence locations=1-226,250-474
atggtggtcaaattcgatgttcagacggattcgcaaaaatttcggttaaacccagggtttctatcgaaaatttttcaaaatcaggacatcgggcccaaaaaatcagattttggagtcgaaaatcaggactttttgcaaaattgcttcaatggaggtagtccggcggtgccgacaggcgccgccggaaattttttttgatttgttaacagattttcaccaaaaaggccattttttaaattaaatccaatgccataaaatttcaaaattattgagtttttttttaagaaatcggaataatttcgtcgctaccccaaaatcagaacattcttataaataagaacaaatggaagccctggtttaaaggcgccagcttggactcactcatactggcgctaacgaaatcagatgattaaagtgaaaaaagggaagatttacgagtagtgaaaaagaaaaaaatttattttttgtgttaaa

SEQ ID NO: 64801 - DNA, 1690 bp, Heterodera glycines
  Genomic contig location: Contig_ID=SeqID_7433; Location=803..2492; Strand=+
  SCN-specific regions: Sequence locations=1-290,312-614,637-758,780 -1690
atgtttccgtattttgttacgcctctcctactaattaccctaattattccaacatttgtcgtcgtaaattcaaagtcgtttggtaacatcagcgacaaatacaccattcatcctccaggcccctaccatattgttgttgttttctatgttgccggtaattttgagtattgtactgtagattgtttcatttcaatcatttaaaaataaaaaactacggtaattttaattcgtaaacattttattttaaattttttgttctgttccatttgcgcgaatttgtggatgttcccaaaaaaaaaaaaattttttttccacgtaattaagaaatccatccggctctaaacacataatccgagttggaatccgtaatttttaaataaaagtgtcatacttttgaactgacagtgaactgtaatgcagtagggacgtgtcaaaatgccaatttccgacatttttgggcacggaattccgatttttaatatttttttgaggttgtcggcacataccccagaattccgacttccgagttctgaatttttttttttttggcacggatttctgacttatcaaagcgagtttttagcacataaataatgttttggacttttagctgacaaaaaatgttttctgctttttagcaaatattttggcgatttttggcaaatataaatccgggctctggtggattaaacaaatttaattttttagatggccatcagaaagaatttccatttgcaactgatgagaacggcagaatcaaattgtcatttaatgagaaagtgttgaaaaaacgtgccaacattgacaaagaggacaaaaatcttcactcatacatagcatttttcgaacggtaggaccctagcaaaattagtacataccattcgaaagcctctgatgggataagcccaaaaaagggaactttttgagccggtttataactcgaaaaacagtgaaaaacatgggacaaatgagtcccagtgaaaatggaacccacttcagtaccaatgaaataattaatggaagcacaaaaaagggtgctgctgggtcgtttcgttaaaaatgccactatgcgcatttcatgcaagtgccaaacaaagaaatttttcgagaaaaaatcgacatacaaaaatttccacgtacatactatgtgtatgaaaagtctataaaataatatagaaatttaatcgttttaaaaatcccccccccccccccggtttaagtaaggagatccgagatgacggctccaccgtcaaaatagcggttcatttgcgcaacagtgcaaatgaggagcgacttttgcatcccttcgaaatgtttaagtataatgaagcacatgagactgaattggttcgaacatttggcaattatgcccttttcatgaaggaccgaaagtataatgagtgtcgattgcacgaagtgtttcaaatcatgtttgatcgtcttccattgctgacggtaatcatcattagggatgcaatttttagtttttttcactatttttttgctgttaactcccagtgacctgaaaagcacgaaaaacatggcttttttggtggttgttaagctagttttcgagttattagagcctattttctagttttttatttttagcacttcaaaaatttttgaaaaaaaaattcttttttttaacaattttggcgttttgccaaaaatttataacaaaaatgca

SEQ ID NO: 64802 - DNA, 2760 bp, Heterodera glycines
  Genomic contig location: Contig_ID=SeqID_7434; Location=1055..3814; Strand=+
  SCN-specific regions: Sequence locations=1-656,678-897,921-1067,1089 -1527,1549-2270,2293-2481,2509-2623,2647-2760
atgcaacagactttccgcaatgaaaattttccgcggatcagtcagagtcaaaaccgacaaaattgttacaattgtggtcgtttcgggcattttgcccgacaatgcaattaccctcggcaagttagaactgaaaatgctaacattggtactccagcgactggtgccaacaaaacatcagtcgaagtgcctaaagacacgtcacagccacaatacaacaaaccgctaccgttttcaagaaattatctccgtcaaaattttcttgttgaacaacaagaaaatcctccaccgacgtcacaaaattttttgattggaggaatttcaatgagtaatgatgaattggagaaactttttgaaagagacaaaagcgttgaagctgaaaatagtcgagcaaagttgttgaatgtctctgttggtaaaatcgtggtcattaaagtttctgtttgtgatttatcagccacggccatgttggacggaggagcacaagtttcacttgtgtcctttgcttttttctcgaaaattatgactgagaaaaacctcgataaaattcaactttgtccgacccggaaaagcactcaagttgttgacataaacgggaaaacagtagagtatgttggagtcgtgtcattgccaattgtcagaaaaaatactgaagtttggatcagatttcatgtgacaaaagcgtcatttggttatgaatttctttttggcaccaacgcattggctcgtttgaatttcaagctctatgatgggcaaaaccaagaaatgataagtttcacagaggttgacagtgaagaaaaaaactcggtacatgttatctatagaacaactttattaccgcaagccacgactttggttgaattggctagtccaatgaattttaaaggggaaaacgtggctgttttcccaaattcagaaaaagaaataaagattgagccaacactcacggtttccgaaaaaggaaaactgattgtaccaatcaccaatttttcctctcttccgataacattggaaaaggatacacatgtcggaaatatcgaattggttgaaaattttggcgaaacggaggacttttttctgtctccgttaattgcgtattgtcgtcaacaaaacgagccgagccttgctcaaatgagtgagcaaaatgcgaacaagttggacactatgagagaaatttgggtgccaaaaataaaaaatctgaaagagggccaaatccgaaatttggatgaattagtccgccaattcgaaaatatttttgccttatatatgaccatgagttaacgcaaacaagtttggtggagcataacatcgatacaggaagcgcagcgccagttaaaaatcgaatgagacccgtcccatatgcttatcgggaaaaagttgcggaaatgttgcgagattatttgggccgtggaatcattaaatcatccatttcgccatgggcgagtccaattgttttggtgccaaaacgcgacggaagtttgcgattttgcgttgattacaggggaattaatgcagtaacgaaaaaagatgcatttcctctgcccaatattgactatatcctaatggcgataggtggaaaaaagttcttttcaacactcgattttatgtctggatactggcaaattcgcatgagtgaagactcggttcaaaaaactgccttcacaactgaatttgggcttcacgaattcaccgttctaccatttggtttgtgtaatgctgtcgcaacatatcaacgattcatgacaagacttttcaacgaaatggttaatgatttcgttttcatttatgttgacgatattttggtggcgtctgagacttgggatgcacatctgaaacacttggagcaagtttttgagcgagtcgagcaggctgagttgaaattgaaaattgacaaatgtcgttttgctgccgaagaattaccctttttgggtcatatcctaacaacaaatgggataaaaatggacgcggataaaattcgtccaattcttgaacttccacttccttcctcaaaaaaacaattgcagtcatttcttggattcatgacatactaccgtaaattcatttacggatttggatctttggctgcgccactcttccatctcattaaagaaaatacaccttttgtaatgggcaaaaaagaacagaaaattgttaattttttgaaaagaaaagtgttagaagatgttgtgttgtattttccggactttaaagtagctgcggaaaatgcgttgaggcgatttatcattttgacggatgccagtaaatttggaatctcagcagttctctgccagcaggacgaacttaaaaatgttcgcccgatatactttgcttctcgccaatgcaataaatataagagtaaatactgtcctactgaactcgaagcactggcaatccgttttggaactcgaaaattttcacaattcattacgggtattccatgccgtgtgatcaccgatcataaagcattaattcccatgtttcgaagtaaaaaggaaacgggaaatgcaagagtcgatcgatggctgatggaagtgaacgctcgttaccaattatctgttgaatatcagccagggaagcagaacgtggttgctgaccttctatctcgagttggaaaacagtcagacacagaaaaaatggaaaatttgttagatgattgtccgtctgaggtagttgttatcaaaaaattgtctatcaaagaaattaagacaaatgctgacattgagaaactggaccgaaaagagtgggttgaacagaccaaaagca

SEQ ID NO: 64803 - DNA, 899 bp, Heterodera glycines
  Genomic contig location: Contig_ID=SeqID_35193; Location=59..957; Strand=-
  SCN-specific regions: Sequence locations=1-205,232-408,436-496,518 -609,631-680,703-796,825-833,855-899
atggcaatctctggcattgcagcacagaagcagctgttacggttggccattgaatcggaggctcgtaaggataattaactaattcattcttttaccgtttccaactttcaatgaattttcgcctcggtgtattaaaatgtgaatgcctttctaagaattgggcaatttttgaaaattggaatcccaataaaataattccaccttcttttaatttttttatttattttaaatgcctttttaaattaatatcaaagtgctctttgcttttttcgtttttcttactaattgttttatatttttgttatttctcgcatttttcgcgctcattttgatatttccttggtgttggaatgaattattagtaatcaccgataatgaattggtcagcaatttatgagaaagacttccataaaatatatataaataataataaatgaaatgcattcgaatgcattaattaataaaatttcatttggatgctgctttaattaatcccatttttatttcttcaattttcccaggcatattatttttcccatttatttgcgcgtgtcgaatgacaattttcttctccgccgaatatgccattcattcagcaacgccaaaaaggacagaaaatgcacttttcggcaaaactcattcgttggaagtgccgagacgacggacaaaaagtggcaaagcaaagcaaaaatggtggaggcaattagccaaatcattgccgacgatttgctgcggaatcacaatttcgatcagtcccattaaaaggggaaaatgagaggaaatgataaatgcatgcatttttaaataataataattatttttatctgtaaatattgtgataaaattgataaaaatgaaaaagagagtttgatgagtaataattattcggtcggaataaa

SEQ ID NO: 64804 - DNA, 49 bp, Heterodera glycines; identical to SEQ ID NO: 51181
  Genomic contig location: Contig_ID=SeqID_35194; Location=310..358; Strand=-
  SCN-specific regions: Sequence locations=1-49

SEQ ID NO: 64805 - DNA, 473 bp, Heterodera glycines
  Genomic contig location: Contig_ID=SeqID_35195; Location=1016..1488; Strand=+
  SCN-specific regions: Sequence locations=1-74,96-195,227-473
atgacatggactgcttgccaccagcgtcatgcaacaagcgctcgcgcgtttgttgcgtgcaaccattggatcaggccccaccgcctgttggctgccccaagggtatgttgcctaattagctaattccaataagtggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctga

SEQ ID NO: 64806 - DNA, 695 bp, Heterodera glycines
  Genomic contig location: Contig_ID=SeqID_35196; Location=4..698; Strand=+
  SCN-specific regions: Sequence locations=1-510,532-695
  Gene Ontology: Mol. function=acetyl-CoA C-acetyltransferase activity; Cellular component=mitochondrion; Biological process=lipid metabolism
gatggcattgtgaaagatggactgaccgatgcttacgattcggtgcatatgggcaattgtgcggagaaaacggcgaaggaatgccaaataggacgggaggagcaggacaattacgccattcaaagttacaaaagggctgctcaagcatggcaggcgagaaaagaccgtgactcatttagaaacagcaatttcttatattgatagaatgggcaaattggacccgaaattgtaccagtggagataaaaacgcgcaaagggactttcaaaatggagcgggacgaggagtacagcaaagtggactttgacaaactgaaggcattgcgcacagtcttccagaaaggcgagggaaaaaaacaaaacacataagtaatcgttaaaatgtttttttttcttccacggcccctgacgcttaattccgatgcataagaagtgataaataaaaaataatccccggccacttctgaatttttaagaggaactgactaaaatttttctttaactttagagaatggcacagtgactgcgggaaatgcctccacgttaaacgatggcgcagccgccgtcttaatggccagcgaggaaaaagcggacgcacttggggtgaagccaatggccaaagtaatcgcctacggagacgcagccacacacccaatggactttccaatcgccccggcgcttgtcatccccaaggcact

SEQ ID NO: 64807 - DNA, 588 bp, Heterodera glycines
  Genomic contig location: Contig_ID=SeqID_35199; Location=1..588; Strand=+
  SCN-specific regions: Sequence locations=1-588
ttccctatagcctgtactttaattctgcgttggatttctgttccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttg

SEQ ID NO: 64808 - DNA, 667 bp, Heterodera glycines
  Genomic contig location: Contig_ID=SeqID_35200; Location=163..829; Strand=+
  SCN-specific regions: Sequence locations=1-448,486-667
atgcgatatgctcggcaccatatcgagaatgccgaagatgtcggcgacgaacttttgcacggaccaaaagagttggcagaagtcgacgatacggagtgtgggattgcattctgtcgggtaatatccgtccgataatgatcagtcatcgtttaaaaaaaaattattgcgtccaaatattttcgttagtgccgtttaattggtaaaatagtgcgttggagatgaacattgcgattatgtaccgcaacgaccgcgagcagttcaacaagaatgcccgttaatgggcccagaagcacgcctgttactgttttccatttcttttatctttccgattcccatttttgttggttttttctcttatcatttttctcacaatttgcaatttttttttccaaaatttcaaccctttattgggtgcaactcgtccccttcccccctccgaaaaatttcgtaaaaaattataatagaaaaaaaaaatttttttttttgacacgaaaatctcaagaaaaaaattttcactgatttttggaaaaatttacgtatgtgtgcaccctattcttctcttttcagtaccttgactgctttatctttttgatttgctaaaaaattgatttatgtatttcagttattactgaaattcgatttaaagaaaccaaagttaacaacgtag

SEQ ID NO: 64809 - DNA, 458 bp, Heterodera glycines
  Genomic contig location: Contig_ID=SeqID_7435; Location=226..683; Strand=-
  SCN-specific regions: Sequence locations=1-119,142-177,200-256,278-458
attggactcttttgccgatttgctttcacatctttttgagctgatggaccaatttctggagggaagttcgtgtagcgaccttttggcggaagtcatccaagaatcactaaaaaattgtatacccttcctcttcccctttctgacagagtctaatgacaagtttaacaggtgttctcgtctgtgaaaactttggcgtttttcgcgacaatttggccgaattgcacggccaattgcaggaaaggctaaacgcactggcgaaaaaacatgaaattgcttcctctgttggcacaataaaactgagcacttgaaaagggataaaagaaggagatgaaagattttttgattccacgagctaatggctccccaaattaatgtgatatttgtgatacccatgatttcgcacaatatttccaattgcattgtcatagtttgtaaattcaattgttcctttgaattac

SEQ ID NO: 64810 - DNA, 2915 bp, Heterodera glycines
  Genomic contig location: Contig_ID=SeqID_7436; Location=147..3061; Strand=-
  SCN-specific regions: Sequence locations=1-623,645-1801,1823 -2037,2061-2246,2273-2760,2824-2915
  Gene Ontology: Cellular component=mitochondrion
atgactccaacttctgaggaatgccatgtctgcccctccgaagccgctggcagcgacaacagtcgctcttctgcctctccgccggggcttcaacagcaaaagccaaagagtcgcgctgcgtctccccccgtggacactgcgaatccgccgctcaattcgccaccgtcctcacaaccgcttcactcccgactagcgtttaatggcacaacttcggccaaaatcaatgacacagcacgacattggaagcagtggaattcatcagaggaaatggcacttgcatttggcgagaataaaaaggcacaaatggcggcacgggcgatgttcgacctggtgcatcaatacggggacaaccttcgagaagttctgttccttttcagtagaccgcttcgaacaggcgcacattttacagtgtttagtccgtccttttccatttagggatggatgaatgtgttggattgtcttctttacatgctcaaagctaatcttctgccgtctcctcttgtccaattggaagattttgtggagctgtccggcttcgtttcgcttaaacattgcttcaaacgccgtccgactgcaccgaaaaaggaagagagcggactcctcagttggctcggacttacgggcagttcagccaccggcggcggagaatcggggcaaagccgaccacaaaacgagcaagagaaggagttgagcaaggctagaaacaatcacttagattaggtcgtttcataatcattgtcctattcggttagttgacaaactttcgaattgttacagctttctaaagcctaaaaagtacaaaaaataacaaaaacacgcgcaacaaacatctcatattctcaagcttaacaatgaagtttagatataacaatatttatggaacaacccaatatttgttgcacctttatttcatatcgagtcttccaaattccaatttcagttggctgctaatacagttgccgagtgtcaccctgagcaaattgtgctggacagtcgctatttggccagttcttcgctcactgagttagtcaattccatcatccattgttctttcaccgtggcacccattctctgcactttgcacggaccgacacatcatcaacaagataaccaacagcaacactcacaacacgaaagccaaggttggttgacaggtcgaaaataaacgtatgaaaagcgctggtgcgaacgaataagggaagacacaaaggggtccggcacaataccgacaggcactgccgaaaaatatatgacaattttgattatcttattgtgcggtggggtaacataatgtagcgtaccctttggaattatgtggaaagtgttagccattaagacgaggactccttcgtcgacttgtccaatgtcgctgtgccccctgccgaaatgcttcgccgcgcaccgacagacggcactgagcaacaaccgctgcttcgtcaggcggcgggttccacactttccattgagtcgacttctgacgaccgcacttcgccccaccactcgaacaacggccttcagcaaaatgggccatcggtggtgaaactgtcaccggaagaggaagaggcgatggtctttttgcttgaattgatggtgggtttcaacacttaattttttactgaaaaggtaataattccagacgaacattgtgctggagaatcgagacaggctggcccaagtgtggtctccggtgcgcgaccacctgcgcactttgctttcccacttcccacacaaccaacaactgatggagcgtgccgtcgtgtccattgtccgaattgccaatcggaatctcttccgtttaggacaacatttcacaccaactccaattgaaaaggggaaacaaacttcggaagcggtgatagcaccgaatttggcaagacaaaagcaatcgcagcaaatcattgccggacaaaacaaatgcgtggtgattgtggtggacccaatggacgacgacaaacagcacaagcaacaacggggcgacgtgacgaacaaaggcagggcatcgataataaacaaattgaaacgttaatttttgtttataaattggatttttatttcagattcactggtttccaatcagcagactgtccaggaccgcgccagcaattgtgccgacgaagtgctccatttcatgggctgtgaactgttggcacttcgaccacccgaattgtttctgttctcccgtcaaattgctttcggtctccatcagctcctccgcgcaaatgctgccaatttacacgcgagcgaacattgggaaatgtttttcatacttttggaatctgtcggcgcggccgcttaccgcgacgaaatcgacggggcagaaatggtcgaggtgtgtttcaggcgctattattagttgaaaaacaactgttcggctggttgatgcttacatatgttggctatccctttcagttgcccccaccgccccttcccaaaaactgttcttcggttttcaaacgtggcactatcgtactggcattcaatttatcccgacacgatccagccgcttttctaaaagtctgtgaaattttgacgtttttggcccgtgatgcggcgcatataacgccatcgaattttgcccaattcacgaggtgtcttcgaacaatggttgaagccagtctggatggaggaaagtgagttggcagttaaattcgtaaatcaaaaatctgctcattgtaagatgtgccccaatgaaacttccggcgactcctccgtctgctcaaatactaaccaacgacaatcactcgaagcaattttcagtgccaaataatgatcaaaatggaacgaataatgtcacagaacagcaacacataggggaaggagagcgggcggtgggggagcacgaaagactgtccaactgttacatggacgcatctttacaggtgaaagcgtggtctttcccaccgcgacaaattaaa

SEQ ID NO: 64811 - DNA, 691 bp, Heterodera glycines
  Genomic contig location: Contig_ID=SeqID_7436; Location=300..990; Strand=+
  SCN-specific regions: Sequence locations=1-490,517-691
  Gene Ontology: Cellular component=mitochondrion
tggcactgaaaattgcttcgagtgattgtcgttggttagtatttgagcagacggaggagtcgccggaagtttcattggggcacatcttacaatgagcagatttttgatttacgaatttaactgccaactcactttcctccatccagactggcttcaaccattgttcgaagacacctcgtgaattgggcaaaattcgatggcgttatatgcgccgcatcacgggccaaaaacgtcaaaatttcacagacttttagaaaagcggctggatcgtgtcgggataaattgaatgccagtacgatagtgccacgtttgaaaaccgaagaacagtttttgggaaggggcggtgggggcaactgaaagggatagccaacatatgtaagcatcaaccagccgaacagttgtttttcaactaataatagcgcctgaaacacacctcgaccatttctgccccgtcgatttcgtcgcggtaagcggccgcgccgacagattccaaaagtatgaaaaacatttcccaatgttcgctcgcgtgtaaattggcagcatttgcgcggaggagctgatggagaccgaaagcaatttgacgggagaacagaaacaattcgggtggtcgaagtgccaacagttcacagcccatgaaatggagcacttcgtcggcacaattgctggcgcggtcctggacagtctgctgatt

SEQ ID NO: 64812 - DNA, 228 bp, Heterodera glycines
  Genomic contig location: Contig_ID=SeqID_7437; Location=11..238; Strand=+
  SCN-specific regions: Sequence locations=1-28,50-228
aatgatgagtgggagcaaattgaagaactagttggggttttgaaatgtgctgaagaggcaacaaaaaggttcacggaggagccaatttcgtttgtccttcctcaagcaagatcactacacgatgagttgtacgaaatgaaaattgtcaacaggactgtggagacaatcagaacgacactttactatgcgtttgaacggcgcttttttgagctagcgaacaagaagtaa

SEQ ID NO: 64813 - DNA, 843 bp, Heterodera glycines
  Genomic contig location: Contig_ID=SeqID_7438; Location=2349..3191; Strand=-
  SCN-specific regions: Sequence locations=1-23,45-173,196-282,304 -304,326-441,463-473,495-843
atgggtgttgtccacttcaaaattgtttgtgcttccgttttgatgggccccgactggtggctgaagacggcttttgaacaggtccaacaacgcacatgtgctgggttgtcactgtttgtttttaagatttacgccgatggcatttggaacatccgtttgcgagacctttacacgaacctggtgttcccaattgtgaatacactcacttttctgatcgcgtttccttacgttctcagcaattttctcctcttttttgtcggtaagcgatttaaatttttttcttttcccaaattttaatatcaaaatattttatcactattttattctgtgttttcagatgcttcacgcgaggaacaaatcattgtgatacgatttgcttatccgtttctgctcggctccatttgtttctgtgctttaatcacatggcaatggcaaaagctcaaacttttggcccagaaaattcgtaacgacaaggtgctttgttttgctactctaataatgaatattgggtagggtttttgtttgtttgttttgctgtttgtattttgatatttgttgtctcttcctctcttccccttgggcatttctgtaaggattgtgccgaactttcattctttcgtcaatttggacagcatttgttggttctaaattattttccatcaaacatttcagtatttaatcggcacacaattggtcaacttttatcgtgaaaacacttccgccattgtgggcaattcgacagtcaaaaaatcagtgacaccaatggaatcgattgtaaatcagcaacaacaaaagagccaagttgcgaatggagaacagccgggaaggaatgatgaattgtaa

SEQ ID NO: 64814 - DNA, 1437 bp, Heterodera glycines
  Genomic contig location: Contig_ID=SeqID_7439; Location=1..1437; Strand=-
  SCN-specific regions: Sequence locations=1-491,514-665,688-743,765 -1437
  Gene Ontology: Mol. function=ubiquitin-protein ligase activity; Cellular component=ubiquitin ligase complex; Biological process=mRNA polyadenylation
atatctgccgtgtttgtcgattgtcggggaacgacgttttataccatccgtgcctttgtaactaattggcttttcaatttcaaaatttgttaattgacaatttaggcactggcagcataaagtacgtgcaccaggattgtctgctacagtggcttaagtacagcaagaaggatgtttgcgaattgtgcaaccacaaattctcttttcgtccactttatcggccggatatgcccgaaaggcttcccattttcgacttactcaggggttggcttgtgttttgcagttgccactttccatctttcattgtcaggcgtctttctcatattggccaacttcatgcggttggctctgacttatgcgatggtcgcttgctgttggctcggtctccactccaagtgcattttgttattatggcaattttcgtcccattttaggcattgtgccgttaatggcggctcgcatccatcggctcgtcttctctggccttatgaccgcttttttctcctcccgcattttccaactattctcaactgaaaatgtcgcaattgacatcgcccggggttctttagtcgtcactatttttctatgcacttttatttccctcgtttggcttcgtgaacaaataatggtacaattttgtggatttcaattcttaatgagtttttaacagattggaggacctgcccatcttttacatttgaacgaggaccaaccaattgttgagcatcaacaacaccaaagtgagaaaaatacccattcacataatttaatatcaaccgaatcttagaccaaccgcctgacaatgccgggcaaagtgcagaagcggatgcagaagaacatggggatggaaagaacgaaaatgcttacaatgggctaactcccactgaacaaatgagttcttttggtccgtccacttcggcggcaacttccgattcgactgatgctaatgatcaaacagaagctgaaaaccagcttgaccaacttccccaaaatcgccaactccgccctctccaattctaccaacctgttcaagctgcgcttgtggccaaccaaaatcaaccggccgaccaaggccaacaagcgcacaatggcggagacgcggcggcagccgaaattgacccgcagcagcaacgttttgtggatgagctcacatggcaaaaacttttgggtttggacggctcttttgcttttattgagcacgtgttttggacaatttcactcaacattgtgttcaacatcgttttccgttggtccaattaattgccaatttgtcgatgaccctcagtttagtgtacttccctgctcaaattggttctggaattctgtctaccatcggctttgggtctggaaagattgcatttttcgaacttcctatttcgattttgactggtttggtcgccatttttattcatggcctcgtcatccatcgaatctcta

SEQ ID NO: 64815 - DNA, 368 bp, Heterodera glycines
  Genomic contig location: Contig_ID=SeqID_35212; Location=187..554; Strand=-
  SCN-specific regions: Sequence locations=1-131,154-202,225-295,330-368
ctggtgaactgcaaaaagcgcccattttggacgaagaagcatgccgacagaatgtggacaggtgaggcccaaaacaatgtttgactcgatcagcaatcagaccaagtttcctgaattaatcactgatcagaagtcagtgatcagacattcttcaacgacttcctagatcagcgattagagttaatcactcatttccttctttaccattcaaaaaataataatttgatcagtgattagcgattattttcttcaaacggaaacgatctttctcttttccgaacatcccaatgatcggatttatataaaaatattattaaaaatcatttaaagtgcattttattttcagtggaacctgccagaactatgtg

SEQ ID NO: 64816 - DNA, 165 bp, Heterodera glycines
  Genomic contig location: Contig_ID=SeqID_35216; Location=732..896; Strand=-
  SCN-specific regions: Sequence locations=1-165
caacggtccatccagcagaacacctcgcgattgaacttgcagaaaaggcgtgggaatgactaaaaaaggggcagggaacaaaatggtgatgatgtttggaaactggacgaatgaatgaatctgccaccttttgcattgaagactccaccattgtttggaagccga

SEQ ID NO: 64817 - DNA, 1333 bp, Heterodera glycines; identical to SEQ ID NO: 35216
  misc_feature (1308)..(1308): n is a, c, g, or t
  Genomic contig location: Contig_ID=SeqID_35216; Location=1..1333; Strand=+
  SCN-specific regions: Sequence locations=1-241,263-535,558-1152,1174 -1333

SEQ ID NO: 64818 - DNA, 150 bp, Heterodera glycines
  Genomic contig location: Contig_ID=SeqID_949; Location=63..212; Strand=-
  SCN-specific regions: Sequence locations=1-150
atgcccctatgtgtacaacgactgcgatcttggggacaaatatgggagcctcgagaaagtgatgacgcgcaaattggccagaacagcgtaccgacagaaacagataatctgccaagcggatgtcacaatgatagaaaccgaagaaagctg

SEQ ID NO: 64819 - DNA, 66 bp, Heterodera glycines; identical to SEQ ID NO: 53774
  Genomic contig location: Contig_ID=SeqID_949; Location=851..916; Strand=-
  SCN-specific regions: Sequence locations=1-66

SEQ ID NO: 64820 - DNA, 2107 bp, Heterodera glycines
  Genomic contig location: Contig_ID=SeqID_949; Location=4360..6466; Strand=+
  SCN-specific regions: Sequence locations=1-79,101-255,306-371,399 -574,617-649,671-837,859-1177,1199-1200,1222-1517,1541-1543,1567-2107
atggctcttgcacaaaaattttctatgaattttggaaaattggccgaaaatttacaatcgcaaatcgactatgctttacacgatagaagtggttttaaaagtgatttggacactgacagttcgctgtattcccctgtaagagtaatgcttggtttttctataccgcgtctggttggctcgataagagttcggctttttggtcgaattctttgggttttggtctcgatttgcgagaaacgagacagaactttttacataataataaatatttttgttaaattaaaaaaaaattgttttaaataaaagtgtaaaattttaacaagtttttgcatttttggggatagttaagtggtttgattttaggtttatgtcaaaatttttaaaaatttccattccaaaatctttcgttggcgtgagacggaatgatgtacatttcacttaattattgaataaatctcattccaaaaactttaaaaatctcaatttaatgtttaaaaaaaagcccgtgtgaaaaaggtgaaaagtgaaattgcccaaaaaattactaaagggttcacagcacttattcaaattcaaaaattttgaatttgaaaaattaataaaataaaaaatttttgcgtttttgtaaatatatgataataattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaatgataaagcataaatattagcccggcaatagtattgttaaaattcgaaatctctgacaacttaacggacgggcacgactgggccccgccaactgggccccaaccaactgggccccggattaactgggccccaccaactgggccccaagagacagtaatttttccaccattattgtataatattatttatatatttttcattacatacacatatgtatgtgtgtttcgtttacaataatctaatttgtgtttatatttttttcgttcagtgcctaactacaataactttccttcagctattttttaaatttaactatcatttcatggcaaataatatattatcgcagaataaccacaaaaaaattgagcatgaaggtcatctttatgttttcgccaaactcagtgcggatggttttatcaaatttttgaggtgtgagaacaaaaacaataaggacatgaagtgccgagggcgtctgcacaccaatttgaatgacgtagtgttgaaacaagtcaatgagcatgtctgtggagcaaaccctgcgcgagtggaagcacagcgcgtcgttacaggttaggttatatcaaatgctgaagattttgaatgcatatttgacaattttaggaataaaatgtagagccattgaaaccgccgagccgccatctacacttcgctcaattgcactccaaaatgtgggaacccctgtgttgtctgaagtcccaacaaaaaatgcaacaaaacaagttgtgttaatttctctgcgatga

SEQ ID NO: 64821 - DNA, 1442 bp, Heterodera glycines
  Genomic contig location: Contig_ID=SeqID_950; Location=1041..2482; Strand=+
  SCN-specific regions: Sequence locations=1-708,739-847,869-878,899 -1356,1385-1442
  Gene Ontology: Mol. function=ATP binding; Cellular component=nucleus; Biological process=signal transduction
attcaaaaaatgaattcttcgaaccccataaaattggccgaagacaaaagcgggtcaatgtccgtgaaatatttcaagacgcatttcaacgaattcggcagcatggcacccaaatcgcatgcgttttttatgtgtttgtcgcgcttatggcactttttggagtgatttgtacgattgcccgcttggctttatttaatccggcagattatttggcatggcttctgatgctctggcttttttatgtctttgggcactacatcaacgcattcatcaaagaatgcaccggctgccttcgcaacaataataaccaaattcactcaatagaattggcagagaatggtcccgctgctgctggtgctaatgagcaatgaattaatgcccattagggaaaggaaacggacaattgtttgatactgtattcaacttaaattgtagttatctgattcataacgttgtattttcatagggaaaacataccaattgtcctccaagtatttatagttaacaaaatatattggacaaatttcagggaataatatagtcttacactgtatgggtaataaaatgtaaattcgaaattttaacttgataaacatgaacataaaatttctctcaccgatttcatgccgaatttattcgaacgtctttcaaaaatgaatttgcattcattcgtcagtttcattaaaaactcgagactgaaaaggccagaaatatataaaataattaattaaatttaaaggtccatcggtggaggttggaggggcgatgctcacattgtggcaaatcttttcagcaaaagatgttcagagaaaaggcatgacattttcttattttttcgaattacattattttccattttgtcatttttggtcgtccttattaattaattaattaattatttgcctaaatgtttttattttttaaaccgtttgctgcaggaagtgatcgcgatcacctgctcctggtgcaagcgctcctaccacaacaagcggcactgcttctcgctggcacgcttcgacgaccgctgcgaccggggcgtgctgcgcgagctgatccttcccccgggatggctgcttcggctggccgctccgcggcggcggagtgccaacccatcgaccggctcaagaagtaattggcatataaaattcaattttataaaatcaatgcctttttcagtgttggcatacgctgacgcggcggcacagaaacggtcccgacggcgcagcaaataccgtgcgtttgtggttaagccgccgcccgcctcgcgctgttcgtccgcgcaggcgcacggcgtcgccaacgggtacagccgctgggcaaccgcggcccaactgcagccgctgcccatccaaccgctgctggtgttcgtcaacccgaaaagtggcggcaacaaaggagccaaggcgttgaacacgctgtgctggttgttgaacccgcggcag

SEQ ID NO: 64822 - DNA, 490 bp, Heterodera glycines
  Genomic contig location: Contig_ID=SeqID_951; Location=112..601; Strand=-
  SCN-specific regions: Sequence locations=1-490
atggaccatgaattggcaatgcacggatggcaagagtgcgttgcgcggatgaacaacatttgcccgggccaaatcgtcgaattcacgcggctgaaagtgcgcgaacaagggcgaaatggaaacgtgaaggggagtttccccttcacgttgctgtacaacggcgagtcgcgccaccgtgtgctcggacaggcgcctgcggcagtgacaaatgcgggtgagtaaaagggttgctatttttttggggagggttttttgactcaaaaaatccaattttctgtcccttttccagtgtgttctccgaatttcaacacgcccatcattgttgaagcaaatgatcagcaccaacacagcagcaacggcacaatcattggcggcggcgaccggggcggaaacgatttgaacaaccccaacaacaacaatgatagcgtcatcaatgacgcactgtcggcacaacttaccaatcgctcggaccaagtgaacacgagcgttg

SEQ ID NO: 64823 - DNA, 132 bp, Heterodera glycines
  misc_feature (104)..(104): n is a, c, g, or t
  Genomic contig location: Contig_ID=SeqID_952; Location=167..298; Strand=-
  SCN-specific regions: Sequence locations=1-132
atgatattcttttatcggtcatattaccgtattattggtagcttcttcattggcagaattgctttgttcagcatacgaaatattctgatccacttgttcattancactctttttcaaatggttcttcgttta

SEQ ID NO: 64824 - DNA, 1658 bp, Heterodera glycines
  Genomic contig location: Contig_ID=SeqID_952; Location=388..2045; Strand=+
  SCN-specific regions: Sequence locations=1-49,71-390,461-672,695 -823,852-877,899-975,997-1326,1349-1399,1421-1586,1616-1658
atggagattttaaacgaatttaatttgatgaaaaaggaattgcgaaaagaaagtgtttataaaaatttgtcccattctcaattggaatgtgaaattgcaaaaaagttgggaattagtcgaaagaaaatttataaatggaagaacgaatttggtaagaaaacaatggcatatttgaattttactaattgtctcattttaaggtttattaagggaattttcaaatcagcaaaaaatagtaaaagttaaacaatttgaaaaagtgaaaaaagaatttacaaaaaaattcaattcaaaaacgaattggaaaattaatgggaaaatagctgaaaaaattggtgttaaatttaatacaattcgtgtttggaagagaaacttaaacttgacaactcgtaaatttgtttaattttatacttttatttaattataaataatgaaaattaatttaaaaatttgattttttgataaggaaagaccaaaatttacacggatgctgataaattggaatatgtgaaaagaattgaagaaatgacagaaagaaacccaatgatgaagaagaagaaaattgccgaaaaattaggcattccaattggcaacttaagccgatggacgaagaaattcggcaccaaggcagaaggtttagccactagaccacatttgaatttgaataactgctttaaattaaataaataatttacagacccccattcttaccagtgcttatttagtcccgccgggaccgggctttctttttttcaaaaaccgggaccgggcctgaaaaaaccgggaattcccgtctcggtcccgctcagctcaaatttttctgttatttaaatttaaacaaaatttaaaaagacatcaagctttcgtttcataaacatataattcttttaaatggtaattggggatgtcaattttatgtaaaatacatattttttcttggcttctccatgctctaaatagtaggaaaaacactttattttctgtgtttgcaacaaaaatcgggacttttatttacatattttggggttttatacatatttcgagattttatacatatttggtacatattttggtttttttttacatatttatatacatattttgactactttttgtacatatttttgacatccctactggtgggtgagctatttctaaaaatcagtaaagtcgatccatggcccttttagtacaggataattgagcttcggtacaagtgcgctggtttatagcttaatttgctaaattcattgtttttttgaaattttgaaaaatttcaaaaatctcattttaacaattaatttggtcccatttaagcgaaaaggacattttacacagctgctgagaaattggaatatgtgaaaagaagtgaggaaatgacagaaagaaacccaatgatgaagaagaagaaaattgccgaaaaattaggcattccaattcgcaacataagacgatggacgaagaaattcggcaccaaatcgattcattagcattggtgaaagataattttatcctctggacacttggctcaacttcactatgtagagaaaagcatatactatttatttataatgcctttttctaccaaaaaatattaatttttaatgaaaaatttcatttcttgagccttggagctttttatcagaacaaaatgagca

SEQ ID NO: 64825 - DNA, 1092 bp, Heterodera glycines
  Genomic contig location: Contig_ID=SeqID_7440; Location=2212..3303; Strand=+
  SCN-specific regions: Sequence locations=1-73,95-230,252-528,550 -578,604-703,725-879,901-902,925-1092
atgggaatggtcaacagtttcaaagaggtgtgtggccatatttccgtaaaatattttgcttaattgccatttgctttttgtttcacattgtttaggcatttcttcgtgccaccactcctgtcggctacacatttcgacttgaactttatgattcaacggaaattgtcacgccatttgaagtgatgaacgaacggaccaacgaaatgctgacatttgagaaagaaggaaacgatgaaattgtggatgaagatagtcaatttactgatgctgtttggctgttgaagcgatgcccaattggggggacggcgacgattcagtgggaggacagaaagtcggacaaattgaacaaagtcgatattcgtctttatggaaattgcattgggtgcgtggcaaccgtgtcccggcatttgcgtttttgtccaaaaatcgggttcaaaattaagtttttttcaatccctgcttgctgatcgcctaaaacaagcgatacaaagtgatcgtatctgatcatttgatcgtcaatgaatttatgatattaaaattttcaaagagcagagttaatgctctctaataagtgagaagactgtgttttaattttaatgatctttagatcagggatgaaaaaaaaaaattaaatttgattccgatttttttgacaaaggcgcaaatgtcggggttccgtggcaacggcatttttgtttcgtttaaagtcattcaaatttcacttaatattcaggccattgtctccactaaaggcgggccaaatgaacgcaaaaaatcatccgaaaatgaatcccgagcccagcggacagcagaagaaaaagtgaaagaattattaggaaatgacaaatgattgatcataggaatggaaattgatctgataatttttccttatatttatttgttgcttctttcatttgaatacatttaggtaatttgtctggatttttggaacttttacgcagaaaatcttttttgtctttagaaattcattgtctaatgttctattttttgtgctttacttttgcctaatttttcaggacttttttgcatttcttacgtacgttttttgacgattttttatgactttaaaaa

SEQ ID NO: 64826 - DNA, 77 bp, Heterodera glycines
  Genomic contig location: Contig_ID=SeqID_7440; Location=540..616; Strand=+
  SCN-specific regions: Sequence locations=1-77
tccaagtgggggaaattgaacccaggcgaaaaattatgaaaggtagaaagtttaaccactacaccacatgtgcatgt

SEQ ID NO: 64827 - DNA, 1034 bp, Heterodera glycines
  Genomic contig location: Contig_ID=SeqID_7440; Location=3681..4714; Strand=-
  SCN-specific regions: Sequence locations=1-15,37-359,381-653,678 -986,1008-1034
attcccttcacagcgacaacaacaacaaacaatcagcaacgacgacaattgcgcaacgcttcaacacagcacatccatcgcccgtgcacacgttgactccgatcacttctgctgctgctgctgctctccaatcaacacaatgggcttcctcttctacatgttcgtggctgcggttgcgttcggcggtggagcggtgggtttgggggtggggggaattcgcgttgttgctgctttttctgaatccaatcaaatttgtatccattccaaaatgtattgtttgtccttaaaacaatggacaaaatttctcgggattgagctttcaagcagggtaaattcgagactcataaaagcacggaaaatgcatttggcttatttatgtgttttttgctggtgtgagacgaaaccaaattttagaatccaaaaattgattttgaggcttttcagaagtgccattaacatatacaacgttcagtttgaccaatttcggacccgaaaacccaaaatttcattgttccatgactagtaaaatggtttagttggcccgcttttgcctccgttcgtgttcattttgtgtctaatttgttcccattttcttttcagtactgtggcatgatttacaccgccaaacgggccagggcatcggcgggcggcggctccaagaaggacaagaagcagaaagcgtcgaagagctccagcggtgaacaatgatcgactcgaggacggcccccgcggatgaacgaacgatggaattcgagcaacaaacgcttctccccttctaactgctgctgatcccccaatatgacgctgtttcccccctccccccaaattatatcatttgtatgtgctttatcaccctctgatctgttgtccgtgataagctttatgcgctgtccatatcagtgatcaaatcgttgtaattgttgtaatgatatatgtatgtatgtcctatatattgtatttgtatgtgctccaatgcaacacccaatcattatgtgtacataatatatgttgtatgaatgtattcggacaataaa

SEQ ID NO: 64828 - DNA, 470 bp, Heterodera glycines
  misc_feature (9)..(9): n is a, c, g, or t
  Genomic contig location: Contig_ID=SeqID_35227; Location=412..881; Strand=-
  SCN-specific regions: Sequence locations=1-173,195-470
atgggaatntaagtcaaatgacttttttttttgctgactctaaatgaccttaaaatgacttcaaaagtgttctacactttgtttgaagcttctaacatacattttttatgactttttcgtgactttttggcgatttttcatgactttttatattaatgaatgatgatcaagcgaaaaaattaaatttttgtgccgtcgatggataatggattggaaacaaaaattaaaatttggcatttcaggtgcgtccaagctcatcacgacatgcgaatgtttgacggacataaggtgatcagtatctgtagttaattttttgagtaattatgcgattgaggcttttttcaaatttcataattgaaaaattggaggtgtccatttttagagtataaatcccaattttttaactgtcgcgagtctcttcagccaattttagcgcccttattgagacaaactaaagataaaaaaataaa

SEQ ID NO: 64829 - DNA, 620 bp, Heterodera glycines
  Genomic contig location: Contig_ID=SeqID_35228; Location=39..658; Strand=-
  SCN-specific regions: Sequence locations=1-116,138-234,256-288,310 -314,339-620
atggtcagctgttggcattgcattggttctgtgcgcattgtattccttctgttatatgatcatcgccttacaaaatgccttaagggctcaattgtttgaattttgaaatgaattactattattttttaaattattatcaaattctcaggccaattgcttgtacaacgaccgctccgcttggcagtgcggtgaacgcattggcaaagacgaactttgcgttggaatctatcgccatttttatttacattttcatttggttgcacatgaacaaaatggacaaaaaatcgcgaaaagagaatgggaatagcacaggcaagaaaaaagaaaggaaaggaggaaatgaattagttgtcaatcaattgttaattgcccatttaattatgtcatttgttaattgtctccacaatttttgccacctaattccaaatttagtggatgttcgccgtctgttcaagtcgctgttctccattttgctggtcgatttcgtcggttggtccaccaattccatctcgattactcttctcggtttgatcggcttttcgtccgcttctcccaaaacgaccgatcgcattatttacttttttatcacaagttccctaaactatatgacgtacattaaa

SEQ ID NO: 64830 - DNA, 219 bp, Heterodera glycines
  Genomic contig location: Contig_ID=SeqID_35232; Location=1275..1493; Strand=+
  SCN-specific regions: Sequence locations=1-219
tataaaaataaaagtgattttgggattccagaccaaaggggggtgacaggatttttgagtggaaaaattttttcccaaaaaactttcaaaaacatgtcattagggctattttatgacgctgatcacgaatacgtgatcagattttacttttaacatcgataagacctcagaatccctgtgtgattggggattctgagcatcattttgagggggaggggg

SEQ ID NO: 64831 - DNA, 381 bp, Heterodera glycines
  Genomic contig location: Contig_ID=SeqID_35233; Location=167..547; Strand=-
  SCN-specific regions: Sequence locations=1-82,116-138,160-381
atgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatggataggcaccgccagttggacaggtcttgcaccttctctggagccccggtcaagggaaacttgaacaagcgggccaacccaagctcacggtctatacgctacacctcgcaacccagaggagctgcgattcagcgctggactcttcccagttcactcgccgttactacgggaatcctc

SEQ ID NO: 64832 - DNA, 352 bp, Heterodera glycines; identical to SEQ ID NO: 55331
  Genomic contig location: Contig_ID=SeqID_35233; Location=851..1202; Strand=-
  SCN-specific regions: Sequence locations=66-66,98-104,133-294,325-352

SEQ ID NO: 64833 - DNA, 662 bp, Heterodera glycines
  misc_feature (164)..(164): n is a, c, g, or t
  Genomic contig location: Contig_ID=SeqID_35234; Location=241..902; Strand=-
  SCN-specific regions: Sequence locations=1-349,371-502,529-611,654-662
cgaaaacaaaaaaaatcgattttttcaagtgtccgtttggggtactcaaacaaatatggggagcaaaaatccaacgcagaattaaagtacaggctatagggaagctattcccgaaggattcggtctccccataaatctgggcgcatcggttcggggggactgcnccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 64834 - DNA, 95 bp, Heterodera glycines
  Genomic contig location: Contig_ID=SeqID_35235; Location=124..218; Strand=-
  SCN-specific regions: Sequence locations=1-95
atggaaatttttgatgaatatattattgttgatgaaaaatcactttcaattaacattggctcaaagttcaatgaagtgactcaattcgctgcaat

SEQ ID NO: 64835 - DNA, 907 bp, Heterodera glycines
  Genomic contig location: Contig_ID=SeqID_35236; Location=12..918; Strand=-
  SCN-specific regions: Sequence locations=1-483,505-661,683-907
atgaactcttgggtgtcgtacacttccttggatcggtgcagcaaggcgaaggaacatcaaaagaggcaaaggactacgttaaaaaattggagaacaacatcgagcacatggccaaattccactacgttaaaagtcaagtcgaaattcaccattacggatttgccgagcacgcctgaggcattgttggctgggattttccaacactgcatcgacgaagcaattgttgaaagccgtgagcgaaacatcgaacctacacacctcggctgtatgatcagcagtcctctgctggaaggcggcgacatcccaatcccgatacgacaaatgacaaacaacactctcgacaccattctcaaccagttcaaaaaagtggcgcagtccaaacaacagaaaaatgtatcgttatggggtgagccgtttaccgtcaccatcacgactctggaccgtaatggactaccatccaaacgtcgtgtcaaagggggagctcgtcgccctgtcaaaacggccgttcaccaccgaattaatgaccaatgcctgattaaaattcgcaataacgacaaccacttctgccttttctacgcgctgcaggcaacaatggtcgccaaaacgtgcaattggcctcgctggaagttttcccgttacttgaacaaccaatacggacaacagggacaactttatcatgatgcggttgagctcatgcagcaggttaatgcaccaatggatttggttggctacgacgcggacacatttgtgcctcatgtcgttgactactggaacaacgcgcagcgacaacaccgctttgctgtgttcatctttggatcgttgggacagtataaaccgatctacaagtacattgacaccacctacgacacacctttgatgctatattttaatgaggaccatttcgatg

SEQ ID NO: 64836 - DNA, 56 bp, Heterodera glycines
  Genomic contig location: Contig_ID=SeqID_35239; Location=588..643; Strand=+
  SCN-specific regions: Sequence locations=1-56
gctatagggaagctactccggaaggattcggtctccccataaatctgggcgcatcg

SEQ ID NO: 64837 - DNA, 770 bp, Heterodera glycines
  Genomic contig location: Contig_ID=SeqID_35241; Location=1..770; Strand=-
  SCN-specific regions: Sequence locations=1-377,399-450,473-770
  Gene Ontology: Cellular component=integral to membrane
ttgaattgccaaactccgaatcgaaatttcatcttttaccttttcaagttcctcggcatggcgtatcatttcatttgtgtctacgctttttgtcaaatcgtttacgctcacttttcttgctgaatgggtcagttgcgtttcccattttccaacatttttatcaattcaatttttagggcgaccgttctcagctgaccacaattgttttgggcgcaagagaggacgttgtcggttggtattttcaaccaattccctaaatttctgcttttaaggcgttattttgggtggaatcattggccatatgatttgcactggcatcgctgtgctcggcggccgtttgttggcacaacgaatttcggtacgcacaggttcggcatttttgtattaccattttattttttcaaccattgtaatcatcgatggacaaggggggagatcaatttcgtaaatcgtacggaggtctgaggaaatttcgtaaaattttcaaccaaaatcgaaaaagcactggtaaatgggaaaattttttgaaaattgggaaaaaaccaacaaattttgtgacggttttgaattacgtttcgttaaaatttttaccaaattgggggaaaaaccgaattttgtgctaaaacccgaaatttttacgcttttgagtctattcgatcttttcctattccgtaaatttttacgaattggattccgttttcctatttcgtgaatctttttttttacgaagttgggtctcacttacattgttttagtggaaaattactagt

SEQ ID NO: 64838 - DNA, 345 bp, Heterodera glycines
  Genomic contig location: Contig_ID=SeqID_7442; Location=186..530; Strand=+
  SCN-specific regions: Sequence locations=1-152,175-183,205-345
atgttggccgaagcgatcagcatcaagatggaacatgccgccgcaacccaaacgtgcggatttgagaactcggtggagcattgcgaacaaaacaaaagtgtaagtatcaaattaaatggaccgatcgggagagggggggggcggggagcaacagatgtgatgaaaaatagaaaaatcatgtacaaaaattattaattaaaaaatgaagattgtttatgcggtcatcgacgaaatggacgacgaagacgtggatgaagccatggcgccaccaccaccccaatcatcatcatcgcataagggcacttgcagtgtagcgacgcagacaaagatgagttattgaataaa

SEQ ID NO: 64839 - DNA, 271 bp, Heterodera glycines
  Genomic contig location: Contig_ID=SeqID_7442; Location=2381..2651; Strand=+
  SCN-specific regions: Sequence locations=1-98,132-271
atgagcattacagtacctctgtccacttccgataagccgtttggcaccgaagtggacaataacttccgcttttttgatggtgaattatcaggtagcggtgatgatgatgatgataatgatgatgatgatgaaattgttcgttttaatgatgcgagggcagtttgcacaactgcaacctcaacattgccgtggcgcagaatccgatcggccatgacgtcgtgcacattttcttgttgcttcaacaaatcgaacgattcacggagaacggctg

SEQ ID NO: 64840 - DNA, 380 bp, Heterodera glycines
  Genomic contig location: Contig_ID=SeqID_7443; Location=68..447; Strand=-
  SCN-specific regions: Sequence locations=1-179,222-380
atgaagaaatccgttaccgtcgctgttcccgaacaaaaagaaatcaatcaaccaaacgcggaagtggagccaccaaaatcagacactacaaagaagcgcaaggtggaggaccgggaactgtggaaattggcaaaagggaaattcatgctcgcgacgtacttatgcgcaggttaaattggaatattaaatttaaattttattaatttaataaaatttatttagacgactgggaccgactgttccataatcaacagaaagtcgcgcgcttggaagatggccgttttgcggtgagctttgagctctgtgaagaatgcgcgtgggccaattgtcgcgcaaccgatctcattgcgcctatgaagaaaaagcctaacaatgcatga

SEQ ID NO: 64841 - DNA, 1841 bp, Heterodera glycines
  Genomic contig location: Contig_ID=SeqID_7443; Location=1339..3179; Strand=-
  SCN-specific regions: Sequence locations=1-610,632-921,962-1090,1112 -1290,1313-1314,1336-1470,1492-1841
atggtgcttcccaatggaaaaacagcgggacaggtgcgggagcgagacggcaagaggatggagtacatcagaagatattgcaatcgcgtggatgtgtactgggaatgtcgaatttcggaaatgctggcccggagcaaagcaatgcggaaatgctttgccaattacgtggacgacggtccgttggtgataagggatgcgtttatgggaggacggactggaccgatgaaattgctgcgcagggctggaccgggagagaagatctcctactacgacttcacatccctttacccatacgtgaagtgagttttttattaaatttacagataaataatctttattttagcttcacaacccgataccccattggacacccgaaagtacatgtgctgaaccaacaagtggactggagcagtgcggtggacaacccatatcccttggcactgctgaaggtctgggttgtgcctccccgtcgcatcgatgtcccggtgttgccggtgaaagtggacgacagattgtgcttcccattgtgcatcagttgtgcaaaggagtacccgactgggggagtgaacaacgactacctctgcgagcacactgaccagcaaaggggatgggtcagcacatgcacatcaattgagctgaatgcggctttggatgagggctaccgcgtcacgaaggtgttccgcgtgttggagtacgagcaaagcgacgaccaacttttccgcccatacatcgcggaatttatggcgcaaaagatccaagccagcgggtttgatagcatgatcaaaggaaatgccgctatggaggagcagtttgtacgagagtgcgaggaaatgtttggtataaatgtggacccaaccaaaatggtggttaacaaaggaaagcggtccttggccaagttgtgcctaaacaatttatgtaagcatttttttatttttagttatctttaaaaatttttaatttaggggggcgcttttcactacgaaactacgggctgtcgcagactctgattacggacaacccagttatattagcagagtacctggacaacaaatcgattgaagtttcgtcaattgatcagctggatggggagcatattctcatcacatatctacacaagaaggactgggtggatgagcacgcttgctcaaatattggtgagaaattttctttaaatattgcttaatcaaaaattacagtaatttctttgtggaccacttccgctgcgcggattgttttgctaaaggcaatgcaaaaggtggtcaggtcagagcgatgtgagctactgtacacaggtaaatgaacaaaaatcttcgtacaataatttttgaaaaattacagacaccgacagtctgatcctcgtccatccggaggaatgttgcccactcaaaactggtccacatttgggtcagttcacggatgagtaccccgatcacgacatcgtggagtactgcagcggagggtcaaaacaagtaaaatttgtaaaattacattttacaaattactgttatttgtttaagtacggtttatgtctgcggaggaaagaggcgggacccgatgctgagtcggagtacgtgctaaaagtccgggggatgacgctcaattacgacgtcgtcaacaaccagggactgcgctatgaacgattcaaagaggaagtgatcaattatgcaacaagaggagattatgaaccgattatcgtcacatatccaaactttctccggccaaacatcagggagggcggtcgggttgtctctatgcctatgcaaaagtgctatcgaccatttgtgggcaagggaattgttggtcctaattttaatgttttgaattttggtcacactttataa

SEQ ID NO: 64842 - DNA, 57 bp, Heterodera glycines
  Genomic contig location: Contig_ID=SeqID_35242; Location=811..867; Strand=+
  SCN-specific regions: Sequence locations=1-57
gctatagggaagctattcccgaaggattcggtctccccataaatctgggcgcatcgg

SEQ ID NO: 64843 - DNA, 549 bp, Heterodera glycines
  Genomic contig location: Contig_ID=SeqID_35243; Location=559..1107; Strand=+
  SCN-specific regions: Sequence locations=1-357,379-549
atgccgactgcgaaagttgtcatatcgcaagatggaaggaaactcgtgccattcttcacatcagcatatccattttccaatcacttctcctgccgatttgtcattgatggactcgaattttcgtccagtgagcaaatgtacatgtgggccaaagcgagcgttttcggagacgaagaagcggcatctgcaattctgcggacgtcaaatccgaaggaatgcaaacgcattggatcgcgaattcggttgttcaacaccactgcttggagacgaataagcatattcgtcatgacctgtgctaactggcataagtataagcaaaatgaagacctgatgcgccatctcttcaattttggtcccgatgctgaatttgttgaatgtacagcaaatgacgtgtactggggtgcaggagtggcgctttcggatgttgaaaaaatccgcgacataaaccgatggcctggtaaaaatatccttggacggattctctcagccttgatgaagaaattcctgcgtaagaaatctggtgaaatgaacacaaaaaaaaaataaaaa

SEQ ID NO: 64844 - DNA, 62 bp, Heterodera glycines
  Genomic contig location: Contig_ID=SeqID_35244; Location=294..355; Strand=+
  SCN-specific regions: Sequence locations=1-62
atggatggcccgtgggtgatgaagcagggaaatgggcaagaaaaagagaagcaaggcgactg

SEQ ID NO: 64845 - DNA, 61 bp, Heterodera glycines
  Genomic contig location: Contig_ID=SeqID_35244; Location=1..61; Strand=-
  SCN-specific regions: Sequence locations=1-61
gtcacagagtctgcgcgttccattcaaattcctccccttttggcttttttcgccgcttaat

SEQ ID NO: 64846 - DNA, 989 bp, Heterodera glycines
  misc_feature (36)..(36): n is a, c, g, or t
  misc_feature (63)..(63): n is a, c, g, or t
  misc_feature (103)..(103): n is a, c, g, or t
  Genomic contig location: Contig_ID=SeqID_35251; Location=4..992; Strand=+
  SCN-specific regions: Sequence locations=1-159,184-254,336-415,437 -499,674-865,887-989
  Gene Ontology: Biological process=N-linked glycosylation
atgacgacaaatggacggggacggagtgaccaaggncaacagcagaagcaatgccaaaatacngaagcattgggcgatcagccgcagaaaagggacggcacgnccgaaggaggcggaaagggcgcaatttgtgggggagggacgggaggcaatcttttgtaagagagaggggagagataattaacaaaatagcgttacatcaatttagggacattttgaatctgttgagcaaaagagcggaagcggcagcatcaaaggaaaaagggcaaaaggaggagggagagacaaggggaggacgagagacggaagaggagaaaaagactgtgaagagaaagtgcaatgtcaaaagagagtcagatgaacagcagccacaagggagacagtggacggaagacggacagagaaaggaaatagtggaaggaagagaagaagaggacgaaactgcgatggacgaaggacaaacacagacacatttgaaccattcagtggaacacattctgaaggacggggaagagaaagaggaggaagagttggcgaagaagagagcaaagacggaagagaagacggaagggaaaacggaagagaagacgcaagagagagaaacggaagagagagaaacgaaagggatggaggagagagagaaggaagagacggaagaaatgcaagtggaagatggatatcactgtgccaacagagaagaaagtgccgacttccgactggatcaaatggacagatttgcccttttccttggcacggcttttcctccagcggcgttgagacatttaatgaaggaaaatccattttttcgcaaattttgttcatcgttgcgcgcagataatgcacttacatttgaaagtgtaaacaaagtcagttttgagttcctaagtttttacaataaatttcaatttcagttaatggacactcattttgctcgaatgaaagacaaaatccggcgaaaattggcacatattcaaagttcagttctgctg

SEQ ID NO: 64847 - DNA, 190 bp, Heterodera glycines
  Genomic contig location: Contig_ID=SeqID_7444; Location=459..648; Strand=-
  SCN-specific regions: Sequence locations=1-190
aaatagtgacaaaacgccaaaatagtgatttttaactattttagtgacgaaatcgccaaaatagtgatttttagctattttagtgacgaaatcgccaaaatagtgatttctagtgacgaaaagtgacgtccaaatgaaaaaattttaacgcagaaatgcgttttttgagctcctttcttcaaaacaattg

SEQ ID NO: 64848 - DNA, 316 bp, Heterodera glycines
  Genomic contig location: Contig_ID=SeqID_35258; Location=557..872; Strand=-
  SCN-specific regions: Sequence locations=1-188,210-279,302-316
  Gene Ontology: Mol. function=cAMP-dependent protein kinase activity; Cellular component=cAMP-dependent protein kinase complex; Biological process=protein amino acid phosphorylation
ttgggacacggccaaagaccgtgccaatttgtacatgttatggaatttctgcccggcggcgaactgttcgcctattttcgagcattgcgcaagttctccagcactgtggtcaaattttactcagcagagatcattttggcacttgagtatcttcattccaaacaaattgtaacatcgtggcaaaacggaaatatttaatcgacaaataattcaaattttaggcttatcgcgacctaaaaccggaaaatctgatggttagcatccacggacacatcaaactgacggattttggctttgcaaaagtcatccagaacaa

SEQ ID NO: 64849 - DNA, 450 bp, Heterodera glycines
  Genomic contig location: Contig_ID=SeqID_35259; Location=304..753; Strand=-
  SCN-specific regions: Sequence locations=1-132,194-321,352-413,435-450
atgccattgtatgtgttgtgcaacagtttctattcggtgcaacaaaggtgtgacgttctgtgcacaccagatggcataatgctagttaatttggccgaaaattcattttataagcaggattcagtgttagtgaattattattattattaaacttattactaaattaagatttaatttgataatttttaaatttcagtgtcatgagaatgggtgacaaaatgatgcgtaatgtcgtgcagccacttgcccgtttaaaactgatcaatgaagaatttgtacttattcgggcgatcatttactcacatatgggtctgcaatggcaaaattttaaaaaaatcaataaattttaatgagttcatttaattttgctttaagtttcgaaccgaatcgtttgagtgcaaagagagagtttaattttttgtaacttttcttttaaataaccaaattaaa

SEQ ID NO: 64850 - DNA, 1042 bp, Heterodera glycines
  Genomic contig location: Contig_ID=SeqID_35260; Location=50..1091; Strand=+
  SCN-specific regions: Sequence locations=1-227,249-414,436-727,749 -1042
atgtctcgtggacaccggttcaagtgtcacggtggcgtcaagggcgctgatcgacattcttggctgcaaaacggtaccatcgcatgaggacgcaatcagcgcaagtggtcacataatttcatttcgtgaaaaagcaaaggtaatgctaaaagtggcagacatttgtgtcccaattactatttattttgtaaatgaacaaaaatccgtctgcaaccgagactatcaattaattcttggatgtgattcactccgacattttggcccctttaccgtagacatagagaaaaacaaaattcaaattggaacccaatggataagcttaggttcgaaaaattatgaattaatgaacaatattcgagcctttgctgccgaaaattacacaattccaccttcaagccaagtaatgatcagagcaaacattaaaactgccttacagccaaaacacagcttagttgtggataagcccgatttaaatttgctaagcaatgaccttgggattgtaccaagtgtgtcggctccatttgtggaggatatcccgttgacaataattaatccatcaaatgatcctaagattttattcaaaggcatgcatttagcctatttaaacgaaatagtcgaaaatgatggaattttctacgaatcagaccaggagaaaattaaaagcgggaatcctgacccaaatggattaactgatccatcattcaaaattgacctctcaaaatctgacattaatgaaagagaaagagaagcacttaaaaatcttttagaagaatttaaggacatattttcaaaaagtcaatatgatttaggctcattttcaggtggcgaacatcattttgacacgacaaccgaagctccaatttcttcgccgccaagacgaatgccatataaatacagagatgaattaaagaagcatattgaacaattgcttaataaaggagtaatggttgaatctgagacaccatgggtcaccccttttgtagtagtacagaaaaaggatggtggaattagaccatgtttagattttcgaaaattaaatgag

SEQ ID NO: 64851 - DNA, 507 bp, Heterodera glycines
  Genomic contig location: Contig_ID=SeqID_35261; Location=81..587; Strand=+
  SCN-specific regions: Sequence locations=1-146,168-384,406-507
atgagttccattttgggaatagtcaaatttgttcctttatgtttggttttaacttttgttttggaaaaaattaaaaaacaatcagaaaactcggaattgggattggaaacacataggaaaacagcggcacacatggcgagatttgaagcatcggaaaaacaatgtaattcatatgatagattttgaagggggagagtgaggggatttcgggggatttcaattttctcagcgggtacccaatttttaaaaagatgattccattcattttgtgaatttagtgtaattggttggtcccattcgacagattccacgcaaagagtttgcataaaaatttttaggggaagaattacgggggaaatgagtccaagggggtcaaaattagaagcaataaaagacaaaattgaccttttagtacataaattttcagggggtggtgatacggttaacaaaaattgtcatttagagtgttccatgatacaccaagaaatttatgtatcgtaccactga

SEQ ID NO: 64852 - DNA, 810 bp, Heterodera glycines
  Genomic contig location: Contig_ID=SeqID_7448; Location=129..938; Strand=+
  SCN-specific regions: Sequence locations=1-87,109-435,457-520,574-810
atgccattgtttcggactgccaacccacacgcactgaacagcaaagtcgtccgtggcattgccaagcagcgcggcattacgcctgagcaagtgttcttccgattcaccatggacattggcatcacaccgctcagcggcaccaccaacgggtgggtgccggtttccgcgagagcagttcgcccccaccccccgtatcaaacttaaaaaatttttaagagaagttcaggagaaagtttttgaaattttttagcaattttttcaaaattttatgatatttactaagttttaaagattttttttttgtttgaaagatttctagcttgaattttttaattttcgaggggaaatgatacggggggtcgaccctccctgacttcattcgtatgagaggctgaaaaaggaggggggggggggggggttggaacttcgtattggtttggtggacaaaaatgtgaaaagatgtggggaaagattgaagaggaagtgtaagagagagagagaggcgacttcgtaaaaacgaaaacaattaaacaaattaatcaagatatttacttttttctgaaattcaaagcacatatttgtttgcttgttaagcgaacacatggcacaagacgttctggtgccggatatgccaccactgagtgccgaagaaatcaagcaaatcgaatccattctttatggggatggctgaagaggacaaaatttaaacttatttccagatcattattgataatcaggaaccaattcactaattgctttataaaaaagcgaacacattctgttgaataatatttattccaattaatcaca

SEQ ID NO: 64853 - DNA, 2254 bp, Heterodera glycines
  Genomic contig location: Contig_ID=SeqID_7448; Location=1008..3261; Strand=+
  SCN-specific regions: Sequence locations=1-61,83-230,252-315,337 -358,380-431,453-642,664-1340,1363-1379,1414-1441,1499-1603,1626 -1841,1951-2162,2214-2254
atgggttctcttaaaatggatactgagtgtattttagggttcggacctcgtgggcgagggtggcttttcgcgggggcgggggtcagagtcgcgggggtgagaaatttctcgcccccgtggacgggggcgggggtttgtttttaattagctccaaaaaatctcacaaaaaatttttttttttgaatgatgtgtttggctccacattcctttattcgatgtatcgcctcgattcaattcttttttggtataattgcatagatattgtctaaaaatgaccaaatttaaggattataaattatgccaaaatagtcaatttttatgggtgtttttgtctaaatccagggtttctatttcaaaattttcaaaataagaataaaggccaaaaaataagattttagggtcaaaaataagaacattttgcaaaattgcttcaaatatttttacattttattcgatcaaaaatgtattctattattatatttttcataaatttcagtgcattcgggatcactaaatcagatttttaacattttttgcggcatatttccaaaaaacttggtgaatgtgcgaggggagaggtccggtggtgccgattggcgccgcaagcggaaaatttttaagactatatgaattttgttagaaattagccaaattttttagaaatttcccttatgcctataattttaggcttatattttaaaaacttttatcgaattagctctcaatataaataataaaattgcactgaattttataggcatattccccggtaaaggactattaactagagaccggaaatttcaaatttgcggatcccgctgcgggactggaatccaaaattttttgcgggacgggatcccgcgggattaatcccgcaaatcccgcatttaaaatttgcgggatcccgtgcgggattgcgggattttggaaaattcgaaaaaatttcaattaaatttcaaaaaatttccaaaaaacaaaaaatacctgacattttgaaaaagaaattttttaggggctggggtgcatttaaaggggctgatgggtcgactaagattttcaaatggatcagcagactgtaaaaagagatcgggaaccaaaatctcctaatgatccataaatttgaatatttttgcttttcaaaaccgttttttggtgcgctattttttcaaaaaactaggaacagggtggggggggggcccgccgtagaaattctttgaaatttaatacgatttgttaatagattttgtaaaaaatgaccaaattttgtaattttgagtgaattttttaaaagagaataatgtggaggccatccggcgggttacctatcatttcgtcactgagaaataattttttaaaaatgttggcaaaatgtcattatgtaaattattttcattaaataaaatatttttatttcggaaatgtttattaaactagcggggagataattatattgaaaataaattctgttattatttttttaaatatatttttttaaattctttgtttcaagcgatggaaaatatgcacaaataagagtgcgaattggccagtaaattttaattttcggctaaaggatcgctatcttaaatctgcacatctgttgtttacttttttatttgaatgaaattgaagaaataacaattagtacatattattcggttcatcgcagcaaataaacgaaaataagagtttttttaccaaataataactctttctgataagcaatttcatttttctgttttggcttaaattgtttttaatttgtgtaaattattagtcccaaaaatagtcttaaaatggacaattgggttcaacttcaactgaaagggacaattgcgctcaatttaaaaaaatatattaaaaaaataataacagaatttcttttcaatataattatctatttaataaacatttccgaaataaaaaatattttattaatgaaaataattagagatcgacattttgaaaaaagcctggacctggacctggattccatgttggacctggaccttgatttcctggacaaaaatccaggaaaatctaggtccaggaaaaatccaggctcctctagacctggatccaggcctggacctggattttttgaaatttattttaacaatcaaaaaaatgtttgaaaaaattaattatttgctagaaacatctaaaaatatctaattaataataataataatgtgtttttaaatttatttaatctgtttttgaaaacttgaaaaaacatcggtcacttgaaaaa

SEQ ID NO: 64854 - DNA, 941 bp, Heterodera glycines
  misc_feature (273)..(273): n is a, c, g, or t
  misc_feature (324)..(324): n is a, c, g, or t
  misc_feature (332)..(332): n is a, c, g, or t
  misc_feature (337)..(337): n is a, c, g, or t
  misc_feature (344)..(344): n is a, c, g, or t
  Genomic contig location: Contig_ID=SeqID_7449; Location=449..1389; Strand=+
  SCN-specific regions: Sequence locations=1-11,46-484,518-941
atgtatttgtcaaaaataatttttttatttttttataattttaatggtgtatttggaatttatgaaattgatagtaaagaggatcttaaagatttaaatgtaaaaacggaaaattgtaaaaaagtaaagatagagaatttttctgtttctgtaaaaaatgagccaatttttgatgataaacatttggtggggaaaatcggacattttgcagaaaatgcgactgatcaaaagcatgaagagtttgcgattaaaaaagaatctgatcagcagagnatttattgtattgatgaggataatggggatgaaaatgggaaagtaattttngttatttngaganaaatttntttaggtgtataaaaaaagtctcggtcttgagtctcgatcgaaaatgtagactcagaccgataacttgagccgagcccaaaaaccgccgcgagacaaataaattttatatatggcaatagttatgttaataaatttagccaaaaaataaataaaatttataaatgtttaaaatgtagataggtataactccaaattagtaaattggaaaaaaatatcgttaccaactttaaaaaaactaaattttttcgtaaatttttttatgaggtttatttttggtaaataatttttagatatcctcggcagaaacggatgaattggaaatggtgaagcaatttgacgtaatgaaaaatgaattgcgactgaataaaaactataaacaattatcaaaaagtaaatttgaagcaattgtagcacaaaaattgggcaaaagccgtgcacaaatttatgcattaaaaaggaaattgaagaaaaaatatggaaaaataattaacacaaaaatggaggaaaatgccgagacaaaattaatgataattaggcaatttgatgagatgaaagcggaagagaagcgaaatggaaaacttaagacggaaaactta

SEQ ID NO: 64855 - DNA, 350 bp, Heterodera glycines
  Genomic contig location: Contig_ID=SeqID_35262; Location=110..459; Strand=-
  SCN-specific regions: Sequence locations=1-87,109-276,298-350
atggttgcttcttcattctctaataatggcaaaaatattttggaatcgccgttcaaactaacaggttacatacttattaaactatgttttgtatttttcaaataataattacctattcaggagaatgcaaattgctctattattgtacaaacgaattgggtcattttttgaaccaaacatcaaatgctttaatcggcaatcctctgagaatagttccgtttgatgggcttagctctccacaaaaggtttggtttcatggaacatggctgagtattcgggatcaaaaacaaaaattaactgaaaccattgcaacaccaaaaaataatcattctgcacagattcgatcataa

SEQ ID NO: 64856 - DNA, 304 bp, Heterodera glycines
  Genomic contig location: Contig_ID=SeqID_35264; Location=83..386; Strand=-
  SCN-specific regions: Sequence locations=1-304
aaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 64857 - DNA, 304 bp, Heterodera glycines; identical to SEQ ID NO: 51570
  Genomic contig location: Contig_ID=SeqID_35264; Location=463..766; Strand=-
  SCN-specific regions: Sequence locations=1-304

SEQ ID NO: 64858 - DNA, 830 bp, Heterodera glycines
  Genomic contig location: Contig_ID=SeqID_35267; Location=35..864; Strand=+
  SCN-specific regions: Sequence locations=1-447,469-618,641-670,692 -694,716-830
atggacgatctttatgaggaatataagaagcatgatgaaatgggtaaaagttgcactttttgagttttaggcgttcatctttaatatgagcgtattttttagttcttaaagtagtaccaaagatttatttgagcatttttcgagaaaaattggtttttgcctaaaattccttagcaaagaattaataagaaccgaaaaatttaccaccaagaatcgaactactctctaaaaaattggctttttatcaacaaaatccatggaatttactcatttatcatttaattggagagccccgtgaattttatttaaataaaaacggtaataaaagaacaatattttcagactcaattgtatatcgtgtgtggaagaatcgaatagaaaaatattgtgcgaacaaaaaaaggacaattttcaatttgacatttgttaaatgtgcggcagaaattgcccatttccgagtgattaaccaaaacaaaaattcaaaagatgcttatgtgaatttaaaagttgtcccagataagtatttgcaagatggatttgttggatttttgcattatgacaaaacacttggccaacaaattgctgagaaatttgaaaaagaaatcttttctaacaaagaacaaattaatgaaagggtggagaaccaaattatgcaattggccttctcatttgcagcccgggtgatcctctgcataatgtaagcgctttattaaattctaatgggactgtaattgtagcaattagctgtgggcgcttttttttgtaaggaatgcccgtttggggtttttttgtaaggaccgcccatttacgataattgactcgtcaaaata

SEQ ID NO: 64859 - DNA, 889 bp, Heterodera glycines
  Genomic contig location: Contig_ID=SeqID_35269; Location=362..1250; Strand=+
  SCN-specific regions: Sequence locations=1-393,418-889
atgtcttcagctcgatgccggatggctttggggcccgcgctgttccgacttcggcaacatgtcactacggccgaaaatttgctggacgagcccgtgatcaatgccgagacgaccgaaaaccttgaacaggaacgggggcacatcacccgtatcctgtcaaggatggaggtcgagctggacgcgtggggtgccattatgaacggactgcaaggcccagcgagagaggcggaggaagcgcttttcactgcctttattcgagatgaccggcacttgacggagtggttggaagatgcgcgagaaatgctggctcacatagcagcagaactcgcagatgagcccaaccagccaatcgcggcgggaggacagcaaccagctgttgctgtgaatcaacccgtgccagccgtgccattcgtcaacaatgccgcatttctcggcggtgccaatgttcaacagccagctgctgttgccaaccatgccaatcagccaccattggtgccaaataatgcccaaatcgtgccaaacttgccggctgttgctgcgcctgcgcctttagccactgctcggctgccgcagctcagtcttcctgttttttcgggcgaaccaatggaatggcccgcgttttggcagagtttcgagagtgccgtcgaccgtgccgcccttgagcccgtcgacaagctcaactatctccacggttgcttacgcggaaaggctgctcgtgccgtaaccgcctaccgtggaggggacaattatgcccatgccgttgccgcactcaggcgactcttcggagatccacggaaaattgccgaagcacttcagtccgaactgatcaatctccggcctgtggacgatagcgttggatcactgcaacacttcctcgagactttggagc

SEQ ID NO: 64860 - DNA, 287 bp, Heterodera glycines
  Genomic contig location: Contig_ID=SeqID_7453; Location=724..1010; Strand=-
  SCN-specific regions: Sequence locations=1-190,213-287
atggcactggcacagcagggtgccgagaagaataacgccgaacaagaccagtttcatgatgatttgatggtgagttaattaaacgaaataaaaggcaaaattttctagctttaaaattcaaaaattaaaataaaacattaagaaaaagaatcgaaaaataattagataaaatttagctagcacatttttcaattaaaaaaatattaaattttgtcaaatttagccagattgcccgaaattatgatttgaaattgtaaggtggaggggaggtgatactcgaaaataaa

SEQ ID NO: 64861 - DNA, 563 bp, Heterodera glycines
  Genomic contig location: Contig_ID=SeqID_7453; Location=1..563; Strand=+
  SCN-specific regions: Sequence locations=1-274,300-522,544-563
tttttggggtccaagaattcgaatatcttttcggcaccttatcccgaccctgatcccaacccttttttccttgcatccatagcattttttggacccggaattcagtatttcgaaaattgatatcccgaccgtggtccaccaatctcccttttccccaacaaacattcataacgcaacaaaatttggggctggctctccattgttcaactctcatcaaaaccaatgaattttgcttgggcctgacttgtcccgtcccaactgagtacacaagagagccaaaaaataaaacatttttcgtttgcccattttggcggattgaaaatgttcagtctccccgttctccgttcacaaacacagctcccccccaatctcaaatttcgcgcatcaaccaatttcactctcggttagtttcacaaataaacaattctttgccaaccccgcgcctccggggacggcggacggggcggggatcgggcgagatgagtaataaataccccaacccaacccccgcccccccctctctttttaatgtcatataattcacacaatgttcttcacttcct

SEQ ID NO: 64862 - DNA, 149 bp, Heterodera glycines
  Genomic contig location: Contig_ID=SeqID_7453; Location=1229..1377; Strand=+
  SCN-specific regions: Sequence locations=1-149
atgatgttgacgcgggcaaagcgtgccagcggcggccgatggaccacgcagcagatcatcgagtgcattttcgcaattttcatcccgcccgttgctgtgctgatccatggcggccacgaatgggtgctccatctgatcatcaacatcgt

SEQ ID NO: 64863 - DNA, 896 bp, Heterodera glycines
  misc_feature (847)..(847): n is a, c, g, or t
  misc_feature (880)..(880): n is a, c, g, or t
  Genomic contig location: Contig_ID=SeqID_35272; Location=29..924; Strand=+
  SCN-specific regions: Sequence locations=1-166,188-397,421-704,726-896
atgaccttaatacttatgacagaaatgaccgccgttacggtaattggaaattgacagtaatatattatgaagtgatttttaaatattaattaatccgggggatcactgtagcaacgatttggatcgtgacaattattactcaaaattaaggtaattatgcgccacgaagtggctttccggaagattacaactttaatgacctaaatcgtgacaattatgatccaaattatgataattatgttccaagcatagatattgacaagcgttattcaaagaatggtaatagttgctataatgtcaagttgccaaaaagtttaatgttataaccggtaatgttcaatttatttaaaacttgtaagattatgattttggaaattacgctaacatattaatgaagtaattatttaatatttatttttagtaaagtggagactaattatagttattattttatgtcacagtgcaaagtatccagagtgacaattattacactaaattaaggtaattatgcgccaagaagcggttttccggatgataaaaatttgaatgatcaaaatcgtgataattatgacccaagttatgataattatggtccaacttatgataatgatagcccaaaccgtgatgctgatcaacgttatccaaaaaatggtattaatagctataatgatagcgttgaaacgaagtttatgttataaatacaaatataataatatcaatatgcctattatataaaaattttggagataattttaggaaaaattcaatttaattattttaagaaattggcaaatgccaaagtttcttcaacttgcaccatgtcaggcagcaatttttatggacttgnagctagaagacgaaaaatcaagaacagcaattngaagtcaaaaaaatga

SEQ ID NO: 64864 - DNA, 262 bp, Heterodera glycines
  Genomic contig location: Contig_ID=SeqID_35276; Location=687..948; Strand=-
  SCN-specific regions: Sequence locations=1-67,89-262
tatagaggaagctattcccgcaggattcggtctcccctttatctgggcgcatcggttcggggggactgccccgaaaatttaaaaattgattttttcaagtgtccgtttggggtactcaaacaattatcggggagcaaaaatccaacgcagaattaaagtacaggctatagggaagctattccggaaggattcggtctccccataaatctgggcgcatcggttcggggggactgccccgaaaacaaaaaaatcgattttttca

SEQ ID NO: 64865 - DNA, 632 bp, Heterodera glycines
  Genomic contig location: Contig_ID=SeqID_35279; Location=73..704; Strand=+
  SCN-specific regions: Sequence locations=1-216,241-298,320-365,387 -477,500-591
atgttagagtgcctgaatacagcaagccaaataaaaattatcaatgacaaaaattcaattatccattttaattttgtttttgggcttaagcgcgccaccgtttggggattctttactgataattcgaacgcgttggcctcgcgttttcggtgttcatttcaaatggtgcaattaaatgctccttctgtggtaagttgaaatacgatttaatgagagaaataaattattttaattaattttccatttaaaggaatgggacgtcgctttggtcactttcgctgaccgttcattgttgagaaacagttggaatgctctttccaatgcgattcatacagctttaattcgggtaggtacatataaataaaatgtttttcaataattatttccaaatgatcattactagggctgtaaattttaggcaagaaaaatcgtgaaacattatttaaataggtacaagaaagacaaaatatgtaggtattaaacaggtacaaaaattccaaaaaatgtattaaacaaagttttattaacgatttttttagtctaaaaagcaaataaaaaggttaaattttggttcttttactgtgttaaacgaataatttaaatattttcttagaaaatttaatatttttaaa

SEQ ID NO: 64866 - DNA, 2092 bp, Heterodera glycines
  Genomic contig location: Contig_ID=SeqID_7454; Location=14..2105; Strand=-
  SCN-specific regions: Sequence locations=1-139,174-288,320-353,375 -672,710-1069,1092-1111,1135-2092
atgccaacggacaatttgtgccaatggctcaaaattcgacggattggaagaagaagcattgccaacgtccgtgatttgcaatgcgtgaaaatcgcttctcataaattcactaaaatatataagtgattaatttatacccaaatttttttttgtttttaaaatttttttattatgtgttaaatgggaaataatttggcttttctataatatttttcttctctaattatgtgccatttcctttgcctctgactgccttttattcttttaattcaattctctaattatatgctattttccttttgtttttctctctaatgtattcctatttttctcaatcgatattcctttgcttttcttctcccttgtgctttcctttattcattctatttggtgttcacaaatttggacctcagacttttctcctctaaatattttgtgtgtggactcttaattttcgtcgtcttcgcattgaatttaaattaaataaattgaactgtccccgactatttcgccgtccttaattaataagcattggccccgtttgtcctttctgtgctaattaattatttggcccgagaagaggaaaagccgaacgaagcaaagcaaaagagacgagcccctccgaccaattggactccaatttttgcacgtggcgctcctggtcaactgagtaagcggtgccgggaatttttggtttttcgaaaaagggcgagctcgggaacaaaattggaagggagaaatttgtggttcacgggaattcaacaaaagtgaagtagtccgtctgtcggagctttacttagttgttcatcaaagcgaatagcccgtttgccggggttcgttatctcgccgtttattgcttgcctgtctgccaggggcaataaagcaacaaagtgaggacgaggagcaagggacatttcagaaaaacgcatagctgcgattctgaataaataacgcattgttgcgcttttcttcgagttgcatttgtgtcccacaaataacgcattgttgcgataagtgtggacatcgacaaatcaccgacaaatcgggccgtttttcgaggatcgccgtttaactttgtttttgttttgttgagtagtacctctgcggtagctcaaacaaaatgcctgttctccgaacgccaccactaacccggacgagggcactcaaccagggaatcattgttgaccgcgatggaaacgcaattagggctgaaaattttggagtttcggggggcaggccgactcgcccttagcaaacaacgaaaatcagcgactggacgacaatcatgaaaatgttttagcagagactgagattcgtcgtcgcctgctttacggaggaatggaacaaagcgcacctgaggaacaattggagtacgacgaaatggaaaacggcgacgaacaaaatgtcaacggtatggtgcaacaaaatttcgaaaatggagttgaagctggggatagagggagttttggaaacgatgcattggacgcacatgggttgcgagcgttttcaacgccgcttaacgagcaaaatctaagcgctctgcagcgagacctaagaatgcaacttccggaaaatttgagcgtcatacaaaaccaaattagggttatgaatttcatgcaaaatcaaatgccaaacccagtcgcgcataatttccctgcattgaatccgattgcttgccgacccaatggccagttgtacgaaaacgctgcggttaattttgagcggcagagagaacagcagataaggctcacacagcaaccggttgttgaggaccaacaatcacacgttcggcgaattcctccgccacatgcctatacacaaggacaccgtcggtcccaggacgaaggatttgagtttcaccaaggacagcaacacccaaatttcaaaaaaaacctacctataagagccaatcaacaaaatcgtcctgagtgcaatcagcaaccggtcccccaccctgggctggtattcgatggcatgatggcacaggccattcgaagcctcgacggtttttcatatacgatgacactcaacgcaattccgaacctggacggcaacagaggtactgattcggtgaatgctttcttcaagccaa

SEQ ID NO: 64867 - DNA, 646 bp, Heterodera glycines
  Genomic contig location: Contig_ID=SeqID_7454; Location=3258..3903; Strand=+
  SCN-specific regions: Sequence locations=1-155,182-375,429-500,523 -604,629-646
atgctgctcaaattggccgactatttccaggtgagttcctctgatcacttatcaaaacctcatttaatgtttaaattttctctatcagcctgtaaaatttttatgaccaaaactattaaaaaaatttgtgtttttttctaatttttttgtaacctaattaaaaattctttaaaatttggaggctaatagagaacattaatggccataaatgaccccaaattcgctaattagtttgcttataaaaaagtgtcgcttcgctttgaggtgaccgcgttgaagtcgcgctgtgaaaagcatctgatcaattgcgtggaaattccgctgatcgaccgtttccttctgattgaacgcttcggactcggcaatttgaaagtgatttatttttcaattaatttaaattatattttcaatttttagtattattttttggattttgatgtcatcaaattgcgtacctttttcaacgcgaaccatgaacaagtctttccttttatcagcaaagaattttttggtgaattattgctccgagtttgtggatgaatgaatttgttaaactcttttgatcaaattgattttggcattttcaatttctttacgaaattaattttcggtgataaaatttgttttattttttttctgatctgga

SEQ ID NO: 64868 - DNA, 998 bp, Heterodera glycines
  Genomic contig location: Contig_ID=SeqID_35282; Location=192..1189; Strand=+
  SCN-specific regions: Sequence locations=1-256,279-279,321-970,992-998
  Gene Ontology: Mol. function=ATP binding; Cellular component=nucleus; Biological process=calcium ion transport
atggggaaatgcttttcatcgctaaagcgtcatcacaatttgcaagccgatgatagttcagtgaaggagttccaacatttttcaaagggtttcaagcagcaggccgggacttcatcaacaattgcccaacacaatgctgcatttaggcataaaaacgggaattaacattgcatttaaaaacaagcatttagatcaaactcaaaattggcaatgcaaacttctttttcatctattggaaatgcacgatactgtcgcaatcagcaaaaattgtcaaatgatatgtcaaattgtaaaaatttgcagagaaatggagcaaaaaatgcatactgtatttttttgggtttaataaccaacaaaataagcaatcaaaatgaattttgacttcagctgagggagtgtccacttcattccaagccattcaaaaacttgttgcaatgttcgcatacgaatctcggtctgacgaagaattggagtttcaggcatgcaaaatttggacaaaacaatgattattaccaatgatggtctttattcagaaaggcgacatcatgtatttaatggaaaactcgtaaattgcaaattttcacaaaaattggcatttttgtgtttctattaagcaaccttgactggtggtatgtcagaaacatgaagggtaaacagggatttgtgccgagttcctttgtcgcatttgtgaaaacgccgcaagcggaggaatggtttgctggtcgaattccgcgcactgttgctgaacgattggtggtggacaaccattttccgcccggaacttttttggtccgcgaacgggaggtggaccaactggaatacgcattgaccatccgtgacatggacactggacatgggccatgcgtgaagcattacagagtcagacagaccgatgatgcccaaggctacttcataagccataaagcggtgttcaaatcgttggatgcgttggttaaatattattcaggtccaaatttattttttcgtgttactttact

SEQ ID NO: 64869 - DNA, 308 bp, Heterodera glycines
  Genomic contig location: Contig_ID=SeqID_35284; Location=39..346; Strand=+
  SCN-specific regions: Sequence locations=1-308
atgtatgcgtatggcattatgcttatcgctggatatggtgctttgatttttgctggagcgggattaatcctcgcgcttgctgcgttggtgatcccagttgtcaaccgtatgtggaagctcgagaatgagtcttcgcgacaacgggatgtgctcaatgcactcaaaagtcaagtggacaacaatcagtccgaatgcgacaaattgaactttgaagtttttaaattgaacaaaaagtgtgcacacttgcccagtgactagtgtaatattggtgctacattttttagaaaaatatttcgctttttatctga

SEQ ID NO: 64870 - DNA, 575 bp, Heterodera glycines
  misc_feature (505)..(505): n is a, c, g, or t
  Genomic contig location: Contig_ID=SeqID_35286; Location=433..1007; Strand=+
  SCN-specific regions: Sequence locations=1-307,329-575
atgagaaaaacaattgttggcactgaatggatgatatataaaaatcgtgatattggaattatgctttttgcatcaaaaattcaattagaagctgctaaaaattgcaaagtaatggtagcagacgctacatttgagatagcgcctagaggatttagacaaatatggcttattcatggactggtaaaaatcaaaataactttgtgcattaaaaattactaaataatttaaagacgtatggtgctatttatatgcgctgcctttgctacacatccaaacagaattacaaaggctgtggagagaatatatcaaacagaaagaagaaatagctaaatttataaatacattaggggtgccgggtctactaaaaatcaaatgcagcgaaatagtcgcaccttaaaaaaaatttgaatttgattaggatttaaaagaaaatttaaacgaattcttcgttactttgaaaaagaatggattaaaaattgatacaaggagggtgtggaagttcaanggaatcaagaacccgaaacacaaatccagcagtagcttggcattctgtcatttaaagttaaatgaagaaa

SEQ ID NO: 64871 - DNA, 690 bp, Heterodera glycines
  Genomic contig location: Contig_ID=SeqID_35287; Location=175..864; Strand=-
  SCN-specific regions: Sequence locations=1-642,685-690
  Gene Ontology: Biological process=signal transduction
atggcacgcttttctatcggcggattgaacattttcgagtctgaatcggccattgcttttgcaatgagtgaacgacggaacccaaaagaacaagctccacatggaattgagcttaaaatgcaggaagtgccggtgaatgcactcggagacgaaaacgacgaaacggtacgaggagagtactccaaatgctaccacacgtaagagactaattataggcactatccaacagagtaactttcaaattccgtttcagttttcaacaaattggaaacggaacttttggttcagtgaaattggccactcaaaaaggcactggacttatggcagtatcgaagtttatttgcaaggacaaagtgttgccagaaagttggattcagtgcccgaaaagagcgaacaaaatggtgccaattgaagtccatctgctggagaatctgagccatccaaatattgtgcgggtgctcggcgtgtttgaaaacgacaagtattatcagctggtgatggaaaagtgcggctgtggcatggacctattcgaattcatcgatcatcagcccaaaatggacgaaccgctgattagctatattttcagacaggtaacaaaatctgttgtaacgccacgtttaaggctttaagacatttgaattaccttccttttgaagaggaatttattaatgggaaaatcattaaaataaa

SEQ ID NO: 64872 - DNA, 626 bp, Heterodera glycines
  Genomic contig location: Contig_ID=SeqID_35288; Location=262..887; Strand=-
  SCN-specific regions: Sequence locations=1-171,208-241,264-269,337-626
atgcgtggtacttatgacgaagatggatacggctcgcttgaggacaaagaatgcgacaaaggccaacagttttgctacttggcaaactgtaaaaccggtaatgacattggaatgcgttatttgacctcgcttaaaagacccaaatttggtactaaaatgcgtatgattgtcaataattttttgtaaatatttttttttcaaaaaaaactaactaaactcaaaatttaagttaatgaaagattttctagaaatgactttttattcttttcaaaaaaaatttttaattaaaataattaatttattaaaatattatttaaaaaattcattaaaattaatgcattttcttgttcaaataacttgtagacatggtcagctatttgtcttgggattgtgcgaaagacacggattgtgccaaaatttcggctgattggaccatgaacagaggcggcggcaattactcgtgcgagtgcacatttggcgcccctggattaaacttgggcaacgaaaagctgcacattccgatggcacgtacgattgtgttcaccgaaatggaaatccccaacagcggaatttcttcatgtaatatgcaaattggtggtgccattctttgggtgctgggtgattaa

SEQ ID NO: 64873 - DNA, 327 bp, Heterodera glycines
  Genomic contig location: Contig_ID=SeqID_35289; Location=177..503; Strand=-
  SCN-specific regions: Sequence locations=1-327
atgacccggctgctccttgatgtggaattccacgtccacgtcggacttgacgagcaacaagtcagcaggatgtggtcgaaggatgagacgtgggtaattggagatgagagcatccaccagcaggtcaaactgtcggacttggaggttgctgagcgggtagcagacgctaaccggtgtgaagaccagtgtgtgatcggatttccattgccaggagatgatctcgctgatcgttcgcccattgccgatgagattgagctgctcttcagcaagctccgatccatctcgacataccagcagcgcgcctttgctgggtttgcagtaaggtag

SEQ ID NO: 64874 - DNA, 393 bp, Heterodera glycines
  Genomic contig location: Contig_ID=SeqID_35290; Location=328..720; Strand=+
  SCN-specific regions: Sequence locations=1-393
atgaatggaggtggcagcaacaacagttttctctgtgtaatttttgactgtaatgcgtataattggggctgtgtggtcgctgaacgcggtgtgtctacgcttaacgaaactgtctccgcactaattgctctttgcaatgcgcataatttctcctcgctcggaaatcgtcttttgctactcgcaaaaggagccaagcaacaagaaaagaaattgttcaccaacgaacgaattactgcgaaagaattgacaaattttgggccggccattgaaggaattattcatcaaattttggctaagaatgtttctgctgaagaaagccctttcaatttgtccagtgcattgtctttgagtatttgcggtatgttaatgagattacatcatgcatttacctaa

SEQ ID NO: 64875 - DNA, 2030 bp, Heterodera glycines
  Genomic contig location: Contig_ID=SeqID_7455; Location=1352..3381; Strand=+
  SCN-specific regions: Sequence locations=1-85,108-146,168-196,218 -552,574-692,715-781,803-936,958-981,1003-1281,1303-1745,1767-2030
atggaagatgacgcaatggttgagcttgcaaaaggacccgaatattttaacaaattttgcgcggataaaggattaattatcaatgagaaaaaccaatttgtgtctgataaatatgaagtccaccttggccttttgtatgttatgcgaatgaaatggaatcatgtgatggaaacgcgagtaagcaaattctctgtatattaattaattaattaattaactcgacttgacaaatggttagcgataatttgggcaatggaaccactgggcccacagtgaacagtttgggaaattgttgtaaaaaactaattttcaacaatttcgtgatttaccggaactcagaaatttttactgtactcctccacattcagtctgatcactgccccaaaattatccacggccacaatcaattgtccaaataataggcaaaaccatggccaattactaattataccggagacaaaatttaaaaaagccataataaaaggcaacgtataagcttcaaaccaattggaaaatgtgtttttttatgcttaaaatatcggaaattttaccatcttatttttaagcataattcaagcttcattaatgaattggaaaacattcgccaatttgctttcattctctacgaatacttcttctggcaatatgttgctgaatatgtaaaaggtaacggaatttcgaacccaaattttaaattgaaatttcaaattaaattaaatcccgtaaaattttctagcagtagacccaactttagctgaacaaatttccattacaaagaatcccattaaaccaaaattaaaaagcaacgggagagaaataaagttttgtgaagcgatcctagattgggcattcgtttggaagaatcaaatgtggggcggaaattattctaaaacgacacgcttaattaataaagaaacgctaattgaaaattatggaataaatttaaacaattggtatgagcaagaatcattgtttgacatgacaaaattgaaattggaattgaatgccaattcaaaatttgacaattcatttccccgtcttcgcaaaatgttcgatttcaacatggcaaaatgaaagaggatgacactggagaaggtgtcagtaattgatatgctaattgaattttcttcaataacaaacgaaacattgatttggcatattaatgacaagccattttatgaaatagacaaagcggtaaatgaactggaagtatttttggcgctttcagtgatgcttgaggagagtctcaactcgagacaagtggtctcggccttttatgagtctcggtctcgggaaattttcggtctcaagcatcacctaggtactttgcgccagggaaggcacgggattccgattcttgtttgccgagatttatgggatcggaattcaggttcctgaaaaaattttggaggttcgttggcattccgatttccgaaatttttttcgacacaaatttttcagacataaaatcttaaatggcggcgattcactgctaaaatgagtcatttttctattcatcgaaaaatttttgacaaatcctctcatgaatttcaaatttttattttatgtccaaaaagtcaatcctgggggagatgtacgtatgtttctttcgattttaagaccttttattatttggttcttgtccaaaatagtaccaaatttccggtaaaagtcaaaaaatagtgtgaaatatgacttttattcttgtatagccctaagcatacatataaatataattttagatcgaagacaacatatttcttgttgttctgaaagaaatgcgtgttgaaaagtttggtgccaaattggaaacggcgccattaagtgccaatgccaaatcattgatccattcacagaaattggaaatcaagctctatcttaaaatcatttatttgatgagactcaaatggcaatgtgcggaaattgagaattaccgaaaagaatgcacaaaattccgaaaatatttcaattttttgtatgaatatctcttccgaacatacaatgaaggtattgtgagaaactttgtttaa

SEQ ID NO: 64876 - DNA, 967 bp, Heterodera glycines
  Genomic contig location: Contig_ID=SeqID_35292; Location=1..967; Strand=-
  SCN-specific regions: Sequence locations=1-227,250-414,436-603,625 -852,874-967
  Gene Ontology: Mol. function=ATP citrate synthase activity; Cellular component=mitochondrion; Biological process=ATP catabolism
gttccaagtcgccttcccttcctttctactctctcgacccttcattttcagaaaacgattgcccgaatatgcaaatcgtttttcgaaattgtttgatgctaccgccgaccacgggcccgccgttagcggtgcccacaatacaaatgtttgtgcaagggctggcaaggacttgatctcgtcgctggtttccggattattgaccattgtgagtgtggggcagtgggctgaccatttgaaaatccgccatgggataataaaaagagattataaaattcttttaatcaaccaaatttaacgctttggtatcattcgaatgaaattctgaaatctctatttttgaaattaatattctgatgaaaataaaagctattgagaataatgataccaatttgtttaatttggttgactttaagcaattttattttattttattatcccatgtcggaatttaggaatgtcctagcaccgggttgtcgtaaaagtagaggaggctgaaaacagtgacggatttacaattgacattttcagggtgaccgttttggcggtgctttggacggggccgcgaagagtttcagtgaagcaatggacacgggactgagtgccatgcaatttgtgaatgagcagaagcggctgggcaaactcattccggggattgggcacagagtaaaatcggtgagactgggggggggggggggcacagcgacgaaagaaatggcggcgattgttcagataaacaacccggacaaaagagtggaaatactgaaagagatagcgaagaacaagaccttcttcaaacaggagacgcctctttttgactacgcactcaaagtggagcaaatcacaacttcgaaagtgacagcaaacccagacgccctcctcatcagaaaatttgtttagaagcccaacttaattttgaacgtcgatgagcgaattgcgacaattttcgtggacattcttcgccattcgg

SEQ ID NO: 64877 - DNA, 895 bp, Heterodera glycines
  Genomic contig location: Contig_ID=SeqID_35293; Location=64..958; Strand=-
  SCN-specific regions: Sequence locations=1-111,134-512,534-895
  Gene Ontology: Mol. function=glycine transporter activity; Cellular component=plasma membrane; Biological process=alanine transport
gaacattgtcaacataatcataatcgtccaccaattcggcttatgtatcatgtactatctgttcattgcatcgacctttcaaacggttgctgtgtttgtattgcgtttatcaaaacaaaaactttttgcaggtctttgataaagaaaaagctgacaatgagcccaagggaaaagacccaagatggtttctcttcatattgcttccgattgtcgctctcgtaagtggatgagtcatttgttaattgctgtgcactttaacaccttttcagaattccattatgtccatgcgtatcctctcagttatgtgccttgtcggagatgggttgacgatcaccagtttgacactcattctctttgtttgtgctgatgttttgtcaattcttttcttttcactctttcagatgctgtcccaaattgtattcacggaaagagcccattccattccgtttgccctgccatccgcagaaggctttttcaaagcgagtggtaccatcattgtctcttgccttgcccagtcattggtacgatgtcataatgtttgtaaaattgtcaatatcttcggttatttttaggtgcttcctttggagaagcgaatcaaaaagcccagtcaaatgttgggaccctttggcgttttgtccggtggtatcgctatttcgactatcgtttacgcaattgtcggttttctcggctattgtgcttatggagaagaaattcaatctactgttttggaacatcttgaatgtgttaagtaagtgaagttttgtgcatcattgtatagcaaatttctttttccagtaacgcaaaagagttgactgttttgacttttatcattcgggttgccctctgtctgtccatcttcgcttcttttatgctcccaatgttcgttcttgtcggg

SEQ ID NO: 64878 - DNA, 56 bp, Heterodera glycines; identical to SEQ ID NO: 52733
  Genomic contig location: Contig_ID=SeqID_35294; Location=645..700; Strand=+
  SCN-specific regions: Sequence locations=1-56

SEQ ID NO: 64879 - DNA, 309 bp, Heterodera glycines
  Genomic contig location: Contig_ID=SeqID_35295; Location=407..715; Strand=+
  SCN-specific regions: Sequence locations=1-27,85-239,261-268,307-309
atgcaagagaacattgaaggaattttgaaaaataatattaaaaataaagacaaaaatgtttttaaataataaaaataaagacaattaaaaggtttaaagagattaagcctcggcagcccatgcgggtgtcaagaatctcggagattgcgaatttcggggatggaatcagattagcggtcgaacccgtcaattttcttagggaaccgaccgagccaaatatgatgtacccacaatttgttagtaaatttattttttaggcagttcatcgaaaattaattttaaaaaattaattcaaattaaatttttcga

SEQ ID NO: 64880 - DNA, 175 bp, Heterodera glycines
  Genomic contig location: Contig_ID=SeqID_35297; Location=841..1015; Strand=+
  SCN-specific regions: Sequence locations=1-175
ctgctgtaccaaatgttacaattccatgacgggctgtcttcagaagtgcatcattgagcacaagggggacccggcctgtcgcaagacttgcaagcccaatgtgtacaaatgcgctgccaaatgcgggccccactgtccgctaaattggacgacgacgacgccgaagagcggctaa

SEQ ID NO: 64881 - DNA, 2027 bp, Heterodera glycines
  Genomic contig location: Contig_ID=SeqID_7457; Location=1975..4001; Strand=+
  SCN-specific regions: Sequence locations=1-72,94-192,228-357,432 -495,573-831,854-952,996-1258,1303-1414,1714-1868,1916-1971,1993-2027
atgcaaatttttgtgtgtcaatttatttacggcgggcgatttaaatcctaaaacttttaggcgcacaaatttattcaattttaaagggggaaacaatcattgacaagccgtggaaaactggaatttaaaatgcaaaatgagctttcccttttcccacacaaaatttcatcgatccgtcggaatatttttaggaaaataaaataaaataatatttaatttattaaattgcttttttaattgatttagctaaatcaattaattgcggattttttgaaaagtttcagtcgtccgcctgctcaagccaagaggaaatttgggtcggtggtgccaatttggagcgaccactaaatacccaggtaattaattaaaaaaacaaatatgaattaattaattcatttcatagtttaaatttaattttttaatgtttttttcatctttacgtacccaaattcatcattattaaatttcgttttttttattaattttcaaaagctcttaaaaaatttaattttcaaaaataaaaaaccttttttacattaaaaattaatttccaaatttaattttcaatttttgcagctttacttttcgccctccgctgctgacagccgccggtgttcgacgttggcatcgccgcaggtaaaaaagtgaaaaaaagtaaaataaaatggcaaatcgatttaagagtgaatttgcattttgttcaccttttttgaatcgctgtgaataaattagcattttttgtttgtgccgccgccgaaagcgtcgcggcatttgcgccgcgcgctaatgacacaaaacactttggcaaaacggggagaaaaatgggacaaaacaatttttaatattcacaaaatgccaaaatatacaaataaaaccaacgattattttcgggttggaaaaagtaaaaaaaaaactaactttttaagattttaggactaattaacaatttggcattttttttagatttttgtaatttttttaaatttctaaaataagaaatatccattactttttaccgaaattataaaaattgtttaatgtttcttttttttccaaaattagaaatattcctttttatttcacagaaatgattccaaaaatgtttagtgttttcccaaatgttcagagtctactcagttccggcatgcattcggcgagcagtgccgtcgcgtggagtccgtgctcaagccgttcactttcgccatgtgcctcgccggccaactccctcaaggggtcatggtcatacggtaaaattagctaattaattaaataaaaaataaataataaaataaatatttaaattcacagacataatcaatttgcctgtccatttggaacgacacatcaaagtgctaaaggtaagcaaaaaaagaagacatttttaatatgctaattttattgtttaagaatttacaaaaatataattaaaaatttaaaaatattacttaaaaattataaaatatcaccctaaataaaataatttattgtaatgaaagaatattttaaatttactttcataaaaattaaaatatttagtattttgattaatttcgaataaataaaataattttcacaaaaaaaataatttttctcgcaaattaatgattctaacaattatttaattgacaattcaaaaacttgacatggtaaaataaataaattaaattatcaaaaataaattaaaaataatattttaattttattaattttaatgcattttcaattttcaatttaagtcccatttgccccttggcgttgtgttggatgccaacattgacaaagcgatcaacggatgcgtggtgaaaagcatttgcagcaaaaaagcactggccaaagacggacgaattcaggtgaaaaacaaaaagcgcaaaaaattaattaaattttttataaattcgaatttttatattttttagcccggcgatcacattgtgaaggtgaacggcgaaagtctgcgcaatgtgacaaatgcgcaggcgcgtgccatcatgcgacgggcaaatctcgtcggggcacagtgcgggtga

SEQ ID NO: 64882 - DNA, 1690 bp, Heterodera glycines
  Genomic contig location: Contig_ID=SeqID_7458; Location=1625..3314; Strand=+
  SCN-specific regions: Sequence locations=1-91,113-170,199-250,326 -492,534-866,889-1064,1086-1187,1339-1463,1530-1690
  Gene Ontology: Mol. function=protein binding; Biological process =intracellular signaling cascade
atggcaaagcgaaacaatggcaatttaatgaatgaattcgccggcggagtaatggacaatttttttcgatttttgccatatttttccataaaatgaaaaacaaaatttcaaagaatcattttttccgtcctttttatggcttatttaacagttttttacgctgaaaaacctattaatatttttaaatttctttattttgtttttgcaataaatttttcactaattgttttaagaaatagaaagcattttctttattacttaatttatttttctttactttttttaatgaaaaaattttttaaaaatttaattttattaaatttatgccaattttcagaagcatcgtccgccggcttctcctccgatcagcaaaagtcaacaacaaattgaggaagctgccgctttgatttcgtcttctcgaaaaatgggcacggatggtcaaaaaacaatggcacaaagtgaaaaagtagcagcgaagacaatgccggaggcaataatttaatttaaaataaaaataaattaaattaaatttagtcagccaaatcgatgaacttttggagtgaaccacgcacagttacattgagcagaaggcacaacgaaacattcggtgggtttttcgcattacaaaactataaaatttagagttggacattttgaaaaaaaattggaaaattttgaatatcagaatgaaaggaaaatcgaatatgggtaaatacattagtttatggtaccatacggtacataggatggtagaaacatttcttattgacatttcttgggtaaaattttgtaaaatttcgttaaaatatgatcagaaacccccgacgatttaggctaataaatattaccaccgcattttgcgccacaaattattccaattttaaaaaattacattttccgccgatcaaaaaagccgtatttggcattatgccattctttgttttgtgtcacaggtataagcattgttggtggtcgcgtggaagtcacccaaagggacagcattaccgacgccggcggcactctgccgacgacggcagtgccaatttgcggcggcggtgccgccgctgatgaggagggcacagcactggtggctaaaacggtgtccggcattttcatcaaatcggtggtgcccgactcgccggccggccgatcggggcaattgtttatgggcgatcgggtgcttagggtcagtttattttaaagtattttagaaaattcaatttaaaaaaattcaaattcaaaattttttttaataattatattttagcaaattcaaaattaaatttaaatttttttttaattcaaacttttaatataattttataaaacctttaatttttttctaaaattataaatgatgtttttcttattttcacattaaattagaatttttacaaatatttaaacgtattcccttttcattatcttcatagattcaataaaaaatatttgttaatgtgtgcaaattttagaatattttataaattaaaaaagtaattaatgtttttatttatttttattttttttttggcttaattccaaaatttcccttcgttttctgcaggtaaatgacaccgatctgagcaacaccacccacgattatgcggtgcaagtgatcaaaagtgccaaaaacccagtcaaatttgtggtccaatcgcttcagtccctccaggcgtttgtgccgagctcg

SEQ ID NO: 64883 - DNA, 88 bp, Heterodera glycines; identical to SEQ ID NO: 55892
  Genomic contig location: Contig_ID=SeqID_35302; Location=656..743; Strand=+
  SCN-specific regions: Sequence locations=1-88

SEQ ID NO: 64884 - DNA, 643 bp, Heterodera glycines
  misc_feature (23)..(23): n is a, c, g, or t
  misc_feature (31)..(31): n is a, c, g, or t
  misc_feature (43)..(43): n is a, c, g, or t
  Genomic contig location: Contig_ID=SeqID_35303; Location=311..953; Strand=-
  SCN-specific regions: Sequence locations=1-102,124-362,385-396,444 -557,579-643
atgggcgcttatcataaggacgncatagtantggagcacaatnggaaagggttatattttttattactgccaaattaatcatacgcccataatccgaaatacaaatttatttttattttaactatgcatttgcaaacaattaaagcacaattcattttttcacccattaattaaaaacaactcattagggttgggttcgtaggtccaaatccccgtggtttgaaattttataaacttttccaattaaaaaaaaattttttgaggaggtgtccaaaacttcagttgtattttgttgcttttgccgtccgttatatttttatgaattgcaaaaatgtgtagtgttaaaaaaacagttacaaatcaaatatttaattatataaaaatgcattgcgttccttaataaaatttaattaaaaaatttattttaaatatttatttttaaagacacgagggcaacgaaacattggaagaatatgaccgcaaatttgttgattcattacgtctcaatttggaggagtgtcgtaactttatcatcacccttcttgcaatcgccgagaagcagatggatttattggtgatgagcaacgaagaaaaacaaaaactatctataaaaaaggaagaatatatgtcattttataattaa

SEQ ID NO: 64885 - DNA, 172 bp, Heterodera glycines
  Genomic contig location: Contig_ID=SeqID_35304; Location=600..771; Strand=-
  SCN-specific regions: Sequence locations=1-172
atgagctgtccgccaccagttgttgctgctgttctgctgatgatgatggtccggcttggctctcagccggcaccggctgcaaaacgcgttgccgatgctgctggtgccgatggagatgatcatgctgtcgatattgctcatcagcaacagaatggctgccatcatcttcttg

SEQ ID NO: 64886 - DNA, 214 bp, Heterodera glycines
  Genomic contig location: Contig_ID=SeqID_35305; Location=129..342; Strand=-
  SCN-specific regions: Sequence locations=1-181,203-214
attttcgaatataaaattgctaattcgtaatttgttactttttttaaagttgcaaaaccagattacaggagctattagacaagtgtctaatagagaggtgccacaataagtcccccagaatttctttgcaactttcaaaagggaatgaattttttataaagattatcacagaaataaaacaaaataattaatttatcttttgttggctgtttta

SEQ ID NO: 64887 - DNA, 53 bp, Heterodera glycines
  Genomic contig location: Contig_ID=SeqID_35310; Location=643..695; Strand=+
  SCN-specific regions: Sequence locations=1-53
attgaaagccatccattgcctgccgattctcgtgacaataaagcactaatagg

SEQ ID NO: 64888 - DNA, 633 bp, Heterodera glycines
  Genomic contig location: Contig_ID=SeqID_35311; Location=104..736; Strand=+
  SCN-specific regions: Sequence locations=1-253,286-390,424-433,455 -478,545-633
atggcagtgattgagcccggcggaacagccaatgccaacgaggcccagcagcgaaagaggagggtgagttcgggcaaattctgatggactgtgggtccttgtcgggcccagcttttgcttttctggcccagataagggctcacccctgaggtgtgggcccagattgggctcacccttggggtgtgggcccatgttgggccccttttgtcttttggagccctgattgggctcacgggctgtgagccctgctgtgtattaatcatttaataaaaaaaatttttttttcataaaccgcgttcgggggcagccaagcgaaaagcgaaggagcgatctgttgctcaaccaagagcacctgctgctactaccaacaacccgcacatgccgtttccaatgatgatgccgatgatgatgccaatgatgatgcctttcaatttccccttcccgcctcctccccctccaccatcacaacaacaataattttttttttgcattttcacatttatttttatgcattttcatttatttatttttgtgcttaccttcaataaatcaaattacaaaattcacggtcgaaattttcagtttttcttaatgtttactaataattcaatcaatgacagtgtgattaaataa

SEQ ID NO: 64889 - DNA, 112 bp, Heterodera glycines
  Genomic contig location: Contig_ID=SeqID_7459; Location=78..189; Strand=-
  SCN-specific regions: Sequence locations=1-66,109-112
atgtgcaagttggcaaatgaccgatccattcaattagaaatggacatcagagccggggcaatcaattcatcattccatcatccaccatcatcaacatcatcagcatcaagag

SEQ ID NO: 64890 - DNA, 1088 bp, Heterodera glycines
  Genomic contig location: Contig_ID=SeqID_7459; Location=346..1433; Strand=+
  SCN-specific regions: Sequence locations=1-116,142-203,226-383,405 -458,483-629,651-1088
atgtccaacgaccacaatttatgcaaaatcttttgtgaattatataccgtatgccctcccatttgccacggcaatggcacagcccaatttgctattcaaattggtgccgtccgtcgtgtgtattcatcaaacattattcacgccaaagcatttattggtgcggagggtggccgctctcgactctcgccctgccgtggcgaaattcgccggccaattttcctcgccaatcgaatgaccaattcagtggcatcaacagcaggtgtgtgtggtgccacactttttatccctctcaaaattcattatttgttgaatgaatggtgccgcaccacctcaatggcacattggcgtattatgtcttaattacatgtcctttctgataattcgacttttaattatgaatattttagcttcgagaaaatttaaaagcagtcaattctgtacgaagaagaaaagtaaagatattaaataattttttttaatttccgagcgctaaaatatgttcgaagtttagtcttccccgccccatatttttgcttttggatgaaaagccttgaacatttatcagcttatcacccagcctattcccaacatccgtcaaaaaattagcaagatttttttttgttgatttattgttgtttcttattatcttttcttattggcaaccgttgcttctggtgatgattgattacggattgggaatgctttttttgagtttgccgatgagtgcctctgctgatcatcttcttgtggttttgatggattatgctcacttttctgttggtcattttgagactcgacaaaaaaacaacactaacaaaccaaataattaagcttcttgatcacattttctctcgattatattagactgatcagaacaaacgttaagtcactgccgattttgtgaattcaataaggtcaatcttacgaatttggcaccctaatttattccattattcctagtatttctgctcaagaatttcgcgccatttctcggtctcgagcctcgggaaattccagtttcgagcacactattaatttgatcagacaaacacaatgagaatgccgaaaaattttcccgcaatgatcca

SEQ ID NO: 64891 - DNA, 506 bp, Heterodera glycines
  Genomic contig location: Contig_ID=SeqID_7462; Location=127..632; Strand=+
  SCN-specific regions: Sequence locations=1-127,158-506
tatatacgtgccgagcttcatcttcacggccgattggactcctttttggatgctaaatggacaaaatcaacaacaccaccacttcacattgtccaatttatgtgcagcagtaacaaatggacgcaaaagattggcaaaaatggaaaagactatggcaaatggccaaaaaatgggaccggcggcacaatttggccaagtcggaaaatttcgcttggattgacacgaattgatcagatggacgagaaacagcaaaagaagaattatcatcgccaccaccaaattcactccccgggatggtcaacttttgacgcgatgactccccttttgtacgcatcgaaggacaatgccgagcagcaacaggacgaactgcacataaacgtacaaagggacaaatgattgggatgggcaaagggcgaacagaaaaattgttccgagactccatgcaaacgaaatttttgaacaatttaagccggattcataggttcaaatcagcgaaacattgaaaa

SEQ ID NO: 64892 - DNA, 581 bp, Heterodera glycines
  Genomic contig location: Contig_ID=SeqID_7462; Location=1819..2399; Strand=+
  SCN-specific regions: Sequence locations=1-12,35-182,246-277,332-581
  Gene Ontology: Mol. function=cytokine activity; Cellular component =extracellular space; Biological process=skeletal development
aatgcaaaaggaagccctaaaatgattaatttcacaatttccgttccgacagagatgcgcttggcacaacatgaccgtggactttcaccagttgggttggtccgaccgaatcattgcgccgaagagattcgaggccggcttttgcggcggacattgcgattatccgttggaaaatgtacgacaaaattattaatttatattaattatatttataaatttatttaaaatttttatcaatttattttgacttcaaacaaacggtaaacaatttaacttcaatttattttatcaaataattattaaaattttccattatttacaaaaataatttctttgtttttgccaaggagtccaacccgtcgaaccatgccattctccaatcactaattgcaacccaacagcaacatgaaggacaagcaatagcagcagcacaaccacggcgccgaacaatggcgtcgccttcggccgtttgttgcgcaccggcggagtttgactcgctgacgctgctgtactttgacgaacgggacaatgtggtgctgaagaactacccgcggatggtggtgatgtcttgtggctgtttg

SEQ ID NO: 64893 - DNA, 592 bp, Heterodera glycines
  Genomic contig location: Contig_ID=SeqID_7462; Location=1043..1634; Strand=+
  SCN-specific regions: Sequence locations=1-560
atggacaaagtgcgcaaaacggcggaatatttttcttacggtatggccaaaggcaatgtgaacgatgctgccaatgatgcgcaaatgccgacagaaagtgccggcgatggaaacgattttgacactttccgacgattgaaccgacgccgaaaaatggtgcaaaaaactgtgcaaagcatggaaaatcaaaaataatcactatattaaaaagttaaaacttcattgatcattaatatccaaattcttccctggggccaatttgtcatttaaatcggcacgaaaaatcgaaatttcttaaaattctatttataatttgaatcagtctattagttttattttagagaaaccgaaagtcaaaatccgcgcaaaaaaaataccccggctttgatgccaacgacccgatgctcggctttggcacgcccttttcgccatggcaacggatgtcgccgtcagtgaatcggcggaccaaaatgttgcaaagtcccaacgctggcacatcactgaacgacattctgggcttgcgagaacacggctattggttcggcaccgaaatgggtccgaaaattaattaattttttaacaaaaataatta

SEQ ID NO: 64894 - DNA, 289 bp, Heterodera glycines
  Genomic contig location: Contig_ID=SeqID_35318; Location=206..494; Strand=+
  SCN-specific regions: Sequence locations=1-234,260-289
acaaaattttgtggaacgaatggagttgctacggtgttgaatacagtgcacaacgcttgagcaaaatccgaatggacactgttgatcagaaccgtgccagagacaacttgccaccccgtgccaccggcgatcagtggcaatgcacggcacaatttggaaagactggtgtgagcatgagtaacgcactgtttatgccgccgttggtcaaaattgtgtaaaacacagcgtgaaaactttaaaattaattataaaatattttgatcgggttttctacacaaaatcaatcgaa

SEQ ID NO: 64895 - DNA, 95 bp, Heterodera glycines
  Genomic contig location: Contig_ID=SeqID_35318; Location=973..1067; Strand=-
  SCN-specific regions: Sequence locations=1-95
taattattttttccgtttgacgcacatccgaccaaactgacaaattatcgtagaagatactagccgtaagaaataaaaaattaaaaagtcaagaa

SEQ ID NO: 64896 - DNA, 487 bp, Heterodera glycines
  misc_feature (447)..(447): n is a, c, g, or t
  Genomic contig location: Contig_ID=SeqID_35320; Location=326..812; Strand=+
  SCN-specific regions: Sequence locations=1-487
atgaattcctttccttcgccccttccgaaattttctaccattggcattggcactttccttctgttgctggtgatcaatttccatttgattgcgagcaacgaatttgggcctgaagattcggtggaccgcaaaaagacggcggaaaataatgaatcatttgctttactccgacgtccgaattattttgccaaaaaactcatcgtttcgatggacgctttttcggacacggacagcgaagacgaaacaaagcaaaggacggcacatttcgaattgagcgattcggaggaagaatttaaggaatggcaggaaaggcaaagggaaaggaaattggaaaaggaaaatgccgaaatggaaaaagcggcaaaaagggaaagtgccgaaaagggaacggtgaaagacaaaaaaggaaaattaagcgaaaaaaagagtgattggaaattataaggngccaaagaacatttccaaagaaattagaaacaacctttga

SEQ ID NO: 64897 - DNA, 1168 bp, Heterodera glycines
  Genomic contig location: Contig_ID=SeqID_953; Location=1019..2186; Strand=+
  SCN-specific regions: Sequence locations=1-469,507-1168
atgccaatgattggttcgaatgccaatgttgattttgaagccgtgcttatcgagaagcgatttttgcgtttttgggactcaatgaacggcgatcggcggttgccaatgagtgccaaaaacgggggaagtgccgccgctgcgctccctccgcctgcaattgtctcagtgagcgggggccttttggacgaattcattgacgagggatggactctttcgcgtgcggtgagtgtccacgcgcacagcgcggcgatcgaccgaatttgggcggaggcagaccatttgtgcattgtttggtgcaatgaaattgtacggtcagttggccaacgcaacgcacaaacattgcgggatagagaaggggcggggggggggggggcttttaggttggaatccaaaagggggggggggtaacatttctttaaaatctatttaaaaagcttcccaacggctttttcgctcatttttcagagcctataatttagaaaaattaaacaaaaaatatttttaatggcgatgtggaaaaatatcttcgaattcctccgtccgaatttttttgttcctaaaatatgaaattttttgttgtaaaaattgctcaatatgtgccattcactggtgccatccctccaacgaagccccccttcaggcaaacttctcgctttcttttcgattacgccgcctctccgactgattttctggagaagttccacgacttcgcccatttgcattaccattcgcttgggctccgactccgtccgatcacttcggaatcggtcgctttgactgatttaaatgtcagcctttgtaccccaaaggtcattttgcgattcgtccgatcactgatcagtcggctgatcacttccatttcccctgtctctttcagtgtccttcgcaatctgtgcatcaaaaattcgatcttttggccaattccatcggaaaacgccgcctccttttgttggccattgccaatttgactgatcgggacaattcggtcccaaaatttgaccttttaacggcgtccaaatgcggacaaaatccacaaagtgttggtggcactcgctttttggacaccgatcatctctttgccgttgccaatttatcaaattgcgagggacggggaaacgttttggtcgcaccgaacactaatttatgggtgctaattgacccccattaa

SEQ ID NO: 64898 - DNA, 1729 bp, Heterodera glycines
  Genomic contig location: Contig_ID=SeqID_953; Location=3068..4796; Strand=-
  SCN-specific regions: Sequence locations=1-755,777-819,846-1030,1172 -1512,1536-1613,1635-1665,1694-1729
  Gene Ontology: Mol. function=sodium:phosphate symporter activity; Cellular component=integral to plasma membrane; Biological process =hermaphrodite genital morphogenesis
atgctttgcttttcctccaccaatgcttctcgttgtcaggccacgctgctgttcgtctacaacaatgtgcacgtgccacaaccgcaggagacacccctgtggattctgttctacggctccatgggcacgtgcattggcttttggatgcttggccatcgtgtgatcagaacggttggccaagagctgactgagataaatcccttctgcgggttttgcatcgaactcggctccgcaatcaccgtggtgatcgccagcaaattgggcattcccatctcgatgacactgtgcattgtaaggaggggaatagcgagcagagaaacagaagaatgatcggggaataatgaccaaaaaacaaagcgatcgagtgattaaaatcacaaattgaaaggatcaatgatcaaagacaattatggcttaattgccaataattggtcgataaccggataattccaatccaattcctatcgatctgatcactccccccaatccccgcaatttcaggtgggcagtgtcgtcgcagtgggcgccgtgcgcggttccgtgcccgtcaattggcccctctttcgcaatgtgttcctcgcttgggtggtcactttccccgtaagcggcattttctctgccgcttttatgtttttgctcaaattatttttcttatagcctttaattttcggatttttctttctttttattgctgaatttgtgatcataatttattcccacgtttgtgcgttttgggctaccaaagggcgttcagtttgtatttttgtattaaatatgcgaagtcagtcaatcggaccagattttcatttaaaattactgataattaaatatatttaattatatttgataaaaggaagacaaaaaaagaaaattgctaataaaattgtgataaagacagagtgaagaaatcaaatttaattattagcaattacctaaaagacaaaaaatgatttaaaacgaaagtaatttcaaatgcaaaaacagacaaaagggagagatcgtcaaagagaagaaagctcatcggagtgataaaggcagaaaaagtggaaaaaacaatcaaagaaaaaaggaacaaaaaaagtgtaaggaatttgaaaaagagatgagggaaaagaacggacaaatttaagaggggaaaagggaagagggagaaaaaggaaaagagagacaacgcaaaattggagacgaaaaaggggtcggaaagggaccaaaattggccatatttggccaaattccatacgcaagtgaaaatgtgaggaaattggaaaacaaagacgggcagaagcagcagaagagaagcggaggaaaaagcgatggcattgcccgtggagacgaaacgccggtgcaaagcctgtcaaaaagggaactgatccgacagatttgggaccatagaacgaacccatttataaatgcaaaagtgatcggatttaaaaatcattagctcatgggtgattatatcctcctatttggattcagtttttgtgtttaggtctcggctttcaggcttagaaattttgttgtatttattttagttcagccactacgatcctccacgctcagacaagtgccaattaaatacaaaaatttgttccttacggcaatgttcaaaaaaaggccaaacaccgccagagggaaagtgttgttggtgaacgtcgtggacagcgcaaacagaaagaagaaaagaacactgagagaaagagacgaagtgaaagagcaaaaaggacgatga

SEQ ID NO: 64899 - DNA, 3630 bp, Heterodera glycines
  Genomic contig location: Contig_ID=SeqID_954; Location=1953..5582; Strand=-
  SCN-specific regions: Sequence locations=1-18,40-427,449-923,945 -955,979-1306,1328-1521,1546-1577,1659-1677,1699-1811,1914-2108,2497 -2502,2530-2673,2695-2698,2745-3146,3168-3170,3212-3592,3620-3630
  Gene Ontology: Mol. function=myosin light chain kinase activity
atggcacagacgaaggaaaaacggagaaagagagtggcaaaatgccaaagaaaatcttaaaaatccaaatttaatttcagaattcaaccgaaatgcaaaaaataaatgtgagcagaagcaatagcgacataaaagccttttcaatgaatgaggacgacgaattaacgcgggagattttggcattgtttgattatgaggacaaatgggacaaggcacaaaatcggacaattgacacacaaaggggcgaccattcgaatggctcaaacggtggggggggggagggagaattggcacaacgaacgaacgaattgaattggtttggcctttttcagttaattgggcaaaagccacaaaattggagacggaacagctgcagttcagcatggacccatcagcaggtgaatgttttttattcaatgccaaaatgttaaatgttcagcgaattcgaccaatgaatggacgacgaaaagtggcgaaaaaacgggcgaaattcaaatggaaaagggacccgcgaaagagcagcagcaattagcggaatacgaccaattagcatctaatggccccacaaaagtggagacaatagtcacaaaaacgacgccagaacaagcggaaatgacaatggcaacggaaaatgcaagcgaaacaacggcatattcacaacgcaatcattcaatagcaaaagccgatttggagagggaagtgaacggaacggaaatggcacaacgaaaatgggaaaaagtggcaaacgacggagagcgaaaaggcaattcatcggaaggggaagaaaaagtgccaaaaatggaagaaaacgggcacgaaaaggaaatgccaacggacgagacggagaacaaagccaaccgaacagagaagggtcagtgattgggcattaatgggagcatctcaacttttttgcttttgattggtgcttttctctttcagtcggttcggttcttccggtttcgcccttttcttccgccccaacggtcccttcccttcaaattgccatgccatcagtcggcattttggaagaagctttaggcattggcacggcatcaccttcaacgattacctacagcgaaaataaactaaataaatcgacagaaccgagcattgaattcacaaacattacaatgccattggttggcactgaaatggcaccgtcaaattttaaaagcattaaaaatgaaaatgaaacggaaatattagccaaaaatcagtcggaaaatgccaaaagcaatctgacaactaatacctcacaatcaacaacagaattgaaaattctttacccattggagtcggaactttctttgccattactttcgccaatgcctcccacggaattgccaatgataaattacgaagcgaatggcaccgatacctttgttgaagaaatgagcaatcggacagaggaagggaaggaagcgaatggcacatcggcaggagaaggcataaagggaggagcattggaagagttgaagcggaaggtggaaggaaaaatgcgaattgatgacgcagaatgtgagcagaaggaggagggaaaggggtggggagaagtaaattaagtaatgaaggtgattagggagaaggggaggagagagagaggaagagagagagagagaagagagacaaagagaaagggagagagaggaagagagagaagaatcccatttgatttcgttctgttttcagttgttgagctgagcgagtatcggcagcatttgcggcaaattctgtcggacgtcgaatcggtgttgtccaaatggcccggccaactcgcccacttttccgactttcccaaatcccgacggtacccttttccttttcctttttgcttttgtttttcctcttcctctcctccgtccccttccaacttccccttttccctttcccaatttcagttttatttccatttcggcatcgatgccaaatcgcaattccgatttgttcatcgcccgtaaaaatgccatttcggtttcggtgtcttccaattttgaagagattcgcaaaagtccggtgaaaatgggcacaacggaggccataacagtccaaatggaaaaaatgccaattttaacgacgacggaaaagacgaaaaaggaaaaaatagaccgagagaaagagacagacggaaaagagacaatgggccaaaagacaaaaacaatagaggaagagacaaatacagaggagatagtgggcaaaaaaggagggaatacagttgaggaaaagaaagaaacggaagaagagacaactgaaaaagagagaatggcaaaagagacaaagacaggagagaaagaggcaagagagacaatggcaaaagagacaaagataggagagacagtggcaagagagacagaggcaagaaagacaacagagacgagagagacagagacaagaaagacagtggcaaaagaggagacagagacaagaaaggcaatggcaaaagggatagagacgagagagacagagacaagaaagacaatggcaaaagggacagagacatgttggtaaagagagaaaaagacaaaaatgtgaatattacctaaatagcacatccctccgattcgcttgaacccatcgccggtcccctcagttcggaatccgactccgacgaacggccacattcgaacagtccgaagaagacgggctttttcagggccgaacacttctcgtccaaatatttctcattgattcctttggtcggtattatttatttattttaaaatgtttaatttttatttttaaaatttcttagcgaaatatcagtgccgtggatcactgcaaacatttggcacaggatgacctcgtgcatgagttgaagcagaagggcacttacaaccccgaactgatggcatgggcaagcgatcggaaaagcgaaaaagtgccgaaaaagtcattttgagtttaggatgtcagcggagtgttccgtttcctcgacaaaaccatcactgaccaatacgaagtgatcggagggggggggcaattaaaatgggaaattgggcaattaaaatttaataggggacaatgaattaacataattgcattaagcgccaatcaaaagccccaaagtcaagtgaccaagcagtgaagagaaatgttgaagcattggaacgactgctgagtgagctgaacttgcgatgtgtaaggaagggaaagtcacaaattaacgcaaaaaaagccaattgactaactaactaactaacttattaatcaattagaggcttaattactgggtttgattaattgtctaaaggataatttattttaaggacgtgcgttcccccgaagtgttgtcgcgactcggcaatttgacaatgcaagacgaaatgagaagctttgcgacagcttcaatgaattttggtgcttttgctttaggaacgaatcgaagcggtcgatcatttcgccgtcgttgcggcagcaaaaggcgcgccatttttggcataaatagcgaaaaacccagcatttaggatcagtttcagctgatgcgccacaaacgcaactccgtattggcacatttggtggggaaaaacgacgaaaaacggcggaagcgaagggcgacgaaaaaggaggacaaaacggagcaaaagggcgggagaaagcagcagagaaagcaaaagcaaaagcagaaaatgatcg

SEQ ID NO: 64900 - DNA, 2188 bp, Heterodera glycines
  Genomic contig location: Contig_ID=SeqID_7463; Location=498..2685; Strand=+
  SCN-specific regions: Sequence locations=1-50,72-130,152-186,222 -608,630-655,683-790,813-821,843-1016,1137-1214,1236-1266,1317 -1321,1349-1732,1755-1917,1946-2188
atgcaagaaatggtacaattgctgggccatgcacttcgagtccatgttgcgctgaaaaccaaaaattcacatacttttgtatgtacaaattcactaatgtaaaaaacattcgattttgagacaaattccttttgttttgccaattttttaatgttttgtcattaattgcagtggaaaaacagaaagaagtaaaattgttttttctgtgttctctttggcaaaaatggtttagccaaagactcacaaatcaacgtcatttcaagtcgttaagaaattcgtaatttgaaaattccaaatttagcattttggcaattacaaattttttgcgttttgttcaaaaattttttgttcaaaaatttatttatttttggtgcaatttattgggcattttttaataatattggttgattgattataattgtaaacatttaggcatcgtctcggcaactgtttgaacttggccatatccctcatttttgggaatctgtttgttgtgccgggaaaatgcacaaatcacaaatttgtaaaaaaaatctgttggtaatttagtttatttttattttttagcaatgctcaccatagaatatcttttgtcacaacatgtttgttatgccatgcaagaaatttaatgagaatctaaacatcatacagtatcaataatattttattttaattaaaatttcatattgaaccttttttattttatactcattgtttaattaataattgttattgtttgtttggttgttgttattttggttgtgactttcacagcttacaattttcgtgttctttcattcttttccaacacttcgttatgattttattcaatattttaaattaattaccacattatttgtttaattgttaaaagtaaaaagagccagagaaagtaaagtataatgatattttattatatttaagattccaattacataagctgattccaaaattgattcgcgaatttttctaatacttctctttatctaatctccctctttctaatttttctctaatctctctcactctctctctctctttttccactcccccccccctccttctcatacatctctcctttttctttctctttttctctctgtctctctcttttcttttttttctccctccccctcatttatccctcctttccggtctacctcagttcggcccccacggttcggccccagcacgtttcggccccaaataaaacaattaatttttcaaataaaatttcacgtaaaaattagcaagcaaaatgactacttttttaaattaatagtgttattcttatttttatatttttaattttaattcgaacataaatttaaactttttaagatttattatgtaccgtatgcaacatcaaattgacgccaaaagaaacaggtcaacgctacaacatgatggccatctttacaaatttgctaagacaagtaccgacgggacgattaaattttggcgatgtgagttcaaagacagcggtgtggacaagttcaaaggacggatttggacttcacttcgagatgaattcatccgcatggcgacacctccctcacacatatgaacggaatccaagccacgtcattgcgcaaaaagtcacgactgccatcaaaaggcgtgctgttgagacgatggaagctccctctgtaatccgtgctatttctcttcaaagcattagttcgcctgcactttcagaagtgccgtcaaaaaaggcaaccaattttgtaaatcttttcaatcaaaatttgttaaaagatctttcggccgatgcccgaattctggcaaaggttcagatttattacgtcgacatgcccaacaacgatgatcacaattatattaaccgtcatccccgtagaatcgaatatttgaaaggtatttcccgcaattaccagatgaatccttgatcagtttttgtatttttgtttttttaaattttaatattgttattagtagggctgctaattttaggtaaatacttaaaatttttgcacacttaatacacggagataggcgcgaaaaacgagtttttagcttggtttggagcttctatacccacttttataatacctatttttacctatttgggggtttttctacctattacctaggtacctatttttatacctatttcggcatttttgttacctattttaaggattttcaaaaaattcttaacaaaaatgca

SEQ ID NO: 64901 - DNA, 300 bp, Heterodera glycines
  Genomic contig location: Contig_ID=SeqID_7464; Location=205..504; Strand=+
  SCN-specific regions: Sequence locations=1-115,146-260,287-300
atgaatctgtgcaaaagcccagtccaagccttagtcaaaattaagaatttttatttcctcttgtcgaatgttttttgtttttttcagaaatacgaaaaatttttcaaagtgagtcttatattaaattttttttaatttttttaaagaatttccttttaatattgtgcaaatttcagcatgacgctgggaagatgcaaaccaattagcctagaagcagaaatagaaacaaagaaaaagcttgaaggcgcgacatgatgaacattatttgttaaaataattgattatttaattgaaaaatga

SEQ ID NO: 64902 - DNA, 2371 bp, Heterodera glycines
  Genomic contig location: Contig_ID=SeqID_7464; Location=547..2917; Strand=-
  SCN-specific regions: Sequence locations=1-350,372-501,575-764,839 -867,891-908,931-1060,1083-1445,1502-1574,1597-1626,1649-2371
atggataaaatttccggctccgaaaattttgtttttttcggttgcgggattccgactcctgaaatgttgtgcaaagttttgaaaaattttgcggaagttattttcgaatttttatatccagtaaaaatttcagtaagggcaccgaatacatattttccatatatttatacatttcagtccattttttatccaaatttcggcatttcatggaaatatttttttttggaaacaaatcttaatttaaggaaagttttcgtccaatgtgtgattattcatctgatatccatcatttcaattccattttatcagtgtaagtttatgatatgcgtttcaagataatttttcgccaaatatttaagatgttttcttcaacacttcttatttgttcgttacttgtcttttttatttggcaattgtaattcgtctggcatggattaagggttaattaaggatttaatttcctaaaagattggcacaactcatttttgataggaaatttgcaaatttttgaaaatataaaatgaacaaattttataacaaataatttaattaaaatttcatacaaaaaaatattcaattctgacaattaattggtttaccgtagtttctttatttgaatgcccgtctctggtagaatgcctctctctaattaaatgcttggaggggttgaacaatacaatgcccgggcattcaaatagagaaagtacggtaacttctactatgtttggcacatcatcacaaattttttggtaaagaatttgcagattttatataatttaataataaataataataataatatttaatgaaattcaattttaaaatttaaataattaaacacaaaaaatattcgatcctggcctaattacaaaaaattaaatccaatttttcgaaatttttttgccctgtagaactaaatttaaaattattcttgccgaaatcggttgggcttaaccatggaaaatggacaataaataataatagttttttgcatgtttttatttcaattataagtgaaagtttcaaatttttttttttgctctaaatttataatttttggttaatattttcttaaattttttggcattattcttcataaacatttatttaaatagttcagaatttttttttgtaattattcctcctcacctttttcataaatgagaccagtacattttaaaattttaagcacaaaagcgccgttggaataatgccgccactgatgcggcgacggcacaaaatcctttggacaaggaaagtgcgcgaatcactgtggtatgcattgccgtccaaatccatggcatatgttttgtgttacttggtaatctcaccattacgccatggtacacgatgttgacgatatgtacaaattacgacccaatcttgcaacaattgtattacccaatcaatgcgttcacatcgttgttttacatatcagacgaggcaattaatttacaatttaattatttggaatcaaaaaaatttaaaattaattaaatatcattagggtgcgaattttttgtttttaacggatttttttttgcggttttattccgctgtgagagaactgcttgaaaaacacaaataaataaatgaattaatgaaatgctgtaagcatcatcggcattgaaaaaaggtttctttgcaatgacatagaatttgttatttttggacaccaaatttgaatcgtctaattataaatttaattactttattgacactgaggcaaattttcgaattagcccacactgacaatatatttttggttcaacctagcaccgttaaaacattaattaaaactaaattaattcgcccgtcaattgtccaaaattatttttgcagctctttttgttggccgtctgtatggacatgcgtgtgcaatttgcgcaaatgattcggaaaatgtttgtgccgtttcggaggcgtggaactcaaacaatgacagttcaaactgtgcaggccaatttcaatagccgaatgcggcacaatgccaatgcgaattagtctcgacatacactctcgaatcatcccaggacttgactgaattgctaacaaatgtcttggaaaattgttttatagcaatttaacatttcatcgataaacaattacttatttcgagcacttaaaatcgttttttaaaaaaagataacaatgaatgaaacaatgtaaaaatttgtatttaattggtcaatattattctacgcttttcaatattagctgacttaattaaaaatttttaagtttgtgttaatttgtggaaccataaactgtagttaatttctgacctttgtcggcttacccatttattcgtcaaaaacatatttttaaattcttgaaaattgtttttgattaaatatttattcacaataaa

SEQ ID NO: 64903 - DNA, 64 bp, Heterodera glycines
  Genomic contig location: Contig_ID=SeqID_7464; Location=3079..3142; Strand=+
  SCN-specific regions: Sequence locations=1-64
atgccattttggtcatgtaaaaaagcaaataattcggattccccggaaccggttatccctcgag

SEQ ID NO: 64904 - DNA, 1898 bp, Heterodera glycines
  Genomic contig location: Contig_ID=SeqID_7465; Location=42..1939; Strand=-
  SCN-specific regions: Sequence locations=1-218,240-300,322-899,921 -942,966-1009,1031-1270,1293-1328,1350-1401,1461-1485,1524-1592,1614 -1624,1679-1898
atgtgcttgtatatgcttttcctttgtccatacacacatcactccacctggccgttggattcggatcccgaccccctcactccccgctccgaatcgggaaagctcaccattgttaaacatgtaccgatcggaataaaggatattattccacatattgtactttctgtggtgggcttatcaaaggtacgataacaccataatcagggtcatctcataacaatacaataacaaataattttttgacaaattcaacacatgtgctctctctaaagcatgagaggcacaatagtgtgcatcacaaaataatacattttaaaaaacgttggcaaatttcacttctgtgtctcatggattaaagatggggtgaaaataaggaagggatgcgatacgaatggggaccggtaaattggacaccggaaaattggacaccggaaaattggacaccagaaaattggacaccaagcggaaaaatggacaccgccggaattttggacactaaaggaaaattggacactaagatttcctttttaaaaaaaatcaagaattaggtgaaaataaatttgagtagaataaatgggttaaatgagggatgattgatcaatgggccaaaaaatgaaccaaaaatgagtaataaaacttattgatgtagtgattttctcgaaagtgagcaaaaagttgagtggccgaccgacaggttcaacacttcagaaatgaaataacaaccaattgtaatccaacagcatcaatacaaaaatcacttcatcaaaagtattgggccgacctgcagttaatgaaaaaaatgccgaagcggcagagagaaagtaaattattcaaacctgtagaaaattcaatttaagtaatcaattcatttttgggaaatttaacaaaaaatttttgaactttggcagaaaaatagagcactttattcttggtattgcaccattttttaaatttgatccctataactcaaacgcaccaaaaaaacatgaaaatttctcgacatagttcttcattattattccgttaaaaaattcttaattaactttccatgtatttaataaaggtgtgcattttatcactaattgtaagtaaacacacgccacttggtattaacgagaattttaatgaaatttaggtatttttaatcattgtaaaattaaaaaataaagccatcacgcaaatttgccacacacacacacacaatgctcattaagtaataaatatgttttaataatcacgcaaattggccacacaaacaatgctcactaagtaataaatattattttaataatcaagcaaatttgccacaacacaatgctcattaaataattaatattttcttttactaatccctcccccccctacaattgtgaagagaacataaaatccattcatatatgctatataaaataactgattatttatttttaaattcatatttatatgtatttttatttaatcgatttaatatgaaattcagcagtcaaaaattttaaaaaattacaaaaatattgttttaaattggtggtacatgattataaaaaaagaatgggcattgactgtgtgtacaaaaatagttttctaatcatcaaattttcaacatctcattttgtgaaattcattgtaatttattttcaaataaatttattaacctaatttttgtcaaaaaacagcaaatgaattgcactatcataaattcgttgtcacctctgtcgaaagtgcgcgacgcctttcggatcacaaattttctgatttgtatagcatttatgattttgtgcgcttttccaatgtacaggttggctcgagaacgcctgacattgtacatggtgatcagcaaggtatggtttttcatcggcagggttgatttgatcagagttggtcatgatcactcgggctaa

SEQ ID NO: 64905 - DNA, 1006 bp, Heterodera glycines
  Genomic contig location: Contig_ID=SeqID_35322; Location=64..1069; Strand=-
  SCN-specific regions: Sequence locations=1-197,219-510,532-896,918 -1006
atgcatggtcttcttgaagacgacaaaatttgggacaaaactctggcggaggcagctctgtcgcgctggccagatcagatgagatggctctttgtgagcatcctggtctatggccagccgagtaatgccatagaattgtggaacaagtacaaagaccaaatatacaatccgcaaggcattaccacaccggcacaacgccaagcagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaagtgacagcctgttttcaaatgtctccgttgtttggtcaattcaccacgatgaaattgaccatcaaccagagactgggccaag

SEQ ID NO: 64906 - DNA, 313 bp, Heterodera glycines
  Genomic contig location: Contig_ID=SeqID_35329; Location=205..517; Strand=-
  SCN-specific regions: Sequence locations=1-313
atgcgtaggaaaattcaaatgccaaattggtcgaaattgtctcgatttattcatagtgccactttagcgtgttctcgggtcggatttggcctttttggcagaatttcatggccaaacgatgggacaaaaggggcggaaaagaaggacaaatgggccaaatggctgagtgtggagacaaaagcgaggacggtgtcagattgtgtcagacaatgttacgaataccgattttggtcagtttgtggagggaagaccatggatcaaagcgagaatcagtcgggaatgagagtcgggaatggaaagggtcgagtcgaga

SEQ ID NO: 64907 - DNA, 306 bp, Heterodera glycines
  Genomic contig location: Contig_ID=SeqID_35330; Location=135..440; Strand=-
  SCN-specific regions: Sequence locations=1-200,234-306
atgccgaaaaatgttcaatttccaacgcaagtgtgcccttgtgccgatcagaaatgcgttgccgagtggaaaattgcaataggcaccgcccaccgggcacatcagaaagatttgaatggcaatggaactgataaatgccgatcacttcttccaatgttagcacgtcagaaggaactgtgagaaatgcattagacaaaaattagaggatatttgcattttcggcactttgtgttataatttggcttttttaggcttaagaccgacctcgcgaatggagaaatatttttaagcattcccattgtttaa

SEQ ID NO: 64908 - DNA, 278 bp, Heterodera glycines
  Genomic contig location: Contig_ID=SeqID_35331; Location=71..348; Strand=-
  SCN-specific regions: Sequence locations=1-278
atggctatcactaacctaaggactgaaggtggtgatcacaatcagttcctttggaatgtacattgttttcctttttcggcattttccagtgcttcatctcgtgccaatttcagtctgatgatgatgactttatcatgccgttcggttttaccaatcaattgactggggagcgattggcgtttaaaagtgccaacattttggggcgactgggatacaattgacattgcattaatcaggaagaaatcggaggcgggtcagtaaattgagaacaaaataaa

SEQ ID NO: 64909 - DNA, 481 bp, Heterodera glycines
  Genomic contig location: Contig_ID=SeqID_7466; Location=84..564; Strand=-
  SCN-specific regions: Sequence locations=1-128,150-343,365-457,479-481
atggctttgaccagcgaaatgtcctcggcaaattccaatgcgaccaaagcgacgccaaaaggggcgaccaatgcgcggaccaatccctccactgcacactttgcagggtgagcagagaatgccatgggaacaaaaaacaaacactttgccaacaattaattcaaaattcaatttcagcattcgaatgtcaattctttgtataaattttccaagatgcaaaaaatgtctattccacgaatgacactcaaatttatggacattttgttcgaattaaaatttttcagaatgccaaacattggccaattaccgccaggaaaatataattggcgagaatttgaaaaattacaaaaagaaattggaaacaaaatagaacatctgataaaaaatgaccaattcgatatgggaatgtgcagatatgatttgaaagacagggcgaagagaagggcagaaatggagaagaaaatgcaaatggaaatttcaa

SEQ ID NO: 64910 - DNA, 5115 bp, Heterodera glycines
  Genomic contig location: Contig_ID=SeqID_7466; Location=1087..6201; Strand=-
  SCN-specific regions: Sequence locations=1-213,235-260,299-659,700 -977,1001-1007,1030-1321,1343-1752,1781-1811,1854-2451,2476-2524,2547- 2621,2643-2923,2952-3122,3144-3379,3401-3634,3656-3658,3788-4331,4360- 4430,4452-5051,5073-5076,5099-5115
  Gene Ontology: Mol. function=myosin light chain kinase activity; Cellular component=nucleoplasm; Biological process=protein-nucleus import
caaaaaacggagacatcactctgatggacgtgtgctttctgcgcaacttttggttatacgtcgaaaaattaaaaactaaaaaatcggtggaatttgaagaaatgaacgcattttgtgagcaattggaaatgcacgtaacggagttaaagcatccagaacaattcaagaattttgcaaagcaatttaacatgtttttgtcggattgtcatttcgtatatttggacaatttgttgacggaaagggaaatgcgaaagaattcgaattttaggcaaatttttgaaattgaaaacagaaaaacggacgaagaaagtgaaatgacgcaaagattcagagaactgacagcaaagaatgaatttgatcagataaaacatgccaaaaggataatgattgcttttttgatggatcagagcagcgtggaccaattggaattgaacaacccaattctattggcgattggtagggcaaatagcactaatcaacactaatcacaatttcgtactttaattttcaggaattgagagtgatgacttttttcgaatgttatatgaaggaattaacaaaaatggatttaatggaaatgtgatgttcatcaaactgtccattttattcgcaaaaattattgcacattttgcaaattgtcaaaagaaagacagcataaacaaatacaaaatttattggaaacaatttgacaaaattatgggcaaaaacgacgaatggcgcaaagaaagtaacaaacagaaaatattggcacaacttgacgaactgttggccaaaatggacagcgaatttggcacatcgaaagtgacagaacgattgaaactgattctgaatgatcttgggagatgtctgatcgaactttacctggaaaatgaggcattcaggaacaattttcgtgaacaacccgaaaattgggaaggagtgaatgtgagggggggggaagagaagggaaattggttagaaagttaattttgccttgcaattaaaaaaataaatttaaatagaggcgtctggtggtgggtgcctttctggcatttgccccttcaaccaatgcctattattttagaagctctttgaatccgccgtttcttcaagctgtgatgattcgttgttgaacaaaacaatggaattgtttgaaagtcgtagtatcaaataaaattgaaaaatggaagttatataattcaaaatacttatattttttgatttaaggaatcagcaaaccacaaaaagacgattttattaataatgccaacagaagttttgttaaagaattgaaggaccaaaatatcgaatttgagaacacaaaaggtgcggtaggaaagggaattttaattaaaaatatttagttatttgataattccaaaccatttacagaacaagatgccataatcgtgatgaagcagtacatggagcttctaaccactgaatcggctgataatttgagaaaggattcgccatttatgcaaaatttgaaaatgcatgcgacacattggtattatcgaaaatgcatcaactcgtttttggaattagccgatacgctaattgaacaacatggacaacaaaatgccaaattcaaggacagaatagacaagtacaaactcaaaggacaaaacctatcgggccaaaacagtgaaaagagtaacggcagaaagagggaattgtgcatgacgtacaaattggcttacgaattggccactgatcagacgctgatcaaaatgaattcggattggaaaacggagattgaaaaatttgtgcaaaaagaaaaggaagatttgagcaaatatacggtcagaattacattatttattttgaataattccataaattaaaaacaattagaaacaattagaaagtccgtccattctcccattttccatttctctgctcccgtgtttcgttcaacactttaaaaacagcgctaacttacttttgggtttagcaaatgactgttctgccagagaatgtcgaaactgaatgggcaaatatggactgtgaaaatgatcaaattgttgaaatgttttttgatcaaataactgattcgacaaagattggacaaatccacttttttgcgatcagaaatttgattgatcgaagcataaaatttagagaatttttttataaaggcacttccgaacggaactttcttaaaataaaggagaatttagtgaaaatggtcaatgtgcaaataatgtttttgttggagaacttttacccggacattttccatttcagttaattaatactttaatttcaaaaatgacttttcttttcattcagaacatctcctcactgctcagtacctctcccttttgacgagacaaatgcaatttcaaagcggcacactttgcgccgaattttttgaagctcggattatggcgccaaatttgatcaaagcattagaaatttacgaagctaatctggcaaatggtgcgcccaatttgtccgcgaatgcacaaaatatttatttggaaaaaattgcgaatgcgaaagggcaattttttgaggaacaacaaaattcgaagatgggaaaacaaaggcaaaggcaaaatgtgtgtaaattaattgaaatggcaaaattcgtagagcaatttttgatgaaaaacagcagaaattctcagggaattaatgcgaaaaatgtgacaaaaattgtgaaatggaagccgacagaatgcgaaacggaaaagggcgtgaagagggcactggcggagcaaaggcagcgaatgcgaaagactcatttcgaatatttggaccgacttttaagcgaagaattctttagggccaaattcaacaaaataagcggggcaaaagagcgaattcgaaaactgctgacagacggcacagacaaaggcgaagaagcgaatgccgagaaaataagggcaatgttcagaacgccggaatgtgtgcgcgaaggtaaaagcgaaggatggaaaaagcaaaagcaaacaaaatgctaattggaatatttagcttttttgaatgcacctttgagccaattttatgaggaagcattattggacgaaaagtgccaattccatcagatggcaaattggttaaaggcggacgttgtcgtaattgcacaaaagatcgaattggcactggagcaaaatgccaaacgactacagcccttgggaaagttttgggaaaagaataaatattcatttatggaattgttcgaccgaattttggacagtgaaatatcagaaatagaattgagagtcatggaatttgtggaattaattgatgaatacatggacaaagtgatgaagaaatgcatggaaatgagcctaaatggggaggaagacaaagcgatgaaacttttgtgtttaaattcggatgataaaacgtcggacagacaaaagaccgaacaaaaggccgacgcggaattttatggaaaatggataaacaatttacatttcgacactttgaccaaattaatggccgagaatggacagatgaagagcaatttaaaaaaaggttggtttaaaaaacaaacaaataaaagggggcgaaaattattttaagtttatgagtcatcggaagaagcgataaaaacactaatgaatcgttttggcattgaaagggcaaatgaaatattgataatttgtggaacgagagaagaaataaaagaacaatcggtagaagagattttgatggaaataacagagaaagaaagagaaaatgggataaaaaagaataacaaaaacagaaggaaaaaggaaaacaaaaagaagcaaaaggaaaagccgacaaatggacgaattgaaaatggaggagcaaaaacggaaacaaagtaaacccatttttaaattgctataaattggatcgttaaggaaaaacgaaagcgaacttagcaaaagcgatagcaatgaaatggaaaataaaatattaagcgacgaagaaacgcagaaaaatgacgacggacaaaaggacaaaacattagtcaaaatgaaggtaaaaaaagatgataaagtaacgacaaaagaggatgaaaaaataacgacaaaagatgaggacaaagtgacgacaaaagaggaggacaaagtgacgacaaaagaaattggtgatggccaaaatttagaagacattcaatcagtaagaggtggaaaaatgatggaacagattcatgcagctgatcaaaatgaaagtaggacaaatgatcaaacattagggagtgacaaagggacgacaaatggtaacaaaataattggaaatcgaggagaaaaagcggacgaaaaaaggaaaacaaaagaagaagaactgagctcagaagtaaaagacaatttgaagagaaatttaaacgaattaaaaagtgagagaaaagcgaactacgaatcagaagaagaagaagaagaagaagaagaaaattgcaatggcaaaatgccaaaatttgatggcaaagtgccgaacagaaatgaacaggaaatggcaaattgggaaacaaaaagtgaagaaaattcggaagaagaggacaaattggaccaaaatgaattgcttcatctgaaaatcgggcatttttcagacgataatttgctgagtttgaaatatggcgaactgttttgggcagtaagcaaagaaagttgggaaaatgacgaggaaaacgatgctttaacagtcaaaactttgtgttggacgctccatcttggagtttatgccaacgaaatttcgaatcggattggactttttggcactttggaggaattgaaaataattggcaaaaacgaaaaattggaaattgaaaagcaatgggaaaagcttaaaatggttgaattaagcaagataattagcttatgcgagaggaacaaattgatggccaaattgcatttgttgctgaagaaaattgtggcctcaatggacggattttgtgcggaaaacggcacaaatttatggacagagattgaggagacgaaaagtcagctgcactcgagaaaattggccaagacaatggccaagagcgaaacggaacgccaattaaagcgcaaaatggacaaagtgattttggcactgattcaaacggaaaacgatgggcgcgaggacggaatgccaaagcaccgagcggaattcgaagagcaattaaaggccgtcaaacactttgatgggcagagaaaattaggcaattaa

SEQ ID NO: 64911 - DNA, 1120 bp, Heterodera glycines
  misc_feature (955)..(955): n is a, c, g, or t
  Genomic contig location: Contig_ID=SeqID_35332; Location=155..1274; Strand=+
  SCN-specific regions: Sequence locations=1-138,160-454,476-781,804 -1120
  Gene Ontology: Mol. function=protein binding; Cellular component =nucleus; Biological process=signal transduction
aacttaaaaaaactcccttctctaatagttacttaaattcaaccaccttataattcactagtaccaaaaatgcaaagtgaggattttgatgatggatatttacgaacgacacctgatccgtttgttgtcttgataaacaattattttttcttgtgtctttttagaaattcatttaaattaccgccgactgaattaagcaaagcacccgacgaagtgttcgatgtaattagcaaaattggcgaagggttattttgttccgaactgcttttcatttgcattgtgtaaatttaaggtcttacggctccgttcacaaagcattacacagagaatctggccacacgcttgccgtaaaaatggtgagccgtaaattatttcgggtggggcggtgtttactgtttgaataattatgctttcattgcaattccttctattaaggtaccagtggacactgatctccaagaaattatcaaagagataacgattatgcaacagtgcgattgccgacacgtcgttaaatactatgggagttacttcaaagactccgacctttgggttgggtgaccgatctttgccgatgctttttccatgtgcaataatttgagattgtcatggaatattgcggtgccggttctgtgtccgatataatgcgattacggcgtaaaactttaaacgaatgcgaaataggagcgattctcaaagacactcttctgggacttaattatttacacggattgaagaaaatacacagagacgtcaaagcgggtgctaatttaccataatatgctaaacatctcaaaatatgaccctttgttctgtatcaagggaatattttactgaacatggatggcaatgctaaggtacggatggtttatggacttgctttgcgaattaatttaatttagctagcggattttggcgttgccgggcaaatcaccgacacaatagcaaaacgcanatacggtgagtgtgatgctattttctgacaatatcaattcttgttaaggttattggcactcctttttggttaatcgacagcgtttctttaaaatgttttatttgcacctttaggatggcccctgaactgattcaggagatgggctacgacatgaaggcggacatt

SEQ ID NO: 64912 - DNA, 211 bp, Heterodera glycines
  Genomic contig location: Contig_ID=SeqID_35334; Location=689..899; Strand=-
  SCN-specific regions: Sequence locations=1-42,64-211
aaacaaaaaaatcgatttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaaca

SEQ ID NO: 64913 - DNA, 168 bp, Heterodera glycines
  Genomic contig location: Contig_ID=SeqID_35336; Location=600..767; Strand=-
  SCN-specific regions: Sequence locations=1-18,48-168
atgatcattttattcaacatttataattattttaataacattttaaactattcagacgatgatgagaagaagttaagaaatggacgccgtagcaagtggttgaatgggaccagcgttgctatggaaaaatgcttgccgaagagatttggcaagaattcctcgacaaag

SEQ ID NO: 64914 - DNA, 293 bp, Heterodera glycines
  Genomic contig location: Contig_ID=SeqID_35338; Location=26..318; Strand=-
  SCN-specific regions: Sequence locations=1-222,245-293
agcggagacatcgttcgtgtactgctcgagaacttcctctaccatttcgacgaggaattggacgatgcaaaaatgtctggaggagggagtggtgctggtcgaagacaaagccgcagtgacagttttgtggtttcactgtggtcaacactgcagcgcacattggcactcgggccgcaggcggacggggacagtgacgggtcggactgttttcccccgcatagtctgtcgacgctcatcctgacactgctgctctcgctcgtctattacccatcctttgaaggacgaaccaacgc

SEQ ID NO: 64915 - DNA, 493 bp, Heterodera glycines
  Genomic contig location: Contig_ID=SeqID_35339; Location=347..839; Strand=-
  SCN-specific regions: Sequence locations=1-46,68-166,190-232,260 -449,489-493
atgggcacttatgcatttgacaattatggctttttatggattaacggaaaagaaaaaggaacaaatatcgaatatttctaccgtgttggcgataccgtaggaattggtgttcatttattcactcgacagctctttttcaccaaaaatgggcttcgtttgggttagcaaataataaataatataattttacgattttaaattacaatttggttatttgtctattttatgctaatttattttatgtttaaaataatcaaaaatcccttaactttttcacagattcctccggtcttttcgttgatccatcttttgctgatggttctctttatccattcgtttctttgtttggctctggttacaaaattgaggcgaattttgggcccaatttcaaattcgatttggcgactctctgatggaaggattaattattcactaatgttgttgatcaatttgctctttttaatcatttttatgtttttcttcttcaattaaa

SEQ ID NO: 64916 - DNA, 455 bp, Heterodera glycines
  Genomic contig location: Contig_ID=SeqID_35341; Location=1..455; Strand=+
  SCN-specific regions: Sequence locations=1-47,69-328,350-455
ccagacaaaataggcatcacaaaagtcacaaattaaatctacttgcgaaaatgtttttgctttgctttgtattgctaataaataacaaattacaatcttagctatattacgacgtccgcgttcctcagagatatgctcaaagtaaagagctaataaaacttgaatatgaaaaggcaccaaaaataaaacagaagaaaaaataaacgaaagataaaaaaggataaataacgaaggatatggcaaggaaaatattgtcggatggactaaccaacggagaaaggcccgcaaaagggagaaaacctaacggataattgagttaatggtataattaaaatttaaaatgaaaaaacgggcggaatggaaaataatttacaaaacgaatgaatgggcgaacggtcgtccgtttttggctatggacaaacaaataattgcgtgattcatacaatgcgtcgtct

SEQ ID NO: 64917 - DNA, 2650 bp, Heterodera glycines
  misc_feature (46)..(46): n is a, c, g, or t
  Genomic contig location: Contig_ID=SeqID_7467; Location=1104..3753; Strand=-
  SCN-specific regions: Sequence locations=1-116,138-283,305-845,868 -1285,1307-1356,1378-1646,1674-1692,1714-1784,1807-1920,1944 -2363,2385-2429,2452-2490,2513-2650
atgacgacgaaatcagaagacgattcgttcgataaaattgctgtgnagcaaatgaatgagtcaatgaaaaaattcacgggaattaagccagacaacgtacaaacaacacataatgtgcacagaagccaaactgaggaccgagatttcgagagaaacttcggattcccaaaaggtcagtcaagaggattgagaacatttacaaatagcaaattcacattgcctttttatgttgttgggcgtaaatttatgtcaaaaaccaatgatttgtcacagaaacgtgccatcaagatttgtcaaaattggtcgaaacaatagtgcctgttcagggatatctcaaatatttgaaagaggtacaaaaaatttagaacttacattgtatcgtcctaaccaaaaggaatacaccttttgggggcatcaatgtttactccttaaacattcggtccaattttggacgaatttactgaatgatccattcgacatcaaaagtcaagaaatgatgccgatttctgccgaagaatgccaagaaatctccaaaaccaaaaaatgcagattcggcattctagtaggtgactcagacggtaccatgataacagaaaataaactcatttatgagcattcttggtggtcttggggtaaaaagtctgttgagacggttaattgcatagtcaacaatataacaatcattggatatcccggatcccaaagaattgattcgattgtcggagacctccaacattgtcaatacgacgacggcagatgcagtttacacgattctattgtagtttgggatgttgatcggtatcacacatctgaaccatgggcggctcgacacggacattgcgtttttaaaagtttttcaaagaaaaatggaaccatttatcgaataggttggatcagtgacccaccggacttagccctaacatttggggaagatccgacatttattacttcttgtttaagaagattggtagttagccaacaaggattcgcaatcgaagaaagagaatttgtaaaattcaaccgacaattggacagaactcgccgaaatgttaattttgatgaaccgttggacggtgaagttcgcacatcacaattagatgctcaactcacagcacgttcgatgttcgcagataaagaaatgagaaaagtattgcaggcatattttaaacttatttgtgactccatctttggctcagttttgggcactgatctctcacatctcaatccgaattttttgattcgtcagctttcggacaaccagcaaatcgaagccgaatggatttcacagaacattttggaaatttggccatgttcaccagtttatgagtacggattcgcacaaaccaaggataaatgttacaagaaaatcccagtaaaggtgacattagttaggaaagacaagccaattctggcttatttggacccaaaaaccctcataataagtgcagaagctagaaaagttgattgtcagacagatcgctacaaacatatcgttcttgaaggtcgactttatgagattgatcaagttttaggtattaagagtcctgttaaggaaataagtgagatagaaatcagtaacaaaatttggaaatcagctgtaccgtcaacttctctgcaaatctttcgtcttttgatcataagtaatctgacagaaacacaaacaaaaatgatgagtgagttaaaggcgctgagagcaagtttttcagaatttccgttggattcagcttccgtgcggggagggtcgagtgagtcatgtgaaaatgatcactcgaaatttccagttttggaaacaaatgttttaaaattaataggacacaaaattttggcttgggaaaatttggtcaacgcggtcattctgctagttttagcagaatggatgtggaaaatatacaaaattttggtcgggaaatggatagaactagaggtgaaaaaggaagtgaaaagggcaacgaaaaaggaaattgaattaagtgaatttttgaaagataaaccaaaagagaaaatggaaaataatcgcataggaaaattaaaatcccaaaaaattccttttcaggaagtgatcagtggaagcgattctgaattcgacacgaaggcagttatgcctaggaaggtacggaaaactattaagaggggtcggcaaacgtaaaaacctaacaacgctgtttagcgtgtctttcgtttcttaatgggagtgtcgaaaatgaactatttatagttattttcgatttacaaattctttctatgttttctctcccccgggggatgttaagcaaaggactctctctcctttgcttagtctctcttctattggctgttcagtcattggtcttcagcgaccgccgcgaccgaacggcgctaatgtattcattttccctttttcctccttttttttcagcagaagcaacagtcagccgatgaaatcgccgtctttgccccctccctctctgttccgccaatctgcatttctccactgcacatccatcgcttcatctctgctcccccactgcttggtcatccgtcgtcccatctgccgtctcatccgcccccactctctctccatcgcacatcattcgcaccatctccgcctggccccaacgcttggacaatgccattgaagaacgacggacgaaagacatttcacatcgtttaa

SEQ ID NO: 64918 - DNA, 885 bp, Heterodera glycines
  Genomic contig location: Contig_ID=SeqID_7468; Location=130..1014; Strand=-
  SCN-specific regions: Sequence locations=1-285,307-885
atgcgctcgcttcgctcgcgcacctcgcatttgctccgcgaatcactcaaaggggaggaagtgcgctgtataagaagcgatgccaacaaccattttctgatgatcatagttcgggcgcaacaaagtcgaaaaggttccgtcctgttgaggaccaaccatcgcacagcgaatggactcaggcaattcgaccaatccgtcctgttgaggacttgcagcaacatcagtccagctcaaatccacgtctccaccgccaacagcagtttccggtcaaggccgtttacgatttttggaaattggaaagtatcccgccaattccgccgttcatcaatgacagagcaccattttgccgccgtgtccgggttgaaaaaagagaattgctaggattttttaatcagcaattttacttttcgaatttcaacgaagcgtatgaattcgtcatccacgaaagaacctaccgatgtgtggagcagtattactgtgcccaaaaagcgttgtatctgaaacgtttcaacgcggcggatgcgattatgctggggacaaacaaatatggcaaaagaataagcgcatttgagatgaagaaattcgcaaatatgaacggggaggacgaagtgactgtccgagaatggactgagctcaaaattggcattatggaagaagcacttaaagccaagttttcggtgcccgatcttaaagatgtgctgttgagcactggatctgccataatttgcgaattatcacccgaccagttttggggggtgggttgtagaccgggactcatttatgacaaatggccaacagcggacatacaacagtggaacggttcgaacacactaggacgattgttgatgcaactcagagatgatttgaaggaggcaacaccaaaag

SEQ ID NO: 64919 - DNA, 144 bp, Heterodera glycines; identical to SEQ ID NO: 57282
  Genomic contig location: Contig_ID=SeqID_35342; Location=69..212; Strand=-
  SCN-specific regions: Sequence locations=1-46,89-144

SEQ ID NO: 64920 - DNA, 538 bp, Heterodera glycines
  Genomic contig location: Contig_ID=SeqID_35347; Location=59..596; Strand=-
  SCN-specific regions: Sequence locations=1-136,159-195,227-369,391 -429,451-538
atggttttcttttcgcattatatgcaggcttgccattctccgacaagaattgcgcggaaaaggaaggcgtcaacggaacaatcagcagatttggactttgtcttggacaagagacaaacggtggaaatttgcatttggaaaatgaattaaatttcatggacaataattcagaatgattaaaaacattgcatttagttaaaaaaattgaaattttttttttttttttggtttaaactacacacccattttaatcaaaccattaaatgttttccagggttcaacaacagcaaagaaagagaccgattttgtggactatgttttgggcaaaaaacggaaacagcgacggcgccaacaaaaattttttacatcatcagaagaggaggagaaagaagtatggtgttggaataacatatcgggaagatgtgatttaaattttaaatttaccattttaaggagaatgagcagcattccgaagttggtggacaagtgtgatcttctatctcatctttattgttttgcttacaaatttttggcataa

SEQ ID NO: 64921 - DNA, 305 bp, Heterodera glycines
  Genomic contig location: Contig_ID=SeqID_35348; Location=29..333; Strand=-
  SCN-specific regions: Sequence locations=1-305
atggcgtcagaattggatcattcaccgtcaccctccatcattggctcaaacaataacagcgccaaaaggtcctcaagaagcgcagaatcttctgccgaatccacccggaaccgacggttccttgcaaatctacaagcaacactaggaggaacgggaaaatcgcaaaattcgtcgcctagaagagggaacaaaccgcgcaattttggacggaatgttttaccaaaaacagtcgattcgctggaggaagccttaagacttatcaatttatcagagggacgacgtttgcgcttcgctgatggacgtta

SEQ ID NO: 64922 - DNA, 397 bp, Heterodera glycines
  Genomic contig location: Contig_ID=SeqID_35348; Location=1150..1546; Strand=+
  SCN-specific regions: Sequence locations=1-169,191-292,319-397
atgacaagtacggaaacttcggcagatcgcctcgctgtgataaactcatcgtttgcggatggaccgcaaaatgaggagcagcgatatgatgggtttcaagtggagaaacagcggttcaacacgggtccatgtgcgagtaaaacactccctacacaatttgtgtgtttagaatttatttaaaaacaatttatgagaaaatcgtttttcttcagcatgtcgtgaccgcaagcgagtggacaagctcaaattgaccaattggacaaaccgaaaagtgctcattcttcacccgaagaacaacaacaccaacaacaacagcaaattgttcaacaagttcaagtgctcagcaacgaatcgtcagattttagtctttgttcggaaaaggagctcgaagtcttaa

SEQ ID NO: 64923 - DNA, 404 bp, Heterodera glycines
  Genomic contig location: Contig_ID=SeqID_35349; Location=130..533; Strand=-
  SCN-specific regions: Sequence locations=1-99,124-178,200-404
atggagcgcggacataaagatcccgcgttcgcgcatcgcagattcaaattgccgcggtcgcgccccacccatggtaagaaatttaaaaacgaaattccgagattaaaattattcatgagaaatttgggctaactctttccattcgtaacattgaaggagaaataaaacaggttgacatacaaaaggaacaaaatgaggatccggaaatgtcaattttaattcaattcttaaagtcaggtgaatttccaaatgaaatgctcaggcaagaaaaagacagactatcaatattggccaaagatttatgcatagagtctaatattctctattttcgtcagaaagacactaagccaagaatttacattccagcatcattaagggctcttatctttgactctttcccttag

SEQ ID NO: 64924 - DNA, 538 bp, Heterodera glycines
  Genomic contig location: Contig_ID=SeqID_35350; Location=127..664; Strand=+
  SCN-specific regions: Sequence locations=1-83,118-348,400-538
atgattactatcataaagcataaacaattttcaaagtcaccattttacaaattgttcttcatccgtgccgttgctgtaagctctttaaaaaaatatatttcaaaatttatttaaattggaatttattttaggatattcttagtttagtgcccaattccttgggcattttgcttccagcattctttggccaacaattgttgtcaatttacagcaccgtaccaaattgggcaatcgtcttgttaacctttttcacaaaaactttggtattccaagtctcaaacattgtgacagttttcattttgttgaatcgtttcactgcaattgcatttccattgcgtcacaaaatggtaattaatatttaaattaaattaattaatttccgttttttttaaatttttagctatggaaaaaacactttaggcatctgatggtgtttttgttgattgtaccaatgctaattacttttccaataatgcgaatgcgcacaatcattgttttttatgacagcaacagttttctcttagatgacaaagacccg

SEQ ID NO: 64925 - DNA, 390 bp, Heterodera glycines
  Genomic contig location: Contig_ID=SeqID_35351; Location=522..911; Strand=+
  SCN-specific regions: Sequence locations=1-390
atgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaatgagaaaaa

SEQ ID NO: 64926 - DNA, 544 bp, Heterodera glycines
  misc_feature (60)..(60): n is a, c, g, or t
  Genomic contig location: Contig_ID=SeqID_35354; Location=743..1286; Strand=-
  SCN-specific regions: Sequence locations=1-36,58-107,179-291,318 -375,397-467,510-544
atgactttttattcgaagcatgtggcaatatcaataaaaacattcatgaatttaaaagtntatataagcagaaatgacttttttgtcggtgttcgttacctaaaaagtaattataaaaatatttaatactttaattcaatttttgattgaatgttgataaaaataaaataaaattattcttaaaactcgtcattcttaagactgaaaatccgagaaatagtttatcgtttgttgtagaagttgagcgggaccgcaaattttggcaaatccgggaccggcacttgcatggacaaatttattaatttcaaaataattttggatttttttatctattatctttgaattcaattaaattttaatcagctatgctgaatgttttaaaattaaaaatttaatcatacttttcgcaaaagttgataaggttttttttaaataaaaccaaaatgtttcagacatgagatttgcacataaaaaatttctttaaaatctatttaattttattttatttagcctaaattaaatgataactatatgtaaaaataaa

SEQ ID NO: 64927 - DNA, 785 bp, Heterodera glycines
  Genomic contig location: Contig_ID=SeqID_35355; Location=15..799; Strand=+
  SCN-specific regions: Sequence locations=1-117,139-253,275-292,314 -490,512-539,562-785
atggcattccgaggcccaaaaatgtcggaaatcgaaattcagtgccatccccggcatgaaccagggatggcattccgaggcccaaaaatgtcggaaatcggaattccgtgccatccctggcatgaaccagtgatggcattccgaggcccaaaaatgtcggaaatcggaattccgtgccatccctggcatgaaccatttcatggatttacaccgcccaaacaagtatgctctccaaacttcatgtccgcagttttttatttattttcttgacaatactttttgatgtttataatgatatatctcaatactggtttggattaatgttttgctttctggataaatattttacaattttgcaccagtaaatttgaaagttgttagcgactatttgtccattttttgcacctaggtgagagttttttagaacctaaaaactaactgattttgacaggtgttagaaagaatgtgtttaaattttgaaaaacgaagttgcctgagactgtgagaatgacaaaaagccgataatttctccagatagctctctccagcccttctgatggagacgaacgattgtgtgtgggatcgtaagaacacatgaatgtgcaacatggcttaggaccaccaattaggagtcataagggaatttatttattcgttttgagaggcagctcacaatgagcccgaaataagtgagtccagaggcaactacttccttagcttaatgtgaattgccgcagaaaaacgctaaattaatacaagattagttaaataactattttttttaa

SEQ ID NO: 64928 - DNA, 645 bp, Heterodera glycines
  Genomic contig location: Contig_ID=SeqID_35356; Location=29..673; Strand=+
  SCN-specific regions: Sequence locations=1-3,28-161,195-328,362 -502,529-645
atgaaaaaaataattaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaatgaaaaaaataattaaaaaaaaataatacttgtgtggtattaattcataaatattttttttcagaaaatgctctgaaacgcaccaaattttatttacatgttagtttaggcactctgatgctttttctatcaaaaagggagatga

SEQ ID NO: 64929 - DNA, 351 bp, Heterodera glycines
  misc_feature (49)..(49): n is a, c, g, or t
  Genomic contig location: Contig_ID=SeqID_35356; Location=567..917; Strand=-
  SCN-specific regions: Sequence locations=1-56,93-220,246-351
gattcggtctccccataaatctgggcgcatcggttcagggtactgcccngaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaat

SEQ ID NO: 64930 - DNA, 264 bp, Heterodera glycines
  misc_feature (15)..(15): n is a, c, g, or t
  misc_feature (62)..(62): n is a, c, g, or t
  misc_feature (71)..(71): n is a, c, g, or t
  misc_feature (73)..(73): n is a, c, g, or t
  misc_feature (92)..(92): n is a, c, g, or t
  misc_feature (94)..(94): n is a, c, g, or t
  misc_feature (101)..(101): n is a, c, g, or t
  misc_feature (103)..(103): n is a, c, g, or t
  misc_feature (138)..(138): n is a, c, g, or t
  misc_feature (148)..(148): n is a, c, g, or t
  misc_feature (187)..(187): n is a, c, g, or t
  misc_feature (211)..(211): n is a, c, g, or t
  misc_feature (221)..(221): n is a, c, g, or t
  misc_feature (223)..(223): n is a, c, g, or t
  Genomic contig location: Contig_ID=SeqID_35360; Location=250..513; Strand=+
  SCN-specific regions: Sequence locations=1-264
atgattgtattttgntgttttatgaagaaagaaaaagatatattttttaagtttgatgaganggaattggntngaagagttggggaataagngngataggngntgagttagaaaaaaaaagaattttgtatatttttngtttgatttnagtaataaatgggtaattttaggtttaagttttgaaatnttaaaggatttgtgggatggagangataggtgtngnaggggaaaattttataaaaatcccaagttttttcattttaa

SEQ ID NO: 64931 - DNA, 192 bp, Heterodera glycines
  Genomic contig location: Contig_ID=SeqID_35361; Location=127..318; Strand=+
  SCN-specific regions: Sequence locations=1-192
aaatcaagtgtgtttatgcgaaaaaatacaaatttttaacagtctatcaatttcgcgaaaacaattgcaaatcggatacattcgaggtgttcgggggtaaaactcattcgattatcggccaaaattgatttgtaaattgaaaaactgcattcaacgtcacaagaagtcaccggcgcatatttcatagattcc

SEQ ID NO: 64932 - DNA, 1053 bp, Heterodera glycines
  Genomic contig location: Contig_ID=SeqID_7471; Location=499..1551; Strand=-
  SCN-specific regions: Sequence locations=1-274,296-311,334-460,511 -523,545-560,599-906,984-1053
atgtttattgccccattcactctaattctgtcaggggccactgggagcggtaaaacccaatggctaatgaaattgctgagaagctacgctgaacttatcgatcctccgcctgctaaagtattgtattgctactctgagatgaaccaatcagtcattgagctgatgaagcgcggaatcgagacacataatggcgttccggatcaagcattgatccagagtcagccgaaaccattgcttcttgtgcttgatgatttgatgcttaatgtagggaacgattttttggatttgctgttcacacgcggttcccacaattggaatgtcagcgttatttttgtcacccaaagcctgtacggacgtaatattaagaccgcaagggcgaacagtcacttcctcccccccccccccccgaaattcttttaaaaaaaactacaaacaaaaatataaaagaaaaattcctaggaaattttttattaagaaaatttcaagaaaaaattttttgaaaaatttttagcgatttttttggaaaaattttttgaaaaaacttatttccttctcgtaagttttatttaaaatcttaaaatatacaaaattaaaaaaactaaattcagtaaatctaatgatttaatttttttcaaaaatgaacgattttcttgatgtatttgccaacttcagggcccattctgttcggtcgattcggtttgtttgttaaaactttttgtaaatgttgtttaatttaaaaaatgttcatcataatacctaaaatccgtattattattatgaccaacaatttcgttttcgtcttttttcagacaaatcggtgccaaaactctcacgcatattgttttggtctaataactgctatggattgtttcggaatgcaaactcatcattgccgctggtacccggtaattatagaaaaaatattttttcttattttattatttttcttttttatttaaaattttgatttttcatattttaaaggccggcgcaactccagataacctacacttcccagtgtgtggcgctgcataaatttaataagataataaa

SEQ ID NO: 64933 - DNA, 266 bp, Heterodera glycines
  Genomic contig location: Contig_ID=SeqID_7472; Location=438..703; Strand=+
  SCN-specific regions: Sequence locations=1-42,85-266
atgtacaacaacccgaagagggttagcagttgaagaagcatcatttttataaagaaaaaattcaattaaattgaaaataaaaaagaaatttcagtctttaaaaacagcaaaaattaatgctcattaatattcaatgtgagcttatttatttaaaaacgcattaaatacatttagtttttagctttaatttattgaagagattttattatgtttttacttttcaaaatgaaatgacaaattttaatgctcttaaaaatggatttaaa

SEQ ID NO: 64934 - DNA, 435 bp, Heterodera glycines
  Genomic contig location: Contig_ID=SeqID_35366; Location=39..473; Strand=-
  SCN-specific regions: Sequence locations=1-435
atggtcaacaaacacattcagcccgaatttgcgtccgttgtgccggcaattggtgagaatggtttctcaaacctttggtggatctatttggagtggcaaccagatatggtgatgaagtaagagctttttgttttattttattttcagcatttccattttccgcttttcagccgcgtcgtgggccttgtcgtcctggccggcccgttcacaacacaaaccgacatccgcggctacgacgtgcgcatcatttttgaccaccacaacttggagcacgaaatggcgatgcacggctggcaggagtgtgtgccgcgcatgagcaacatttgtgccggacaaattgtggagttcacacgtctcaaagtgcgcgcccaaggtcacaatgcgaagggcagcgtttcccttcactctgctctacaaagcggagtcgcgctgtaa

SEQ ID NO: 64935 - DNA, 84 bp, Heterodera glycines
  Genomic contig location: Contig_ID=SeqID_35370; Location=206..289; Strand=+
  SCN-specific regions: Sequence locations=1-84
atgcactgcttgtgcgttgcttcgtgggatcatgtacttgtacgtgttcttacgttacttgctcagctcggctgtggtgttttg

SEQ ID NO: 64936 - DNA, 65 bp, Heterodera glycines
  Genomic contig location: Contig_ID=SeqID_35371; Location=913..977; Strand=-
  SCN-specific regions: Sequence locations=1-1,27-65
gaataaaatttttaaaatttttaattcctttttaaacaggccaaaaattttaggcttaacttttt

SEQ ID NO: 64937 - DNA, 2340 bp, Heterodera glycines
  Genomic contig location: Contig_ID=SeqID_7476; Location=492..2831; Strand=+
  SCN-specific regions: Sequence locations=1-1025,1047-1141,1163 -1385,1407-1889,1911-2340
atgaaggaggaagaatatgagaagtttgaaggatggtataacgagaattttgagaccgaatttgagctaggttagagaaagtgtgttttaaataaaattttgtatttttttaggagaacagcttaaggtttactgtgaaaacgatgtggaaatactgatggaggcaattatgaagttccggcaattgtttttggatattactgacgggatggatgtgttgaaggacagtgtcacaattgctggggtcgtgatgaggatattcaggacgaaattcttgaaggacaggcacattccgatcatgccggagggaggatatgaaagggctgataatcagagcaaaattgccgtgaagtattttgaatggttggcgcaccgggaaggcataagggtcagacatgcggaaaatggtggtgagattaaattcggtgacctcaaagttgattgcgtcattggtggtcagaaaagaataattgagtttcaggttttcaaaaataaaagtcatccgttaatgtgagttctttaaggggtgtgcataccatgggtgcaaaaattgttttttgccctgggctgttggaccgaatggtttatgcatggaagagaattacagaaggacagagatgcggatggaagtattgagagaaatgtgtaaaaacttctcggtggaggaagtttgggtttgccaatttccaacagttattgattattgattgaacaaatttaggaatgtgaggtgaaagcggaattgaagaaaaataaggagatgaagaggttctttgaaagtgtgccggataagggaccgattaatccgagggatgcttacgcaggaggacgaacaatgcctttttgcttgtatgcaaaggctacggaagcagttgagatttcgatgtttgatattatcagtttgtacccctttgtgaattatggtaaaaatccgcttgcatttttaatattgccattcacttaagacactccttatcccgttggtgtcccaaaaattgtggtgagcaggaattttaatgtgaattggacggtgcccgacgatgtgccctatgatggactgctaaaggtgaaggtcatccccccgaaggaactgctgtaccccctcctccctgtgcacattgatgaaatgctcctcttcccaaattgtggtatttgtgcgagaaaggccaagaacgagtttgttacgacgaaggatgtgaaaaaatgtaaccatcggccagagcagagagcatttttggggacgttcacttcgattgaactgcggaaggctttagagctaggatatagaattgtgggattctatcgagcgtatcactttgagcaatttgacaatcaattgttcaaaggatatgtgcggatgttcttgaaaataaaggtggaggcgtcggggtggccggcggaggtgaaaagtgaagaggaaaagagagcattcaccgatatgtacaaggcgaaatacgatatctgccttgatcatgacaaaattgtctttaacccaggccttcgtatgatagcaaaattggtacgaaatacgcaaatattaatttatcagcaatgaaaattaaggggttgaacagcttgtgggggaagttttcgatgcgcaacacgctttcgacgagtgagatttttaacagcatggaacggtgggtcgcattgtcacaagacaatacgcttgatgtttcgacaccaatacaaatatgtgaaggagtagagcgtgttgtatatcgtaaaaaggaggagttcataaaggagcataaggtgtcgaatatagttttatctttgtggactacgagcgctgcaaggataaagttgtacgagtatatggagcaggtctacagggaggagggatgtaaaccactgtattgtgatacaggtgttttattataaacaaaatttccataaaattttatatttagattctctggcctttgctcatcggaaggggcggtgtccgttgaaggaggggaagtttttggggtaaaatacaaatttttgaaactctttaaattggctttaagggagatgactcgagaatattccgatagcgagattttggaatatgtgtcagctggtccgaagcagtacgccctgaagctcaggaggaagaaagatggggagatttgggaaaagaccaaaattcggggattcacgttgaataggtccaacaagatgcggtatgaagaattcaaggagatggtgttgggctatcaggaaggagtgaaaaaagtgtttcgttatccggaaaagattgggccgacaagggatagcaggatactctcaagggatgtaaagaaagaatatgggcccgtgcagaggaaagggattgttgatgaaaactttaat

SEQ ID NO: 64938 - DNA, 471 bp, Heterodera glycines
  Genomic contig location: Contig_ID=SeqID_7477; Location=180..650; Strand=+
  SCN-specific regions: Sequence locations=1-471
atgtcgttccaaaatacgccaaaagaagttcggcgtgcgagaaacacacgtcactttttcaaggcaacccctgacaagggaaagtgtctcgaaaagattgagagccatgtcaacgagcgagccaagtttggtataagggagcacgtaactagtttttatttcaaatgcccaccaaatgaagatgcggaaaataattttagaataattatcgataaactaatacaggaggcaaaggaaaaagaacctgcacaaggatggaagacggaaagaattttgctgaatttatattgtgctgctttgtctgatcctgttatgataccattgagaccactacaccaagtaacttcggatgttgtgctaaacgaatttatgcatcgtcagcaatcatttggcgacgtaaaccttatggacgaaagaatttctgtgatcgtgaccacttttgcatatcctctcaagtgatcttatgtgaaa

SEQ ID NO: 64939 - DNA, 514 bp, Heterodera glycines
  Genomic contig location: Contig_ID=SeqID_35374; Location=159..672; Strand=-
  SCN-specific regions: Sequence locations=1-18,41-62,84-122,145 -259,282-514
atggcgaaaaaagcggagagtagcagcagcagcggtggtgccaatgccaacatcgataaacgggataatgatgacagtgatgaacagcatggtctgaacgaggaacaactgttgatgatggacaaccaaaataacaagaaacatcggtaggatgtattcaaatgatatcgagataatagaagttatgcgatactcgagacggagtgttggcttatagaatcaaacttttcgatttaaattttcaagaccgagtcttagcttaaagagacaaattttgattttccgacattcgagaacgagccttggcttaataaatgattttcgacttaccgatactcgagaatcttggctttatgaatgaaattttagatttactgatattcgaaaacagtcttggcttagagaatcaattttcgctttactgattttcgagaatcgaatcttggcttcgagagtcaaatttttaattaaccgaggaggcagccaatgtttggcttcgggagccaaaatttaa

SEQ ID NO: 64940 - DNA, 685 bp, Heterodera glycines
  Genomic contig location: Contig_ID=SeqID_35375; Location=17..701; Strand=+
  SCN-specific regions: Sequence locations=1-36,101-685
atgtcagacgaccgaaaagaggcagagaaaaaaatggcaaaagcaatgtaaaatcaaaatcccaatttcaattttgttttcccttttcttcagcttcatctccggcgacgcatggctggcggtgtacgatttgcttccgccatcacaagttggactgggaattgcgacgatcagcctccgttatgactattacgtggacgaacatctcaagacgcgaaaatggacactgaaatttatccgaattcgaagcaaaattggcgagaatggcacggaaatagaaattgtcaattccgatggaaaagcattgccaattccgcaaattgaagtgccacgcaaagtcatcggattcgaatacatcagcatctcgtaaaattgggcgcgattatgcaaaaatttaagcaacttttcccctttcattttcagttacatcgaccacaatgtcatcgcttttgtcaaccgttttcgtccaattttcgatgtctgtcaaatcaatttggccatccgatcggcaggtgctcgcgctttggagaacattaagaacaacatttggccaatgatcaaacgaaacatttgtggcattcatttgtgcgaagacattttccaccgtttgcgacaattcgtcccgtcaattcacaacggctgtccatatcacttcgctttgtctctttccgttctgaggatctga

SEQ ID NO: 64941 - DNA, 256 bp, Heterodera glycines
  Genomic contig location: Contig_ID=SeqID_35376; Location=75..330; Strand=-
  SCN-specific regions: Sequence locations=1-14,37-256
atgttgttcaaaatagaaaactatataaaaagggtaaacaactaatgtgaaaaatcccaataataatgtgccaaacatttagccggcgaatgaagctgcgtttcgagcagttgttcaagatgtggagaatcgggccaatcaagcagaggaagaaattgaggagcgtcacaaggaagaccgagaaaccatcaatgcacaacaacaagagctggaattgttgtatttgtgttcccgtttagttcgacaatttcggaag

SEQ ID NO: 64942 - DNA, 858 bp, Heterodera glycines
  Genomic contig location: Contig_ID=SeqID_35379; Location=248..1105; Strand=-
  SCN-specific regions: Sequence locations=1-578,603-858
atggactcaaatctccggcattctaaacactgggactcactcaacccaccaactttcaatgacattccaatctctgggactcaattatctgactttccaatcgctgggactcaacccaccagcatttcactggactcaatccaccaacattccaatcaacgggactcaacccaccaacattccaatcactgggactcaatccaccaacattccattcaacgggactcaacccaccaacattccattcaacgggactcaacccaccaacatttcaatctctgggactcaaatctccggcattccaaacaatggactcaaatctccggcattctaaacactgggactcaacccaccaacttcaacgggactcaatccaccagcatttcaatcactgggactcaatccaccaacattccaatcattgggactcaatccaccaacattccattcaacgggactcaacccaccaacatttcactgggactcaatccaccaacattccaatcactgggactcaatccaccaacattccaatcaacgggactcaacccaccaacattccaatcattgggactcaatccaccagcattccaatcactggcactcaattctcctacatttcaatcactgggactcaacccaccaacatttcactgggactcaatccaccaacattccaatcactgggactcaaccctccagcattccaatcactgggactcaatccaccaacattccaatcaacaggactcaacccaccagcattcaatcactgggactcaaccctccagcatttcaatctctgggactcaaatctccggcattccaaacaatggactcaaatctccggcattctaa

SEQ ID NO: 64943 - DNA, 1190 bp, Heterodera glycines
  Genomic contig location: Contig_ID=SeqID_7478; Location=1..1190; Strand=+
  SCN-specific regions: Sequence locations=1-648,670-700,723-1190
  Gene Ontology: Mol. function=actin cross-linking activity; Cellular component=actin filament; Biological process=cell organization and biogenesis
actatcactgagtttaaacgggaataaactcgaaaccgaagctcgcaagaattgggatcgcttctacaaaagaaattcggacaattcttcaaggaccgaaattggacaaagcgagagattgagcaaatgtgcgcaaaagacatggaactgagtgtaatagtgaagcgaaaatgattgaggggaagaatgactcacgaggaaagggggacgaaagtgaacttcaaaaatggaatttaacccacgggactctctttctctccttttctacgccttttgcagcggaatgccctcctcacaaattcacaaatcaggcaacaaattccaattccgtggcctcgtcacttctcgggtttcggttatgatacaaaaaacgacctcacgttagtcgtggtttatatgtacgaaattcacccaactttctgcccaattcttttggttccaaagatttttctcggcctttactttttaggctcctttgactttgcttgacgccggttgcggctgtggcaacactttattcccattggccaaattcttccccaattggactttctgtggcgtcgatttttcctcaaatgccctctctttgcttcagcaaagggctgtacaaattggaactaacagttcggccgtttttctcattccattccatttcatttttgccttttcagttcataccgaattggtggatctgtcgggcgataccctcgtcaatttctcttcgcttcctaaagctgatctgatcactctgatcttcgttctctcctccatttccttggagcatcattcaaaagttgtccagaatttgagaaaacttctcaaaccctcgggcagtgtcattttccgcgattacggcgactccgatcagttgccattgacttttgcttaattgtttaattatagcgaattcagtgctatgcatcgattcaacacaaagtccaaaattgttgatcgtttcttcgctcgccaggacgggacaagggcctatttcttctgtccaggttaaacgaactgaaaaagaaaacccaaacatttccgtaactacaaatgcagacgaaacgaagaaattattcgaaagttgcggcttcgaaacaattaaaagcgaatacactcacagaataacggaaaacctaaaggagcaaattcgcatcgaaagaatttttgttgagggaagattcaaggcaccagcg

SEQ ID NO: 64944 - DNA, 1456 bp, Heterodera glycines
  Genomic contig location: Contig_ID=SeqID_7478; Location=788..2243; Strand=-
  SCN-specific regions: Sequence locations=1-19,41-184,206-243,267 -417,440-454,478-884,906-1456
  Gene Ontology: Mol. function=FK506 binding; Cellular component =histone deacetylase complex; Biological process=protein folding
atgtcgagacctaaagtcttttttgatataaccattggtggaaaagcagctgggcgtatcgtgatggagctttattcggacattggtaaatcataaggacagttactaatcattttcatttttttaaatattaagttccaaaaacggcagaaaattttcgttcgctttgtaccggcgaaaaggggatgggaaagagtggtgaggacaatctagtataattatcttcaaaattttgtttttaggcaaacctctccattacaaagggtctaaattccaccgtgtgattccaaatttcatgttgcaggtaaaactgacaagttacaaaggatactaaaaaatattttagggtggcgacttcactcgcggtaatggtaccggaggggaatcgatctatggcgagaagttcgtggatgagaatttcaaagagaaacacacccagcccgggattctctcgatggccaacgccgggcccaacacaaacgggtcacaattctttgttacgactgtgaagaccgaagtgagtttgtgtgagaaatgcttatacaaacgccctttcgaagcacctaattattaaactatcgtatttcgatttcactaatataataaggtcatttggtaatttagtggttggacggtaaacacgtcgtattcggtcgcgtcactgatggaatggatgtggtgaaagctgttgaagctcaggggtctcagtccgggcgcgcttcgaaagacattatgatcgctgactgtggacaattgtcgtgagaatagggccaagaaaaaccggattttccaatgttatgaatggtattgaaacaagttaaggcaatctctaattttaattattgagggcgatgataaatttgtgatttattaatggccaatttttctatttttgttggtgcggtacaacaaaataaatacatgtccatgatcaacgacccttgtaaagaaaaaaaatcatcaagagatcccctctatgacttttcatcgggcctaataaactgcaaagtgctaaacaagcgataaaatatgtgaagtggaaaatcactctttcgctggtgccttgaatcttccctcaacaaaaattctttcgatgcgaatttgctcctttaggttttccgttattctgtgagtgtattcgcttttaattgtttcgaagccgcaactttcgaataatttcttcgtttcgtctgcatttgtagttacggaaatgtttgggttttctttttcagttcgtttaacctggacagaagaaataggcccttgtcccgtcctggcgagcgaagaaacgatcaacaattttggactttgtgttgaatcgatgcatagcactgaattcgctataattaaacaattaagcaaaagtcaatggcaactgatcggagtcgccgtaatcgcggaaaatgacactgcccgagggtttgagaagttttctcaaattctggacaacttttga

SEQ ID NO: 64945 - DNA, 971 bp, Heterodera glycines
  Genomic contig location: Contig_ID=SeqID_35382; Location=1..971; Strand=-
  SCN-specific regions: Sequence locations=1-879
tgctgcttctgctgccgggcggtccctcgggcgtcgcttccgccgcccctccggcgcgtccctccgcttcggccctcgtcccctccacggtcctttcgctgactctgctccaacttgcggtgttcttctgcttcaagtcccttttcatcatcgccatcttcacgcgtagtccgcgtcttctgtgcgttcagctgatgttccaatattgcacctgcgttttcctcattctcaacgcgtcgttcactttggccgccgatttcggtcagtcttttcggcattttttttgccgctttttcatcgtgccaatccctcccccctccctatttttttggcggttacgacgaacggcgcatttacgcgaagcgcaaccctttgcttattcgcttcgtcgctttcttttctttggcgttcattcccgttcaaatttacttgcgtctgatgacagttccggtgtacaaatttctgagggaccttcgcaaatttaggcaagtcaaaggaacatttgttggttaagaattttacatttggcacccaccacaacagacatgcaatttacaatgggaaatggcgctatcggaagagagtttacttcacttactgctcgctgatgatggaacaacagcagaagaatttggccaggaacattcggccagacaaagtccaattcggggaatgatcagcaattgagcaatcattgaaatgatcagggaatgaatggaagtgatcagagcatcccttaaggttgactcatcggacgaaggccaacacacactgctgacagtgacggacgaaaatggcagcagcagtgccgcggaaaggggcggaggcggcggtgccgcaattgtcgccgcgcctttgccacttccgcaacgaaaacgcaagaagaagcagcagcaaacggtgaagaagcaaaagaggagcaacaaaaagagggagaagaagcacacggaggaggaggaggaaaaggaaaa

SEQ ID NO: 64946 - DNA, 773 bp, Heterodera glycines
  Genomic contig location: Contig_ID=SeqID_35383; Location=1..773; Strand=+
  SCN-specific regions: Sequence locations=1-2,37-38,71-71,101-152,275 -277,305-312,388-459,527-662,698-773
ggcaagaatgtcttcattaatcaagaacgaaagtcattggttcgaaggcgatcagataccgccctagttctgaccgtaaacgatgccaactagcgatccgccggtggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 64947 - DNA, 478 bp, Heterodera glycines
  Genomic contig location: Contig_ID=SeqID_35384; Location=230..707; Strand=+
  SCN-specific regions: Sequence locations=1-50,73-134,169-478
atgaaaagccataaaatttttggtctcatgaaaatttctggcataggtacacagaaaccctgaaaattctgtcgcataaacaatcgcattcttattcattccttagatttgtttcatttgatctttggccctccaattttgtaaaaatttgttttatttcaatttttgactctcattaatttgtaaaaactgtcttctttttctgttcaaaattacacttttacataaaaaccccattttagaagacatattcactcgatcaaagaacggcttgacaaatatggaggttgaggtgaaacagcaagagggtttctatctgaaggcaattgtgaccgatgtgttggagaattcgctggacgttgtttatgaccgtggatgccgaaagccggaaactgtggaattcaggtttcaaactcagtgaataagagggcatttctaataaggatatttccatccattcggagggcaaatgaatgaa

SEQ ID NO: 64948 - DNA, 260 bp, Heterodera glycines
  Genomic contig location: Contig_ID=SeqID_35385; Location=446..705; Strand=-
  SCN-specific regions: Sequence locations=1-137,167-219
atggacaacaaaattgaccaaaatcacaatcaaaatgatattgttggacaaaacaaagaaacagtcaaaagaaacaaatccaataatgtgcgtacaaatttttttcgtataatcaaactatttcagaattttgattgaaatttattttaaattttatatattaatagggaatattttgagataacgaagttttatcaaagtccaaaaaatggagaaatctaaattttattaattcttttttgaaatttaatataaataaa

SEQ ID NO: 64949 - DNA, 464 bp, Heterodera glycines
  Genomic contig location: Contig_ID=SeqID_35387; Location=380..843; Strand=+
  SCN-specific regions: Sequence locations=1-259,281-464
atgacattccaatcactgaaactcaacccaccagcattccaatctctgggactcaacccaccaacattccaatcaacgggactcaattctttccagtgagtttattgcatggtattggccgaagagttggcggacatggaaatgctattgggtcggcgagaaatgatgtgcagtatacgcagtcgagattggacggcgcccacccagtttttgtgcgtcaaatggctgttcactcccaactgacagctctgcgtcaatcggctaaccaactatctggtatagcgacaaattcgtccgaacaccttgcttaaaaccctcaagcggagaacattctttgcatcaacaatccgcagcaacaaattggcaatttcagcagaatttgccgcggcaaacggttcgtagaattgacaatgtcggacatgacgattgcaattaccgttgtgacaggagaaacatatacgtag

SEQ ID NO: 64950 - DNA, 184 bp, Heterodera glycines
  Genomic contig location: Contig_ID=SeqID_35390; Location=343..526; Strand=-
  SCN-specific regions: Sequence locations=1-3,27-157,182-184
aagcaattaaaaaattttttaaatgagaattcatgcgagattttctggaaataagcttaatagggcctagttaagctgtaaaaaaaaatttggggtgatttgaaagagaatagaaagaaccaggttcgatgaagttttggtaagccaaaaaaaaaatccaaacatttaaaaatctattaaaaaa

SEQ ID NO: 64951 - DNA, 610 bp, Heterodera glycines
  Genomic contig location: Contig_ID=SeqID_35391; Location=99..708; Strand=-
  SCN-specific regions: Sequence locations=1-281,310-440,462-610
atggtccacaaaaccgggtgcaatcaacgttcatttaattgctcacacgtaattattagttgagatcggcacaaatggtcgatcggttattagggggtttcggtaaaaaaaaagtcgaaaaagccgaaaagaaaaccgcgacccctgcccatctcgattttattagcactaattaatgcataattatgcgtaattatatgaaaaaaccttaagacacgacgatttgggttggctgaagacggccgacgattactacacgggaagtaagttcaacaaaattgttttattaatattaaataaataattaaacgctatttttattcggttaaaagacaaaaaattatactaaaaaatcatgaaaaattcaaaattttcttgaagaattttttttttttaaataccacaattaaccgtatttaaacaaattgtttatcaagcttatacaaataattaaaaatacttcaagcccaaatatttgatcgagttttttaatctatttatgctttattaaagcaaaagctgcaattgttccggtcggtgtacagttcattctgaataccgtaattgaagagttggaacggtaacagattttttaattctaatcaataaa

SEQ ID NO: 64952 - DNA, 328 bp, Heterodera glycines
  Genomic contig location: Contig_ID=SeqID_7480; Location=72..399; Strand=-
  SCN-specific regions: Sequence locations=1-101,124-328
atgagcaattctggtgtagaagcaaggcgaaagcggaaggaatggcgccgggatcttggtcgcagtgttggttgaacaccaaaaagtgacgaaaattgaccaaaattaattttattttaaaaacactgcattttccagggctaaagcagaccaatgccgcgccaacagcagatggagaggggacatcgacccaagccactgaaagtgggccgtcaacgtcagcttctgaccttcgtaagtcaataaatcactattttataagaaaaacttaaattaaggcccgcgttcaagcccaaggccattgtcagcaactccgatcagacgccat

SEQ ID NO: 64953 - DNA, 1941 bp, Heterodera glycines
  Genomic contig location: Contig_ID=SeqID_7480; Location=2018..3958; Strand=+
  SCN-specific regions: Sequence locations=1-857,879-1019,1042 -1163,1185-1713,1735-1845,1922-1941
atgcaatttcttcgtcaacacaaaatttcgcccgaggaaaattgtaaagacaatcgcaactttttggtttcattacaaaatggtggatgcgaaagtgagaaagaacaaaaacaaatttgttctttggaatttctcctcactctggaaaaacttcccgaactaaatggaaatgaaggacgagagcaaatacggacatttttcaaaaaattttcgttagctaccgaagaatggccagaaaaacgccgaatttcagcactcgagtgcaaagtaagtggaaaggcggaacgtgctttcagcgccgctgcagtgaatcggccggcgaaatttgatgcaatacgaagcgaaatggagtcacttttggacgaatgggattgtaccgcaattcaagcattcaacgaattgtgggatggaccaaaacggcgaccaggcgaaaatttggaagaatttgcagaacgagtttaccaacttgtgctttgtgcatatccaggtttgccgttggatttgtacaacgattatgcggcaaaacacttcattcgtgctttggaaaatgccaaaatttcgattgcattggaaatggctcgtcgtccgggtttgagctacgacagcttggtcgcgttggctgtgcgtgcggaaatagcgcaaaaagccgcaaagttaattgcagaggatgaaaacgcacacatagcacgcagctttaaaccaaataaggcggaaaagacgaccaccgattgggaaaaattttacgtccgaccgacaaataaaagcgtctgttataactgccgtaaaattggccacatcgcgcgaaattgtaaggtcaaattcacttggaaaaaatgcggctttgaacaaaataacagcaatatgaattttcaaaaagagaaccaaagaattaggaccgacaatttaccgagagcaaaaattttcccaaaagtctccgcccctaaacgagcaaaggatggccgaaacgaacgcaatttgtcgcagaaaccgatagagtcagccgatgcttcaacaatttttgctggtctttttgcttcatttttggttgttgccaacgcgttttcgaatgtgaaggctaaaactcatagccgccgaatcagctctacggctagtagcagctcgaaattgccggcattatggaatccgttgaatgttgcatttgaaaaattgaggaaaagggaaaattccaaagaaaacggaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaagctgcgtcaagtcacgctatcaggcctgttcaaaattgtagttttcgttttttccgcacattttacaggtcaaattatgatgttggtctgtgccactgctgattgtccacccttactgcccctcgatggatttgaagcgctgaggacatcgctttgtagagggcgaggatgtcatatcattgttgatttgaattattttggcgttttgttttagtttttgtgaccctttattttttttttttttggggtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgttttttttcttgccgttttggtttttgtcattttttcgcgtcctcgcgacgacgttttattagctccttttagatatttttaatttaatttaatgtacttttatttaacctttatttttcatcaacaataattttattaattattaaatgtttcaattaacattaatca

SEQ ID NO: 64954 - DNA, 583 bp, Heterodera glycines
  Genomic contig location: Contig_ID=SeqID_35393; Location=493..1075; Strand=-
  SCN-specific regions: Sequence locations=1-90,112-207,234-314,336 -394,430-583
gtagtaacacggccattggatcgcattgaactcttttacaacgatattacggacccaaacaaagaacgttccttatataaacaacaattcattgaaaaatgttctgaaattggttcatcaccattgattgttctggttgtgagtatttcaattttcgaaaaatggcattaagcatccaataatcatttagcattggttcaagtaaaatgtttattaaaaaataaaatgttttacaggacatgaagacctccctaaagactgcttgccgtttgccaacacaggaacagatggagggatatgccgaagttctggagctttttcagaaaattgaaaagcgccattttcaaaatagcgatatcattcgcatggaagaataccaacatatgaaacgctgtaattaatgaatatttaaaaatttatatattttttgattaatccatttaagcacttttggtcaattcaaaggggggacaatacatacaaagtcaactaaaccaaagtatttagttctacagacagcaaacagtacagatgccagacaagcattggtcaaactgaactcggatttgcgtggcgtgcaagg

SEQ ID NO: 64955 - DNA, 846 bp, Heterodera glycines
  Genomic contig location: Contig_ID=SeqID_35394; Location=19..864; Strand=+
  SCN-specific regions: Sequence locations=1-21,43-43,66-628,650-846
atgtcaaaaagtaaaagcggcgaaagaatgaagaggaattatgataaaaaggctggtaaagcgaagaattttgaaaatggacagccgatttttgcgcgaaattaccttggtgggccaaaatggatgcagggacgaatcttagaaaagattggagcagcaatgttccgtgtaaagaccgcccgtggagtatggtgccggcattttgatcagctcaaagctgatttgacttcgacagctgacaattgtgatcaggagtccgaatcggaaagtgagacagatgcggaatcggacgacgaacaacaaccgcaaccaattccgattgggtgtccacgccaagaaattcggcagaaaattgcgcctgagggaggtgtgcctgatcaggcattgcgccgatcaactcgcgatcggaagaaaagggtaatttttgacccctcgtgaggcgcattccgctcaaagaagggggaaggaattgtagtgtttaagtggatattttgaattttaaatgcccacatttcccgcccattttactgcccataaatatggaattgtttccacttcctttgctttttccaccattcattttgtcatttaatttatctgcatttattatttgtcctttgacctaccaattttctgtgttttatttatttggaataaatcaatattccctttaactgttgctcggacacaacacaaacgaataatgttaaaaagaaataatatgattccatcaaagaaattcttttgttacgtaaatattttttatttattcagtgtcaattctcggaatatgtacactctaataattacttagaattacaaacgaataatgttaaaaagaaataa

SEQ ID NO: 64956 - DNA, 468 bp, Heterodera glycines
  Genomic contig location: Contig_ID=SeqID_35395; Location=157..624; Strand=+
  SCN-specific regions: Sequence locations=1-288,310-468
atgtcttcaatgaacgataatgtaacggtgcaaggtgaaagaaatggacctcaaacggatatcgaagctgtgaatactgacaaggtccaacccaaaccaaacacccgcagcatgatcaaaaaaagtcgctgggacaataattgtgcaaaacctgtgcaaaaggatgctgaagaagcgccagctgtcaaaaagaggaaagtcgaggacaacgagctgtggaaactcatgaagggaaagtatctattgggcttctacctgtgtgcgggtaatttttaaaactttaacaaaggtcatttaaaattttaagaggattggaacaagctgtacttcaataaaggaaaggtgctgcgcgctgtggatcatcagcacttctctgtgaactttgagatgtgcgaagattgcgcccgaaagaacatttttgccaccgatttgctggccccaccaaaaataaaaaaatataatgagtga

SEQ ID NO: 64957 - DNA, 802 bp, Heterodera glycines
  Genomic contig location: Contig_ID=SeqID_35399; Location=83..884; Strand=-
  SCN-specific regions: Sequence locations=1-802
atgaaaaaatatttttttagcagaaaagtgattttgtttcttaagattgcaattccaacaaatcaaatgggccaacaacaaaaagtgaatttgatactttcctgttttgggtcgacgcaccccaaaaatttaaaaaattccacaaaaacgcgcccaaatttacgcagtcgtaaagcattttttgggcacataaatgcaacaacaattgttgctaaaatctctttgaatggctcatcttgagaatattatgtgatatttgtgaaatttcgcgccgattttttttttgtttaatttaatttttggtgtgcgaccccaaaataggaaaacatcctgaatttagtcaaataattaatttatcattaatgatgattaaaatgtacaattacaaatagttaatgatccatcacaattttagctcgtcgaaaaagcgaaaagcaatgacaaggatgtgaaacttaaagcagtgactgaaattcatagaatgctcaaggacggctttaaaaacgatgccgccgtgatgctggtgatcaacgaattcatctcagccggcgtgttgggtccgctcgtcgaatgtttgtccatagacaatccgtctcatccccaactcgtgtccaatgccatggcggcactcgcaatcattgcgtcacgaaaagcagagcctattttggaactactaaatgtcatggattatttgaattatgggcgtacatatttgcggggcgacgaagtgaacaaaaatgttgcttccattctaaagaatttcatgcacaacgttagaattttagctcagattatgagataa

SEQ ID NO: 64958 - DNA, 514 bp, Heterodera glycines
  Genomic contig location: Contig_ID=SeqID_7481; Location=253..766; Strand=-
  SCN-specific regions: Sequence locations=1-178,217-514
atgtttaagccgttcaaattcatgcttttcattgcactgatcattggagatggggcagcagctatcactggcactgttctgattcagatagtaataatcctttggctccaacaaaaaatgatctttgcgctcttgttccgacgcaccctccaacaggtagtagaacacgtggtaattcataaaaaaaaagaattttacaaataaattttatttttagcgtccaggtataaggtgaatgattttttggattacatataatcctctatttattttatcctataaattgttaattaatggataattgacttcgaaagtcaagagcaagagtctctgctggaaccttacaaattagggatacgacaaatctcaacacgtaactcgaaaccaatacctttcgccaactgcctgtgagatgattcttgatttttcgagcagataaatttcaacattagctccacaaacaatgccattttctcggtaattcacctaagaaaacataaaatagtataataaa

SEQ ID NO: 64959 - DNA, 862 bp, Heterodera glycines
  Genomic contig location: Contig_ID=SeqID_7481; Location=1..862; Strand=+
  SCN-specific regions: Sequence locations=1-222,271-550,589-862
  Gene Ontology: Mol. function=myosin ATPase activity; Cellular component=actin cytoskeleton
ctgctggccccgttttggaggcgttcggcaacgccctgtaattgcagaacaacaacagcagccggtttggcaaattcatcaaggtacgtattacggtagtagaagtacacggtattttttataattaaaatgacaaattaaacctacttttcaaaaaacagtagtgaagagtattaaaaaaactataaaaaaaaacatatttgaatttaaccgcatccatactaaattaagataaattttaattaataaatatttattatactattttatgttttcttaggtgaattaccgagaaaatggcattgtttgtggagctaatgttgaaatttatctgctcgaaaaatcaagaatcatctcacaggcagttggcgaaaggtattggtttcgagttacgtgttgagatttgtcgtatccctaatttgtaaggttccagcagagactcttgctcttgactttcgaagtcaattatccattaattaacaatttataggataaaataaatagaggattatatgtaatccaaaaaatcattcaccttatacctggacgctaaaaataaaatttatttgtaaaattctttttttttatgaattaccacgtgttctactacctgttggagggtgcgtcggaacaagagcgcaaagatcattttttgttggagccaaaggattattactatctgaatcagaacagtgccagtgatagctgctgccccatctccaatgatcagtgcaatgaaaagcatgaatttgaacggcttaaacatgcgatgggcgctgttggattttcggaaaattcgcaacaaaaaatttatggcatgatttcagccgttttactgctaggcaacattgagtatataaag

SEQ ID NO: 64960 - DNA, 2893 bp, Heterodera glycines
  Genomic contig location: Contig_ID=SeqID_7482; Location=1382..4274; Strand=+
  SCN-specific regions: Sequence locations=1-180,203-301,394-553,576 -581,627-679,702-949,971-983,1027-1031,1053-1122,1145-1320,1400 -1537,1568-1640,1691-1792,1818-2087,2109-2893
  Gene Ontology: Mol. function=myosin ATPase activity; Cellular component=actin cytoskeleton
atgctggacaaattgaaccattttttgcgcacaaatgaatactacgaagtgccgcataagcgtgaagcagcattcatcattgcgcactatgcgggaaaagtgaaatatcaaattgctggttttcgtgagaaaaacaaggatctgatgcgccacgatgtggtcagagtttttatagtcaaacccaattaataaattattttaatcgatttaaaaaatcgattttttcaatgaaatttgtcaatcagaacttttgatttttttaatttcagaatttaaacattttaaaaatccttaaatttccaaaaataaatataattaattttatgaaattaatttttttaagtttactaatttggaaaacttttttaaaataacaaaactatttttttaattgtagatgaacacgttgaaaggcagcaaaagtgcctttgtgcgcgagttggttggtgaggatccgcttgcggtgttccgatgggcacttgtccgtgcaacattccgtgccgcgtatgcattccgcgcagctgggaagcggaacaaacgcgcgggtattttattttccaaaattcccaattttctgtatcatataaaatgatttaattaatttaaattttttttttgtaaaattagagacatttaggcagtgttgaccgctatgggacttcaaccgttggcaatcatggcattattggcacaaaaattaatggcgactgtgccaatggaagcccaaaaatgttgcatcggcgctcatcagactcgcggcttaacgcctttctgcgaggggaattagcgtaagtttggtatttccaacagtaactatttgatactgtaaaaataatatccctttatttttaatccaggcccagcattgtgcccgacttttgtgacacttcagtgtttaagacaattgttgagcgggcgagaaaggtgtgcgaaatttacctgtcataaggctattagcaaaataataaaaataataagccgactaataaatataatgttgatatttattaataaaaattaaaaaaagtttctgatttttaacaaagaaaaagctcgaaagaagcttaaattaagaattttattttttgtttgaggctatttttattttcttcaatttgtaagaaattatttttaattttattttccgtttttagaaaatttaagtgtcaaaatgatttataaagcatgtgctatgtttaaggcgccaaagaagccgcacaatgacaggttcagcaatttgagaacactacaacaactcaagggaatcatgtccaaaaagaagcagctttctaataagccaagttcggtaagaataatcgcaaaaaaacattattaattaaaattattgaaaaaattataattaataattaaacacaataataaaaaacatatttaaaatgccaaaaaaaggaaaaaaatcagtaaaatatcttccgaaggaaatggtttcataatgttcttccgctttttatattctttaaattcaatttttcatcacgctaaaaacattcccggatatgtttactttttgctaatgaatttaataaacataaaaattttattttttggtcagcaaaatttcaattagtctatttattccgattctttgttccggcaaaatttaaaaaaaatgtttccacaaattttatatttatttaattgaatctattttttttttcaattttaaattgggttgatgattgattattcgatattttatgaaatcaaataatttcttcgtgaccataattcggttttgattagaatttattctaaaaatttgattaataattaagcttttttgtgaataaatttttattcatgcgactttcaatgaattgaaaattcttaagtttttcaaattttaggttagccgccaatttggcgaatcgctatctcgactgatgaaaacattggaccgggcatcgccctacttcatccgttgcatcaaatcaaacaacgataaaattccaaattattttgatgacaacatcattttgcgccagcttcgatacaccggtatgctggagacggtcagaatacgacgggctggctacagtgtccgcattgaatacggggtactgtacaaaatacaatagaagcaacaatttgtatatttgataagatatattgttaaaaatttttttttagtctttcgcaaatcagtaccgtactctgcttccaaatggccataatgtaagttttggaattcgtaatttattttccgccaaatcattaaaatatttgaatgaaactcgaattcccgtctttgaccttgagtctcgaccttaataatcagaccttgcgaattcttgaactgttgtatcggattttatgctcatctcgagtactaggaaaatacgactctcgaacatttgtacatattagagaccggcaattcaatcggtatttttcaataaagttccgaaaaaatcgataccgaaaaacatgtgaaaatttctacatcaattttttaaataaaatatcgaaaaacacgaaaatttcttgatgggtttttttaattatcgtagtcatcgatattaatatcgactgataaatcaatcgtgccggtctctctctgtctttaacccaaagcgcctgacacctcaaatatatctctgacaggtcgaaggatattttttttgaaaattctcatttttagtcgaccaaggaagacatccaggagttcattcggtccatcccggtcatcgactacaacaatttacagtatgggaacacaaaaatttttatgcgtgacacggagaaattgttgctggatgaccacttgcatcgggtgataatgaagaacatcgtcacactgcagcgctggtttcgtgccaagttggagcagcaccgttaccagaagttcaggcagggcatcatcaaattgcag

SEQ ID NO: 64961 - DNA, 470 bp, Heterodera glycines
  Genomic contig location: Contig_ID=SeqID_7483; Location=569..1038; Strand=+
  SCN-specific regions: Sequence locations=1-115,155-470
atgcttcgtcgagcagctagcacagaaagtgatcaaattcaacgggaagaagaccgaaacgctatggttaaggtgggggttatatgaaattcaaaaatggcacagatttacaagaaatttcaaagaattttttaaataaatttttgcaaattttcgcttgcacattttcagattaccaattccttttcaaaagtggcaccacgtgccaaaagtggttttatgaaagcgaagaagcacctgaaaactttgctgaccaagaccgggcgtcagggcaccacggaaggcacattcagtgaggaaagcctgaacatggaaggaccgtcttcgtcaacaagaaggtcacaaagtgtgaacaactccatggatagccatggatacaaattagaacaaatattattaaacaattattaaatacagaattttttggcaaaaatttttttgcataatatgtttttttcttggcacaaaaa

SEQ ID NO: 64962 - DNA, 1101 bp, Heterodera glycines
  Genomic contig location: Contig_ID=SeqID_35410; Location=84..1184; Strand=+
  SCN-specific regions: Sequence locations=1-731,753-817,841-1101
atggttagagtgccggacggagtcccggacataagcacgcttccgaaaggcaaaaacccgtataaaaatcagcttaatgcgcttctgtgcattgtctgtctgatttacaacgaaaaacttgaaaatgagacggattataacctacttaaaggcaaggaccatcttcaaaatatcagcaaaaatacttctttcccgggagatagaatggattctcaaaaaagtccgaaagtaaacggaaaaaatttgatgggaacggaaattaaggattttttgggaaaattcgacggaattgtggcacaattgaggacaattgtttttcaagggaccgaggaggtaatggagacggacaacatcgactttgccttgacctgggatatgcagtgcggcggactcggaccggagcatcgaaattgcgtccaattgacaaccgctgatttggacccagttttggagagggccggattcggactcaaggtggccgaaggcaggctgaagccacaaaatgcaaaatttgggcttaaggtcgtgggaaccccgttgaaggctttgttggccacttttctgttaaaaaccaacgccatttcttcatctgcagccggcagaaagttggcacaatcagtgattggagcaccagttgggttcgaactgatcactttcatcggaagccgcgaagaccaaatcaaaagtggccgaattccggtggaagaagatttggaggccatcctcgagaaatggaccgaatgctgtgcagttacacggacgaaattggcaaaatgtggatttggcgccatcaatgtgccaattccgcgctcaattgaagacctcccagaaggagaaggaaaaccgtggaccgaactgctcggaaaagccggatttgtgctggagaaagtgaaggccacgtcggtgctgcgcaaacaccaattcgttacgtcgccacgcataattattggagactcaagcgcaaagcaatttgaggacttgtggccgacttctcagtttattggcgccacccaaggaagtgtttggagatgtaattcgggcattttgacgcagtggccctgtcgtcaaagtcaaagtgggcgtgattataatcgggcgtga

SEQ ID NO: 64963 - DNA, 492 bp, Heterodera glycines
  Genomic contig location: Contig_ID=SeqID_35411; Location=6..497; Strand=-
  SCN-specific regions: Sequence locations=1-492
atgaccccaaaagtcggtccgcaaatgtcggtccgcaaaagtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaaagtcggtccgcaaaagtcggtccgcaaaagtcggtccgcaaatgtcggtccgcaaaagtcggtccgcaaatgtcggtccgcaaaagtcggtccgcaaaagtcggtccgcaaatgtcggtccgcaaaagtcggtccgcaaaagtcggtccgcaaatgtcg

SEQ ID NO: 64964 - DNA, 272 bp, Heterodera glycines
  Genomic contig location: Contig_ID=SeqID_7484; Location=233..504; Strand=+
  SCN-specific regions: Sequence locations=1-272
atgccgaccaaaatagtgccatcccacctggtgcttctgctggagctgcttcctcctcccttttgctgtgctgttcgaagtcggccgtgtcagtcccttgctcgcgacggccgttgccgctcggccagcagcactggtgttgttgtgccgattgcacgcgactgctacagcccgtgctgggcgtgtgctgcagcagcaaaccgttggcagaatttgaacggtgtaattgtcgaggattatgctgaatggggtgggagtgaagtggtggtgag

SEQ ID NO: 64965 - DNA, 945 bp, Heterodera glycines
  Genomic contig location: Contig_ID=SeqID_7485; Location=138..1082; Strand=-
  SCN-specific regions: Sequence locations=1-17,39-263,288-710,733 -825,911-945
atgaaaagtcgacgggcaaaagccaagggaaggaaaggaactgatcgaaaggttgaaaagcgtaattggtggagaaatgcaagaaatgcgcactcaaaaaacattgcttgttgttttgagatggtcacttcttccgtttgctccgccccaactgcgcttggaaagcatcgcaacccaagcggcagcggcagaagcgccccgtcgttggccaacgcccccgcggcgacgaatggacccaaaaggaggggccgaaagcgaattgtgcagcagcaggtggagcaggagatgaacaacaaagacgatgggcaagaagggcatcagacggagcagaaggaccgaccgaaggaggaagcgcaggcttcggacaaaccgacgaagcaaggaggtgccaatcatcattttgaattggcaatgccattgttaccgggttggcattccgtcagatggcacccctttggcctcttccgacagcggaatttccgagtccaacgcggcggaggaaggccttttgtgcacaaatgttgtggtgacaacaatggcacggcatcagcagcagccccacaaccacaatgtgaacaacgcccatttgacatccatcgcggaggaggagccgaatggggggacaccgccggggaaaggcgcgagcggtgccaaaagttacggcacgccgaggcaaacgcaacggacgacgaacaaccccgttacggtagtacagtagtcataaagaaaattcatttggttgtttgtgcagtcgacgagtgctggcgaagcgttaaacggcaggacaaatgtcgcggggacaaagcgccggaggggacggccacggaagaaacaggcggaagaagcgatggaagaggacgaagcggaagagagcagcaggagaggcatggaagaggaggtggaggaagagccgatggaagaagtacggcacggaaggacatttaa

SEQ ID NO: 64966 - DNA, 735 bp, Heterodera glycines
  Genomic contig location: Contig_ID=SeqID_7486; Location=291..1025; Strand=+
  SCN-specific regions: Sequence locations=1-16,133-159,183-543,568-735
atggaggaccaagacaaacaaaatcaacaggaaaggaatgataaaaacgacagccaagaagaaccagaacaaaaacacaaaaatcaggaccaaggtcaacaaccacaacaacatgagcagcaacagcatcaaacttcacaggatggcaatgggcatgcgaacggcgatttattgagcagaactttatcaatgccggcccgtgtgactggctcagatttcgtatcagcggatgtgaatgaagtgttggaggatgcacgacaaattatgacaaattcgcaccaacgaaaagacgaccatcatcaaaatgaacaagtgttggtcagtcagtttgatgatgacaatttaaatatgggaaagctaaaaaagcgcaatttgttaggacgaatcaatgcgggtcaaagtgacgaagacaggaggtgacgaagaccctttggaagtgtcggtgtggcggtcaagactgctcagacgtcaggccgaagaagaagcgacggaggctgctgatgctgatgcgagaggtaattcaggggggggagataaagccaagagggaaaagttgggaggaaaatgacaaacatggcataaatgccggtaaatgaccaaaagggaccatttaaagccgctttaaaggacccctcatcagaggaatgaatttaaagggtttgaatacaaaaacgaatctttcgccaagagaaatttgaattaaaaaaatgccaaatttcacgcaaaagtccccga

SEQ ID NO: 64967 - DNA, 178 bp, Heterodera glycines
  Genomic contig location: Contig_ID=SeqID_35414; Location=9..186; Strand=-
  SCN-specific regions: Sequence locations=1-46,74-178
atggctatgagcccggtcacagcaatcgaaacatggattatgaaggtaataaaaatttttaaattaattaatagccatttataaattacttttttttacttaggctatgcctattatggagaatatccgttggcgtttgcaatttgtttcaaaaacatctacatttatgacttgctga

SEQ ID NO: 64968 - DNA, 660 bp, Heterodera glycines
  Genomic contig location: Contig_ID=SeqID_35420; Location=31..690; Strand=-
  SCN-specific regions: Sequence locations=1-53,75-660
cagttccctgtgccaaattcggcttcttcgctggctgccactggcattgccaacactagcagcaacaacaatggcacagagaaagaagcattgtccggcactgaagaaggcgccagtttgtgccactctcgcggatatggcacggaaacaccattttcgacaattgtgccgtcgtcaccatccgtgtccatttcgaactttgagtgggtcgaagacattcaaatcggcgatttgcccaaccaaaatgaatcatttgcgcgggtgccatcccccgccactcctccgccattggcaccatcggcactgagcaaagacattccattcgatgccacttttgaacattttcgggtgccaccgcccgccactccgccgttgtcgtcctcgtcgtcggtgctgacaatgagcacaactgcagctgaagacagtagcaattgttctacgatcttttccacaacgacgacaccaaaagccgatgcaattgacaacgaaaacagtgccaattgctatttggaccgattcggcaaagagtggcgtttgctcgtcgaagcggccgccgatgtcaaacagttagaccaaattgcgggcgaacattgtctaaatcgcaaagggccgacgaaaaatgatgggcgcatttacttcaagtgggtgacgatgagctga

SEQ ID NO: 64969 - DNA, 55 bp, Heterodera glycines
  Genomic contig location: Contig_ID=SeqID_35421; Location=942..996; Strand=+
  SCN-specific regions: Sequence locations=1-55
atgcaaagtgaagcaaacaagcaaaaagacggagatttggttgacaaacaaaaat

SEQ ID NO: 64970 - DNA, 723 bp, Heterodera glycines
  Genomic contig location: Contig_ID=SeqID_957; Location=963..1685; Strand=-
  SCN-specific regions: Sequence locations=1-723
atgcgtgcccaattggcccagtcgcttctcgacggcactgtccattcaatcgtagactcgctaaaagatttgcaaacaatccaagaacagtaagtgaattaaaatggacaaaatctgtaagattagcttaacaacccaatggaggtgaagaagttttgttagtaatttcacattttttaagacattcatttcggtttcccttttcgtcggaatgttaaaaaacaaaagataaaattccaattaaagttctttttgttaggctcatttctttcacaatttcagacatttgtgggcacaacgtgaagaaaaaccctcacaattaaattgcgatggaatttctgatgagaaggaacgccagacaaatgaggacaaagcgattttggagcggattgaccaggtaaaaaagtatcaaagaacagacagttttttacatcgcaacagttttttgcgcttttttccaagaaacttctgaaaattggggttttatttgaaagcgatttattgttactatatttccatttgtcagattgcgcacgagcaacaaagcactttgatctgtgccggtttgcctctgttcaaaagttcggacgacgcgagcgatttgcgcattcaaatggcactcatccaattcattctttcgctgggttcaatttacagggattgaacggccaccaaacaatacgaagggattgggagttccctcccaagcacatttttaataaa

SEQ ID NO: 64971 - DNA, 1439 bp, Heterodera glycines
  Genomic contig location: Contig_ID=SeqID_958; Location=2558..3996; Strand=+
  SCN-specific regions: Sequence locations=1-261,283-309,352-434,456 -541,563-571,595-617,639-757,779-919,942-1373,1396-1439
  Gene Ontology: Mol. function=glycerol kinase activity; Cellular component=mitochondrial outer membrane; Biological process=glycerol metabolism
atgcttctctccatccttctcaaacagatccatgccaccgacgtgaccaacgcgagtcgcactttgttgatggatttgcagaaccgcaaatggtctacagaaatgtgcaccttttttgacattccgatcaatgttctgccggaaattcgaagttccgcagagatttacgggcaccttcagaaaggtcgtgttggaatatttggtcgaattagccaatttgcatctttaggacctttggaaggcattcctttggccggctgtctcggagatcagcaaagttttaagcttttgttggctttaaaccatttctgacccccaaggtgctctgcttggtcacggctgtttgcaggcgggcgaagcgaaaaacacttacggcaccggcacttttatgctttgcaacacaggacaaagggcgtacatctccaagaacggacttttgaccacaatctcttaccaagtggacaaagtcgcccattagaaggtctcattttccccaattcgttcagttcggccaagcgtcgcccgtttgctacgccctcgaagggtcggggtccatcgggggaaacgtcgtccgatttttgagggacaatttaaaattcttcgaagtaatcaaaggaacatggctcttcatctcaatctctaacgccctaatttcgttcagaaaaccgcggacattgagggattggccgcgagtgttcccaacactgaggacgtttatttcggtaagtcttggcatttgccaattgtttcggtttatcggatatttgccatttcctctccatttctggtaatgcttcttcgtccgttcagtcccctgcttcaccggcctttacacgccccattgggactcgacggcacggggaatcatttgcggactcacccaaagtgccacccgagcgcacattgccctcgccgcattaaaggcattccaaaaataattcgggatgttcaagaccgacttgttcactttttcaggcagtcgcatttcaaacggtggaaatggtggaggcggtcgaggcggatatgtccgatttgggcgcgactgtcctttcgcttcgggtttttgttcaaatcgtttcacgaatgaattcaatgattaaaggctgacgggggaatgacccaaaatgcgctgttcaaccaaatccaagctgatctgcttgggctcctcttggaatgctccaaaatgactgaaatcaccggatggggcgccgctttggctgctgcaattggggcgggacagataaagtgagaaaagggcaaagcgaaatgccaaagatgaaaaacgaccccatttaagtgcgaatacaatgatcgaattgcaacaacgcattcgaccgcaaagcacaatattttaccagccaaaaacggacgaggaacagagaaagaaggaaaacggacggtggaaagaagcaattcggaaagcattcagatgggcataa

SEQ ID NO: 64972 - DNA, 255 bp, Heterodera glycines
  Genomic contig location: Contig_ID=SeqID_959; Location=1912..2166; Strand=+
  SCN-specific regions: Sequence locations=1-113,145-255
atggaaagtggcgaattgttcaccttcgcttttggcgcctttgccatcgctttgattgccctcgtcattatttattacaaatgcatcgaccgacgtttgtgacaaaacatttgaaaaaaaaataaaataaatttaattatttaagcgccaaaaaaacgattttattaaatgggcacaaaaaagagaaaattgaagaaaaagccgacgaacagaaaaaaggaaaagcgacgagcaaagaaagaaagaaaaagcaaa

SEQ ID NO: 64973 - DNA, 1200 bp, Heterodera glycines
  Genomic contig location: Contig_ID=SeqID_960; Location=286..1485; Strand=+
  SCN-specific regions: Sequence locations=1-58,80-290,318-574,614 -982,1004-1200
aggtcgtttatgtggcaatgaattggactgatgggttggcaattggcaatctgtgcaaatctcaaaagcatttggcactttccactctctcccaatttgcggccgctttcaaaacgaattttgtttccaatctgtccaaatttcacagcttttcaaactttaacactttcatataaagtgacagacgaaagcaaaaaatgaaattcattaaaagtcggaacgatgaaaagcctcacgacttttgtgttctttttgataattgccgcacttccgccgattgtttctccaggtaaaattattataattatttaataattggcaactaatatttacttgtagttaatctgattttgttcagcccaatctccgccttatggccaacttcaaattaagggaagcaaattaatgagttcgagcgggaaagaaatcgtactgagaggtgagcgaaacgtttctcgaaaaattgaaagcctttttaggaatgtcacttttttggagccaatgggacccaaagtattggaacgcggaaacagtgaaacaattaaagtgcaactggggcataaacatcgtatggacaaccaaatgaaaatatttcaaaatatttcaattaattaagctccgcgctccgatgggcgtcgagggaagcgacggatatttgcaaagtgcggcggcgagtgctgcgaacactcaaaaactgatgacaattgtggacgcgtgcataaacttgggcatttatgtgataataggcgagttaaacaccatttaattggacgggggaaagtgttccattaagattggcattatacgagtgggaaagcgtacacggcacaagcggtggactttttcaagaaaatggcacaaaaatatggcaaaaacccgcatgttttgtacgaaatttggaatgaacctgttggggtggactggaacaaagtgctgaagccgtaccaccaaacagtgatttcggtaagacaaaacggaagggaagagcaaatgccaaagcacatttggcaacaatcaaaggcaatccgtgccattgaccccgacaatgtgatccttctcggcacgccaacctattcgatggatttgaacccagtgatcagcagcccaatgggcggcctaaagaacattatgtacgttacgccagtattcatttagacaataacccaataaattagtgacaaaaattatgccgaaaaaatc

SEQ ID NO: 64974 - DNA, 521 bp, Heterodera glycines
  Genomic contig location: Contig_ID=SeqID_961; Location=66..586; Strand=+
  SCN-specific regions: Sequence locations=1-290,312-521
caaaatatgctcaaaaaggcaatcaaaagcggattgccggtgtttgtcactgagagcggcgccggctcaggcggaagcaatgcgcccgttaatttgccagtaatgaaccaatggtaattagcagtaatgggcaaagagttggcatctttcccattgtacaggtggtcccttttggagcagctcaaaatatcccaaatcatttgggcagtgcgcggagagggaaatttacaaaatccgctgaataaaaacacggcacccgcaaacattggacagaattgggcactaacggaatacggaaaagtggtgaagaatgtgttcacgaagaacgcaaagccgattgggtgttaaggggagagaatgaaaggaaaggaaacgaattacgaaaaagggacgaaaggaaaagccaaaggtacgatggaaattaacagaaatgagctaattacaataacaaatgtcacattaacgcatcaagaaataaaaatagccaattgaaaataacaaacactcaaaattaccaaaaa

SEQ ID NO: 64975 - DNA, 1940 bp, Heterodera glycines
  Genomic contig location: Contig_ID=SeqID_961; Location=1581..3520; Strand=+
  SCN-specific regions: Sequence locations=1-215,238-509,532-690,720 -865,928-1185,1207-1940
atgtacaataactgtggtcagcaaaattccaattcagctacagacgaattcattcaaacagcgaaccaacgacagttccaaacgcacttttgcggggcgcaaaatgagggagacagagcgatcggacaacgacccccaatcggcgggggaaatgtgagtgatcggagcggaaaatacaaagggatggaagctgatcagaaaggagcggcgggagttagcaaaaggactgagagaaaagcatggaagtgagagaaaagggataggagtgatcagaaaagggacggaagtaatgaaacaatgaacggaagtgaacataaaaggggtaaaagcgatcagaaagggtgatagtgatcaggaaaggatgggagagatcagaaaaggatagaactgataaaaaggggacgaaagtgatcagaaaaaggggaaagaagtgatcagaaaaaaggacagaagtgatcagaaagtaaataggagtgaatcaaaaagagacgaaagttatcataatggatagatgtgagagaaaagaaaatgaagtgatcagggagtgatcagaaatggacatggaattatcgacgctttaatgcttaagaatgcattggtgccattggacaaccgacagacaaacttttaccagcagacaatgggcggagttggaccaatgaaaagggcgtttagtgaacacgaaaatgttgatgggagaagggaagggacagacgaaaaagtgccgaaaaggagggggggggggagggaatgaaacgaacgaaatttaggagaatcagcagccaatggccaaacgtatgcatttgtcagtcacagaaagtgccgaaacaaaacggcacaacgacgggaaatttggagagcacggggaaaaggaggaagaagaggaggaaaaggaagaggaggaggaggagggagagggagaagagggagaaaacagccgaacgacaaagtgagggaggggcgaaagatagtgccacatgcgcttttgcaggtcgagcagttcggcagaaaacgaagagccgctgggctgctattcgtcctcagcggggcacccgcagcagtcgcacctttcggcccatttgatggccacgccgctccaacggactcagcacacatcggcttcgattgtataccccgaatttggccagctaaacacgccaaatggccaccgtttgcagggaaatcctttggctcactcgactccctatttgggcgccctttcgctcaattccttcccgcaacagccgctggactattggggcaattgcttcggttgttcgctgccattgaactcattgacctcctttagcaggaggtgtcgcgctgcatcagcagatgaactcccatttttcgttgatggcttccaacaaaaacatcgccgcggggggtgcctttatgccgggccacgcccccctgggccaattgacgccgtcgtcgtccgcttattacagtaacccatacggaccacaacagcacaatgtacgaagggatcaatttgagatgttgctgaagatggatgctcattcgaatttttcagcttatggcaccatttggggaaatgacggcaaatggcggcggaggcgttttttcacagcgaaatgtaaaaatattaagcattcacaggatattaacctaaggccggtccaccatttccagcagagtttccatcccattttgcaaaacaattcgtccgccaattcgccgtttcaaagccggcaattccatcgattaaaattgaaaaatgattgagcaatttcagtgacagtggcgtaggaagtgttagggcggagttaaaaggtgggtttttgaacacggagagtacacaatgggaagaatcgcagaagaagggcgaaatgagacgaggagcagcacgtcgggagggtcggacgaaagcggaagcagcggaagtgccgtgggactcaattggctgcgcgttgggg

SEQ ID NO: 64976 - DNA, 629 bp, Heterodera glycines
  Genomic contig location: Contig_ID=SeqID_7487; Location=27..655; Strand=+
  SCN-specific regions: Sequence locations=1-81,133-158,181-588,610-629
atgaagagatttatcaccccggctaacaactactttttgaaattgactccggaaaaggaaaatgaggggtttgttgaactgttttattattattcttattattatttaaatattattcattaaatatttaaagtgtaggagaagcaaatgatgtgggtggaaagaagaagaagccaaaaattggaaatgaggacgaaaagagcactgagactcgtaaggaggaacatcaacaacagcagcaagaagtgcaagcagatgaatcgcctgcaaaagaacgaaaagtggaggaccgcgagttgtggaagctttgcaagggaaaattcatgctttctacctacttatgccagggtaattgtataattatacctataaatgtgaaatgacaatttttaagatgactggaaccatctttaccacaacaagcaaaaagtgacacgtttggaaaatggacgctactccgtcagctatgagctttgtcccgagtgtgtgtgggcaaactgtcgagcaactgaccttgtggcaccaatgaagaaaaaaggaaaatgaccaaaaaataataacaataacgaacgattgattgattgaccgatttattttgctatttatttttatttaatcgaattaatgta

SEQ ID NO: 64977 - DNA, 1548 bp, Heterodera glycines
  Genomic contig location: Contig_ID=SeqID_7487; Location=901..2448; Strand=+
  SCN-specific regions: Sequence locations=1-95,117-420,442-516,553 -773,795-854,877-1062,1098-1112,1279-1346,1386-1428,1451-1548
atggagagtgagcttattgctcaagtaaaggaatactgcgacgccttcctgtcattgaaagtccatgttaatgacttgaaaaacatggcaatcaatttgtcttcaagaacagaattaattgaaaagtgggccaccaattcggtataatattagatattttacttttatacacttgaataattttagcgctatagcccatacccaaaaggaattggctcaacaatggcaccggcagttatgcgggaatcatttcaactgttaaagcaacagtcgaaccaacgacaacaactggaacaacgaattttgcgcgacggcaatttcgaagaaactgtcatgcgcactgcgattgcgtcactgaaaggcacaatcaatgcggcatcggctgcccaatcatcatcaccaacgccacttgatgatgcaccgacttcatcatcatcatctatgccaaaaattgcccaaaagcgcaaatatatggccaccgatggtctgttgtcggaagaggacaggggtaatttgattttaatttgaataaatttataaataaatatttttcaaaagaagtcgccgccctcgcacttgctgccttcaatcatctgaaggtgcacattgagcagaaacaacaaactttggagctaaaactcaacaaaattgagcatgagtcaaaggcaaagagcgaatggcagatgcgacaactgatgaaatcattggaagcaaatttcaaactacagattatgagtatggagcaacggcttgacagaaaatggtcagcattgattggaaaagaaaaggaaagagctcagcgaatagcgacacaggcggctacggtgatcggtgagttgattgcggaaggaggaggaaaggggaaggaaaaacaatgcagtggagtgatgtggagtgacaaatgtaagtggtgtctggatgctgggaatgtatgttttggatcatcaaactgtggtcatgcttttgtttgtcctcagtgttctattactattgcgggatctgatcaaccaaaatgtctcacatgtttttgtgaatctactgaatttgtgtacttaggtatggaaaaataatcataaaaaatgaataattttttttaacttaatcagcatttgttgtttttatattccttaatttctaatgcattaattaatttatttattttgtccatcatttactttatcatcacttattgctttttattccttaatttcaaatgcattaatttatttgtattgtacttccatttatttaatcaacatcttttttattccttaatttgaaataatgttgtacaaccttttatttaatcaacgtttattgcttatgtatttcttaatttcaaatgctttaattaatttatttgtattgtgcttgcatttatttattcatcatttaacttgaaaatgtaataatttaattatttgattgtccatccatccatccatccatcaatttacttaacatcatttcaaatcattcattcactgctcttcctcatcaacatctttatgaccatcctcgctaacacatttcgccatgcaattggga

SEQ ID NO: 64978 - DNA, 416 bp, Heterodera glycines
  Genomic contig location: Contig_ID=SeqID_35422; Location=113..528; Strand=-
  SCN-specific regions: Sequence locations=1-15,37-416
gtgtttcggaacggatgtgaaattgaagacatggaggaattttggaaacaagcgcaacaaatacaaacggacaatcacgaattgtccgaaagagtgtcttctttaactcgagaggtttaacagatggggaaataacaaaaaaaattacaattacagcacaaccgaattcttgtcgatcacaacactcttcgcaccgaacatgaacgaattcttgtcgatcacaacactcttcgcaccgaacatgaacgaattcttgtcgatcacaacactcttcgcaccgagcatgaacgaattcttcagcgacagcttgacgatttccactattgggtgagtattgctaaaatttaaaaccatgacagaagagtttaataatttttgcaaaattttagattctttgtttcgccttctttatcccg

SEQ ID NO: 64979 - DNA, 275 bp, Heterodera glycines
  Genomic contig location: Contig_ID=SeqID_35425; Location=1183..1457; Strand=-
  SCN-specific regions: Sequence locations=1-275
atggcgaagtaggcaggcgaaaatcagtgccaaaaaatgcaaaaaaataataataatgttcgtgtattttatttcagtagaaaactcgagaatcgagattctcgacgagttttgatcagtgaatttttaatacaaaaatgttccatcactagtgatcataattccggattccgaccagggaactctgaacaaaatttgtacgaagaaaaactgagactttcatgatagtatcggacttcatgctcagaagaggaacatgagttttgatcaataaa

SEQ ID NO: 64980 - DNA, 244 bp, Heterodera glycines
  Genomic contig location: Contig_ID=SeqID_35426; Location=580..823; Strand=-
  SCN-specific regions: Sequence locations=1-21,59-82,104-130,152-244
atgagaaaattcattcggttctaattaaattttgttattacatttttattttatttttcagattggcagttttaacaatagatgaaattatcttttttaatgaccaatagtcaaaaattgtttcacaggggataaaatttaacaaatttattcgaattaaattatcaaaaattaatgaaattcctaatttagtaataatgctggaaatatgttctgtatgtattccagcaatgtgcaaaataaa

SEQ ID NO: 64981 - DNA, 827 bp, Heterodera glycines
  Genomic contig location: Contig_ID=SeqID_35428; Location=83..909; Strand=+
  SCN-specific regions: Sequence locations=1-228,250-334,357-827
ctcatttgtccattttgccgtttcgatgtctccaccaaaacgtgccaaagtgtcagccgatgatgatggggagacaatttccgacgacggggagccatcaacgtccgcgggggcaaagcgaaagcaaaaggcgtcgaaaccacgccaacggaaggcgcatgaggcattcattttgctggtggacgtgggccgttcgtctgccgaaaactcggcgggggcacagagcgatcacggcaccaccactgacctcgaccgatcggtgcaaatcgtcgattgggtcctttcacgaaaagtgcgaatatttatctgggaagcggggcggaggatggaaaaatgttcatttgcaaaaaagaagggattccttccccatcccctcgggtttttctccgcatttccatgcctgaacaaaagccacactttgctttgtctcgacagattttcaccgaatcctccgatcgcttctctctgatgttcttcggccacgaaaacacgtccagcgacgaccatccgaatgtttacgtgcacaacgaacagttcgccacggcgcggatcgaatggctgcacgtgttgcagaacgaagtgcagacgaacgtcaaatgccccggcgattgtctgaatccgttggcactttccgcattttccccccaatttcagacgtcgacgccctttacgctgcgttggacgcactgaaagtgcactttgacgacgcaaaagaggcgggcgaaccgatgagcggagcgacggtcactttggtgagcatttgagcggattggacgacgagcgggcggtgatggacggagtgggtgacatcgcggccggctttcaag

SEQ ID NO: 64982 - DNA, 592 bp, Heterodera glycines
  Genomic contig location: Contig_ID=SeqID_35429; Location=132..723; Strand=+
  SCN-specific regions: Sequence locations=1-321,343-544,566-592
gaatccggaaactggcgaactgcgcagctgtggcactgctgcagcgctgcatggcgaccttgacagcgtgcagcatggcatatgcccgtcctcgttcgtttgcaagcgtgacgtgcagcgacgaaagcctgcaacaaaaggggaggaagcgccgcgcgtatgctgttcgccaatcgcattttgccctgatgcgcgactgccgcaggtcgacccccgcactcggcatgcaaaacggtaagactactttaactaccgtaatccatttaattgagaggcgaattactgtgggtacggctcaattatactgtaacaatatcccaaattttcgttatgtctagctgtttgtctgctgacgtcaaagcatcgccaactgctggtgcagtgaaaaggcatcaccattactatggcgatagtgacaatgattatggtaactgtaccccaccgtacacctgccagccgtctaccgtatccggcatttttgtgtgctgtaaggtgccaccgatgacgggaatttaaggtcgtaattacatgacctctatttcgacccattaaattttttgtaaatgtatgccaggggaggttattcaatcga

SEQ ID NO: 64983 - DNA, 994 bp, Heterodera glycines
  Genomic contig location: Contig_ID=SeqID_35431; Location=12..1005; Strand=-
  SCN-specific regions: Sequence locations=1-710,733-994
atgttcaacaaatcatcaaactacgataaggtcctccagcaccttcctccacgtgaagactactgtccaaatcaaatgatgaaaactgacctccaaaagttcatcacctggtataataacaactgtcaccaaaaattcgacctcaaagaaaaactgcccgaatactgctgtaacgacgtcctaatcctcacccacgccctcgtggaactacgtcgggaattcaaacaacttacacaaagggaaggaaaacacggaggaatagacatcctcgtggcaagccatcgacgatcgccaaagcttgcatacttaactttgcactcaacctcaacatccagacggcacactcccggtacggcgaatacgttttcaaaagagaagggcgggcaggtgtaccaagtggacggctacatcaaaggcacaaatgggaagcgggacaaaataattgaagtgaatgggtgtgtctggcatgggtgtgaggagtgttttggtaatatggatgaggagacgctgatgccgaacggaaagaaactgtgtgagataagacagagggaaaaaaagaagcacgaaatgctgaggcgctatgttgacttagaggtggtgtgggaacacgaaatcaacgagcggttgaaaaaagacaaaatgatgaaacaatttttcaacaactggaaggagaattcacccatcaaaattcgggacgcatttcatggaggaagaacagatgtgaaaaaactaattcacacaataaaaccgggacaaaaaatcagctacaaggacttcaccagcctctacccgtggaccaatttttcaacaagctacccgctcggacacccaaaaatcatcaacctgccacaaaatgagcaaatagtcaactggcgcaaaccatcagacaacacctacaaaggaattttaaaagttttacttctgcctcctaacaacaacctcagcgttaccgtaatgcctgtaaagttcaatcagcgcctactcttcccccttt

SEQ ID NO: 64984 - DNA, 1089 bp, Heterodera glycines
  Genomic contig location: Contig_ID=SeqID_7490; Location=60..1148; Strand=-
  SCN-specific regions: Sequence locations=1-433,469-510,535-754,776 -865,887-945,968-1089
  Gene Ontology: Mol. function=actin binding; Cellular component =secretory vesicle; Biological process=endocytosis
atgtcgaacagtttcttcgtgtttttgccaagcaatgtaacggattacccggaaaatcaacccaataaatttcgtgttcggctccctaagcctttgcattttaatggtacatgggtgtgcgggctgcacagtatcagttaccccttctcatggtcaaccattggtacattggacgaacagtggattgacattcacttcaccgaccgcaacgctcctgatgaggacaaacagcgagtgattagggtgccggtgcccaaggcggcacataatagagcggaacagctgaaagactttttgaccgtaacattgcggaaccatagcgatgcaaaactactgccactccctcgtgaagtggagcaggatcggaatcgcacaaagcctctcgaatctccaccaccgttaaagagagtcaaaagagataccggcaccataacaccgtcacaaccaccatcaccacaaccaccaccaattttagatgagcatgggaaaccgctcggttctcccccaaagtacaaagaaggggaggaaaatgtgattgattcgccgcctctttatcaagaaacacaaaaagatggtgtaacaacctctgtaggatcaaaagagccgtctccgacgccgcccactcaaagctctgctaaaccagtaactgcaactacacctgttcctccaacatcaaagccaccgccgtcttctattcagtcggctgcctctgttaagccaccaattacccctaaccctgcaaccaaaccatcaactcctgcggctgctgctgctactgttagtccaacgtcatccactcctgttaatacaacagctcctgtagtagctgcaaaatcctcaactctcacaaagcatccagtccaaactcctacaactcctaaaacagtagcatctacagctagtgcagaacaaactacgtcagctccacctcctagtgcccaacctaaagccacaaacactgttaaaaagtcagcaactacacctactacctccaccacacccgaaactgttcataaacagaccgttagtcccacaaaaactgaacaggatgatgctaaacaatcatccggtccagtggcagccgcgttg

SEQ ID NO: 64985 - DNA, 851 bp, Heterodera glycines
  Genomic contig location: Contig_ID=SeqID_35432; Location=181..1031; Strand=+
  SCN-specific regions: Sequence locations=1-200,222-464,493-603,626 -687,709-851
  Gene Ontology: Mol. function=oxidoreductase activity; Cellular component=basal lamina; Biological process=electron transport
ttgcgttgacggttactacggagaccctcggcttggcatcaatttgccttgcaagccatgcccttgtccgggtgggccgggctccggcttccaacatgctgactcatgctatttgacgccatcgccgagtccgacagttacatgcaattgccggttggcgtttaactaactaactaatttccaaatggattttctctcgctgtgtattgtgtattgtttgatcacttttgtaggtctggctatgctggcgagcgttgtgatcagtgtgccgtcaattattggggaaatccgcgcgaaatcgggtaaaattatttgcgtttgattcttatcagttttcttcttatcacaatcctcagcacattataatttcaatttgcacatatttagcgcctcatgtgaaaaatgtgcctgcaatgggaacattgatttgaatgtctgtgattttgaagatgcttttgaaatcaaatatcaattttctttattttgatttttcctgaaaggtgccggagagttgtgatgcgacgactggggtctgcttgaaatgcttgtacaacacggtcggagtccaatgtcacctctgtgtgaacggattttttggtgatgcgcaagcacgcacatgcacacggtggggagcgggtcgggacgggagtaatttggcaaatgattttatcggacatttttctaatcttttttcagtttcgttttcaataatttgggcgccaattcgagtgctggctcttgcgatcgtgtgtctggccaatgcccatgttatgccaatgtggtcgggccccagtgtgaccagtgcgcccctctccactacgatttggccagcggaaaaggtggaatgcgcg

SEQ ID NO: 64986 - DNA, 689 bp, Heterodera glycines
  Genomic contig location: Contig_ID=SeqID_35438; Location=341..1029; Strand=-
  SCN-specific regions: Sequence locations=1-2,87-101,220-228,290 -291,314-331,355-362,403-538,562-577,662-662
gtcctcatcagtagggtaaaactaacctgtctcacgacggtctaaacccagctcacgttccctattagtagggtgaacaatccaacaattggcgagttctacttcgcaatgataggaagagccgacatcgaagaatcaaaaagcaacgtcgctatggacgcttggctgccacaagccagttatccctgtggtaacttttctgacacctctagcttaaaattctaaagaactaaaggatcgataggccacgctttcacggtttgtattcatactgaaaatcaaaatcaagtgagcttttacccttttgttctacatgagatttctgttctcattgagctcaccttaggacacctgtgttatcatttaacagatgtgccgccccagccaaactccccacctgacgatgtcttccacgtagctcacccgcacaaaagcacaggcttccatctagaactgggcacccgagaggatggccaggcgctacataatggtataagtaaaacgacattagaagtagtggtatttcactgttggcagagcctcccacttatcctacacctcctaagtcatttcacaacgtcagactagagtcaagctcaacagggtcttctttccccgctgatttttccaagcccgttcccttggctgtgggttcgctagacagtagatagggacagtgggaatctcat

SEQ ID NO: 64987 - DNA, 134 bp, Heterodera glycines
  Genomic contig location: Contig_ID=SeqID_35440; Location=661..794; Strand=-
  SCN-specific regions: Sequence locations=1-51,73-134
atgcaagtgccgccgttgctgtacgcttaccagttggtgagcaatgacggaaaattgcttaaaaaagaaaccaaacaaactcatcaattgttagctcccgttgacaacccgaagggtccattggggcaatggat

SEQ ID NO: 64988 - DNA, 653 bp, Heterodera glycines
  Genomic contig location: Contig_ID=SeqID_7492; Location=371..1023; Strand=-
  SCN-specific regions: Sequence locations=1-199,221-263,297-436,458-653
atgcggggcggaaaagcagctgaaataatgctaacaggggcgagcgttggacacgaaagtgacgaaatcgaatggaaaaagctggcaaaaaaggtgagaaaagtataaaaaaaattgatatggtgggaaacctaagagtgtttaaatcaaaaacaaagccgcaaaaattattcgatttataaaaatgcaaaaatttctcgtcacattttttaaattaaaaaagcgaacttcggtaaatatttaccgttaattgtcgtccggtctctaaatattgtataaataaataaaattgggaataaatgtgcgactaattaagggtgttaaatttcttatagatggtggaaatgagaattttgttttgttttttttgtacaggcagtgatcgccctgatgtttcacaaaatacttgatgagcggcaacggcgccgggtgaactcggtggccattcctcgagtggggatttaaatggctaattttgaatgttaacatctctaaatttcggcacactatttttcaggccaatgttggaccgtttctactcagtgaacagaagatggttgtgcccaaagaattttaaagagggttgttgaaaatgtaattttatattttactgtttctgtgtttaatctgttggaaaaatcttataaaataaa

SEQ ID NO: 64989 - DNA, 228 bp, Heterodera glycines
  Genomic contig location: Contig_ID=SeqID_7492; Location=1803..2030; Strand=-
  SCN-specific regions: Sequence locations=1-184,211-228
atgcttttcgtctctttgttggccaccttttgcttccaaccgtcgcgctgtgccttttttgacaagcatcggaaacggaatgccatggacaatgccgacggggaatgtgccgaagacggatgcgtcagcgatgttgaagccggaagtggtgccgaggacggggatgaactgttggatgacgacgacgttcagcagcagcagcatttgagaagtgatgaatcagagtga

SEQ ID NO: 64990 - DNA, 466 bp, Heterodera glycines
  Genomic contig location: Contig_ID=SeqID_7492; Location=2177..2642; Strand=+
  SCN-specific regions: Sequence locations=1-131,153-466
atgcgatatgctcggcaccatgtcgataatgccgaagaagtcgccgacaaacttttgcacggaccaaaacagttggcagaagtcgacgatacggaagagcagcaaaaaactgaaaatggggaaaacccgaatttctttgaaataaaattgaaatttcacataatttcaattgaaaaaaatgtgagacgtgccgatattcgtgcaacagcgaagcgccgacgggcacaattacgtaagagccgtaggtccaataaacatggaaatcatagcagcaaaattggatatttggaagtacatgtgtttgcgactgctcagctcctaggtgacagaatgccaaattaggaaacatttaaaaattatgtttgaagtgccgcaaaaaatttaatttccaaactattcaggatttgtttcacacacctctcaggaaatcgctgaagatgcacaaatcgagttgctcatcatatga

SEQ ID NO: 64991 - DNA, 66 bp, Heterodera glycines
  Genomic contig location: Contig_ID=SeqID_35445; Location=437..502; Strand=-
  SCN-specific regions: Sequence locations=1-66
ttgatcgtcggcaacaccgaattgaccgttgaccaggccaaagtgcaaatgtccatctgggccatt

SEQ ID NO: 64992 - DNA, 697 bp, Heterodera glycines
  Genomic contig location: Contig_ID=SeqID_35448; Location=258..954; Strand=+
  SCN-specific regions: Sequence locations=1-38,61-450,530-697
cggcgttattcccaattttattgttcgattctgtgcacttttccattggaattgaaaatgtttggccgccaaaccatgcggcaataaacgaacagagaaaacacatcgacgtggacacgagttggacaggcaaagagcaaaagacgcaacaggtggagaaaacggggggaaaatggaaaaatgggtaaaaaaaaggacaaatgggtaaaaatgggacaaatggtaaaaaagggacaaaaaaaacagatcggtcttgacgccagtgacaaagaacgcgctgtggtcgatttgctgacggagcggaagcagctcgccgcatcagctcacggaaatgtggcggcagcggaaacgagcgatggaaagcgggcgcaagtgcaaagatttggggacaaaggcggaatagcgcaagtggaggggcacaggtgggacaattggggaggcaaaagcattggcaaaaaagggaaaaggaggaaaaggcaagggtaaaggcaaaggaggaaaagcattgacatgaaaaggaagggaaaagctgctgaattcacatttcgccataaaattgaaacagtgcgcaactgaaaacaaaagagaacgcggaagggcggcacgcgttgctaaaggcggacggcaaatacgaattggacacaatggcgaaagggtcgctgaacgaaacgaaagacaccgaattcgaaagcgcaca

SEQ ID NO: 64993 - DNA, 284 bp, Heterodera glycines
  Genomic contig location: Contig_ID=SeqID_35449; Location=573..856; Strand=+
  SCN-specific regions: Sequence locations=1-167,189-284
aaatttttaaaaattttccagcaaataatggaaatttttttcgaattcccccctcaaacgaaaattaaaaagtttaataggcaaatttcgtaacaagtagcactcaaatttccaaaaattttttccggcggcgcctatcggcaccgccggacctcccttttccactatttttacaagttttttgccttaaaacggccaaaatttggtcatttttagtgaaaaagtgcagttgttactcagcagtagaaaaaaagttattggttaaatagcaaaaaaaaaaagaa

SEQ ID NO: 64994 - DNA, 336 bp, Heterodera glycines
  Genomic contig location: Contig_ID=SeqID_35450; Location=812..1147; Strand=-
  SCN-specific regions: Sequence locations=1-336
atgagaggcaggctgtgcccgcatggtatcacttcgtgctgtgtggacatttcggtgcgcggtgtacagcaaatttcggcttactgttgttacaaatgtgccgccgccgcttcatcatcagctgcgattgaagcgaacacaacgacgacgacggcaaccagtgatgggggcggcacgttggccaaagtcgcaacagtcgccgacgattctgacgggcaactgactgtgcccgttgtcgctgccaacaacgatgacgaaatcaaaatggagcaacagcaccactcgccgccggcacagcatcggtctcccacagcgaccgcaactgtttacaattag

SEQ ID NO: 64995 - DNA, 722 bp, Heterodera glycines
  Genomic contig location: Contig_ID=SeqID_7493; Location=206..927; Strand=+
  SCN-specific regions: Sequence locations=1-384,406-722
  Gene Ontology: Mol. function=RNA binding
atgggtggagctagcctgggacctctcaaggcggtaaagggcggtgcggggagttccattggagcacgcattgcacggaatgcaatcgagcggaattctgggggtatggtgaagctccaagtttctaacttgcccggatcggtggtcactttggatttagaggtttggttattctaactggtaaatctcatgttaaccttcaggaacttttccaagacttcaatgttttcggagtcgctgttcattatgatgagatgggcaatcatttgggaactgctgacttgttcacagaccaacaatctgccaccaacatccttaacgaattcaaaaacatcgctatcgatggttgttcttaatttaagaatttctattaaaataaattttaaggccaagaaatcaaattttgtttggttactgaaggcgctgattctgttggaggtaaaagagggaacattcgcgaccgtcttcaacgaattagcggaggacctaatccgataagaaaaaagcccatggttcgtaaacgaatttctggaggaccaatcagaaaagtgtcgcgcactgttggaggacgacttaaaggttaatagcatattttaaatggcctacactaaatttgtttatatttattagttgctggagctgggactagcaaagcggcacctaaggcaaaaactgctgatgaattggacaaggagctggaagcgtacatgaagaagctgtag

SEQ ID NO: 64996 - DNA, 859 bp, Heterodera glycines
  Genomic contig location: Contig_ID=SeqID_7493; Location=1460..2318; Strand=+
  SCN-specific regions: Sequence locations=1-248,270-606,628-797,819-859
atgactttcgctgttgaggaaggggagtcccttttgcttggcgaggacctttctcaattggctcgaaatgacgccgaaaccattcacggttcgatttgtgcacggtacgaacggaagaagcgcttttacgtaagttttaaaaaggcagccgcggtggcacaaattcccgattggcagagtcgcattggcttctccgatttgctggcattgaccaccgaagggcaatccccgactttggccttctctgacccttccctttttgccccctttttgtcttccgatcactccaacgcccacatttttgcgacagcttcccaaacactaaatgaactctgcggagatggaaaagaagcggccattgtcttctgtggagaggcgggcgcgggaaaaacgacgaatttattcaacgcaattcgatttttggcatttgcggaggaaaagagggaaaaattgggcaaaggtaaaatatgaggggattaaatgaataaatcgagcaattgacagaaatggggaactaatggaaaggaacattcagtaaaaatacttgaagaatcattagagaatttggagggagaggggaagagaacttttgccatcggaccctaagtttggcaatttaattttaaacgaggaattgtagacctattcgtgttcaagccgatgttattggcctttctttaatcacgtacagtatatcagcaaatccttttacagtatatgggtgacccacaaaaattgaccagattagattgccaaaatgaattacctattcgagaaaaactgtaaattataacgagcattttatttcacaggaagcaacaacagaaatgacgcaaatgttacgcgcaatttattgaca

SEQ ID NO: 64997 - DNA, 838 bp, Heterodera glycines
  Genomic contig location: Contig_ID=SeqID_7494; Location=1157..1994; Strand=+
  SCN-specific regions: Sequence locations=1-165,187-472,494-544,566-838
atgactgacggcaaattgaatccgaaggccctgcaacgccaacttcgcattctctccgtttcggaccattgcctcgccgttcgccacggattccaacacaaaattccaatcaaaaaattcgccgatttgtttcacgtccttttgccagaagaagtgttgttttcgatattatatttttaaatttaagttatttgaggtcgtccatggccaaaattcacaccaaattgccaaggatattttggatgcccagggcattcgttatgccggcctatttgaattcatcccgggtcatctctttctgatggagtctcttttcgctaaattatgccaactgaaacagtccacgctcactttggccgccttaatcatccaaaagaatttccgaaaatttctcgcgcgtcagcattttcttctgaaacggacggctaccattcagatccaagcggcttttagaggatggaaatgccgaaaaatgtgtgggagaaaggcatggacagagaaaaaaatgaaatcactgatggaagaaagactgagagtaggggcaaagaaagaggagcaaagagagatatcggaggacgaagagagcgatgagggaggaaaagacatgatgagaacaatgatgaagatggaggacatggaagaggagaggcggcgagagatcagtgcgatgctgaacagaactgattatgccggaaggaaggccaaagccgagcacaccaaatgggctctcttccgggagtgctccgactacgtccgatcgacttggccaccagcaaaagcaaagggcccctccttcggtccaacaatcacttttgaacaattcgccgagcaaatcaaa

SEQ ID NO: 64998 - DNA, 878 bp, Heterodera glycines
  misc_feature (622)..(622): n is a, c, g, or t
  Genomic contig location: Contig_ID=SeqID_35455; Location=1..878; Strand=-
  SCN-specific regions: Sequence locations=1-67,104-332,355-403,464 -854,876-878
acttatctgcgagaatttggtcatctgaagcacaatgagaatggcctttcccatggcgttaagtgcgtttaaataaaatttcaaaatgaaatattttaaaaatcacaaatattttaggcatttccaacgctttttgggctaccggcagacgggcaatgtcgacttggcaacccttcaaaaaatgtcgtggaaacgctgtgccaactctgacgagggctacacagcacaaggtgggggcggatcgatgaattatggcatttgccaggattattttggagtaaagaaaaatgccggaaatttggccctaaaaatcaaaagtcaaactaatttcttggcaaagttaccaaccgagaatggcacttgcattacacaaagtgtttaatgcaatggcactggctgtgttttaaataaataataattattattttttaattagtccgataattaattaattacttaattattcgcatttgtttttttcgctttagacccatcgcaactttgggaacgttcgacattgttctggaacctgaacgcgtcgcaccccaagcagttcactcatggcgaaacgaagtcagccaaaatttggcacaatttgccaatttgaattagcactcattanacatgttttattacatgcttttgcataattaacttaattgcgcttaattttgcaggggattaattgcgcaagcattccgcgcatgggaaattgtgatcaaaatcgactttctggagacgaacaatgcggacaatgcgcagatcattttcacatttgaaagcgacggagcaaaaaaggagaaaagcaaaattggggaaggaggagaaaggaaaggaagggcaaaaaagccaaatcactttctgatttaataaacacc

SEQ ID NO: 64999 - DNA, 318 bp, Heterodera glycines
  Genomic contig location: Contig_ID=SeqID_35456; Location=420..737; Strand=+
  SCN-specific regions: Sequence locations=1-162,184-318
atggaaccttttatagtgcgtatcagttacgcagggaaattgcgcccctatgaactcgcagaatatgaaactattgcaatgttaaaagtgcgtgtcgccgttttcgaggatgtgcctccgatccagcagcgtcttttttttcaagtagtcaatttgtcatagaaaaaagtcataattttttcattttagatcaccaattggcgaacgagggagtcatgtccaccatggtgcaattctcattcgtgtggcgccgcctggtggcgaactcgtctgatgtgccaagacagttcggaatctccatgttttttttgtggttga

SEQ ID NO: 65000 - DNA, 681 bp, Heterodera glycines
  misc_feature (29)..(29): n is a, c, g, or t
  Genomic contig location: Contig_ID=SeqID_35460; Location=1..681; Strand=-
  SCN-specific regions: Sequence locations=1-681
tttggtcagttgtgacgacgccgccggtngccatgtcaattgggaggaacggcgagtgtttgcggacagacgaagtgcggcaatgacagtttgcttcgcttaggcggcgtttcaccttacgtttccgcaaggcatgtgagtgagtcaattagcagccaattggggagcaattaattagtcgctaattaggcttaatttgccaattagcatttgtttgtttccctttttggccattcatttaatgttttcgccttaccttttgtctttttgttagcatcgttctatgattggtcctctcattgagaatgctttgtccgattctgacctccgttcctctgacattgacgcggtgtccgtttccaattgtcctggcctcgtttattgtctaaaaggcatttcattactttattcatccatttaattcagtcgtttctctccattttcagttggtgttgagcatgcgcttgcttttgccaggtgttggaaagaattaatgaccaaccgtgcccaattaatcaattggctaattagtcctaattgacttagctaattgcctctctcccccttttgccttttcgatgctttcgtcgtcccctgattcccgtccaccatttgcgtgcccactctttggtcgctcgtctgctccatccccacctctcttttccctttctcactctcatc

SEQ ID NO: 65001 - DNA, 1046 bp, Heterodera glycines
  Genomic contig location: Contig_ID=SeqID_7497; Location=2198..3243; Strand=+
  SCN-specific regions: Sequence locations=1-60,90-171,200-263,285 -948,974-1046
atgcgttggaattacaactatgccaaacgaaaacaccaagaagaggtggatgaattttgcaaaaaaaaaatattttaaaaactaaaatacagtttttcctataatacagtactccattggtaatgacgttgacccgttcggcaatgtgtacactttcaatgcgggcgaaggcatttacaaaatgccattttttgtgagcattccgtttttaaataatgcatatacaatattttctttttaaaagtaaaaggtttaaaacctccttttttgaggtcaatgactttgccgacggagtgaacagagtggcgatggactcctcaacagcgggcaaaacctacgaatttgtcgggccgcactgctacgaaatgtgcgagttggtaagtaaatcgaaacgtattttcatgtccatgggagtcgaacaaatgacgggattgaaatttaatgaaaaggaattttcattatgtggttaacgaacaagaaagacatttgtcgtttattaggtaaatggagctgaattgtatgtcataaatggacggggggggtcagaaattgcctttaccaaataagaaatatcccccatcaggccaaaattgaaaaaaaggctcaacatttttttaaccttttttttgcgtggcgcgctttttccaaaaaatttgcggaaggggggcgggggggtccggcggtgcgaatagacgccgccggaaaaatgctgcaatttattaacagatttattttcactaaataatccaaattccataaatgattgaagaggataatatgtgggcaaacagaattgcagattttcaggccgctccagcggatggcataagaggtccacacgaccgacggaaggcaaaatacatacggcaagacaacaacctgcaagctttagtcgctaattttgaccagcgtgatccgcttgaataccttcgcgcatgtgcctaccacttacacttttaaaaaattaagaaaatcattcaaaaatatatcacaatttaaactatgtaattattttaacaaaggtattccaaatatttgtgcgataa

SEQ ID NO: 65002 - DNA, 386 bp, Heterodera glycines
  Genomic contig location: Contig_ID=SeqID_7497; Location=1302..1687; Strand=-
  SCN-specific regions: Sequence locations=1-218,241-259,281-386
gaaaaggttataggacatttgcggtccggacatttgcggtccggacatttgcggcctgctggaaatcggacatttgcggcccgacaaatgcggtcggacttttgcggtccggacatttgcggcccgtttctttagggccattttcggacatttgcggccggacatttgcggcccaagggaaaatcggacatttgcggccaacgaaacgccaaattgtcattcctttttcaaattaattataccaaatatttttatttaacacatttcaccaattattttgttcaatgacttataataattttcaactaatttttcgaaatatttttaactttttttcacaatttgattatttaatttaaaagagcttgctgaaggctccaaccagc

SEQ ID NO: 65003 - DNA, 105 bp, Heterodera glycines
  Genomic contig location: Contig_ID=SeqID_7497; Location=2142..2246; Strand=-
  SCN-specific regions: Sequence locations=1-57,79-105
ccacctcttcttggtgttttcgtttggcatagttgtaattccaacgcatatttgatggtgaaggagcagaagctgccctaacttcaattggcaaatcggcacgca

SEQ ID NO: 65004 - DNA, 56 bp, Heterodera glycines
  Genomic contig location: Contig_ID=SeqID_7497; Location=2948..3003; Strand=-
  SCN-specific regions: Sequence locations=1-56
tgaaaatctgcaattctgtttgcccacatattatcctcttcaatcatttatggaat

SEQ ID NO: 65005 - DNA, 603 bp, Heterodera glycines
  Genomic contig location: Contig_ID=SeqID_35462; Location=151..753; Strand=+
  SCN-specific regions: Sequence locations=1-374,397-539,561-563,586-603
atgagcgtggcacgcgagtgtggcataattcggcccaacaaacgctcatttttgctggaagccaccaaggcgcacgatggccaaacccatttgacgctaaagcagtcggtgtcctcctccgaggaagtggtgcgttgtggaataaaacttggatacagttactagtgctgttcgagaccgaaaatttcccgagaccggttccgagacttgaccccgagactagatatcgagaccgagacccaaaaaacccgagacttttctcgagtcgagaccgagagtctcgaacagcactaacagctaccctccgtcgccccccccaaaaaaagttgttttgacaattttctctgggaagcgtttttttttgccacaaaatttaagtatgattattatatattacagcttgaattcgatgagaatgtgtccttctacgatgccgaacagggcaccggaggaggcgtcagcggaagcggtgttggcaaactgttcaacaataataatggggacggaagaattgccgagtccacgtatcatgtggcggtgtccgggccaacactgagtgcgtttggtggtggtggtggtggtggtaatgttcaaaagcaataa

SEQ ID NO: 65006 - DNA, 757 bp, Heterodera glycines
  Genomic contig location: Contig_ID=SeqID_35464; Location=254..1010; Strand=-
  SCN-specific regions: Sequence locations=1-78,100-313,336-503,525-757
atgccgcagaatatgcctgaggcaaacattgatagagaattggcaccgctgcagcgaactggagaaacagcgcacccccaaagaaatcagaaaaattttgaaccaggagacttaatatggtacaaagaacacactggaaaatgggttgcggggatacttttacagccaatgggcgaaagaatgtgggagattcaaattgagggcagtacagtgaccagaagtgcgcatgtggaccaaataaaaggaagaagagttggtccagtgcgtcacaattgaggcagcgcatagaccctgtacatatccctttcgtcccataaataaaataaaataaaaatgatggaaaaaaattttcagtttttttttttttacaatttgatgataattgtccctcacactttatttaaataattcgacacttgactatgattgtgcattttcagaattaaattcaatcactaaaatgtcttctgggaaaaattctccttcaaatgaattggaacgtctcgaaaaagaagcgcttttgtcaaaaaaatcaaaatcgcgtgacgaaaaagttgcgaaagaagtgcgcgagttggtcgaacaactccaaagcaaaacggagaaggagatgcgcgaaacagctgaccagctaaagggcagcattaaattggaaatggcggccgctgtggacggactgtggaaaaaaattgagccttggctcagcggtcaggtcggatagtggggaaaaaaaagaaagagaataatggaaaataaa

SEQ ID NO: 65007 - DNA, 59 bp, Heterodera glycines; identical to SEQ ID NO: 52421
  Genomic contig location: Contig_ID=SeqID_35465; Location=39..97; Strand=-
  SCN-specific regions: Sequence locations=1-59

SEQ ID NO: 65008 - DNA, 59 bp, Heterodera glycines; identical to SEQ ID NO: 52421
  Genomic contig location: Contig_ID=SeqID_35465; Location=169..227; Strand=-
  SCN-specific regions: Sequence locations=1-59

SEQ ID NO: 65009 - DNA, 59 bp, Heterodera glycines; identical to SEQ ID NO: 61858
  Genomic contig location: Contig_ID=SeqID_35465; Location=299..357; Strand=-
  SCN-specific regions: Sequence locations=1-59

SEQ ID NO: 65010 - DNA, 59 bp, Heterodera glycines; identical to SEQ ID NO: 52422
  Genomic contig location: Contig_ID=SeqID_35465; Location=429..487; Strand=-
  SCN-specific regions: Sequence locations=1-59

SEQ ID NO: 65011 - DNA, 59 bp, Heterodera glycines; identical to SEQ ID NO: 52422
  Genomic contig location: Contig_ID=SeqID_35465; Location=559..617; Strand=-
  SCN-specific regions: Sequence locations=1-59

SEQ ID NO: 65012 - DNA, 59 bp, Heterodera glycines; identical to SEQ ID NO: 52421
  Genomic contig location: Contig_ID=SeqID_35465; Location=689..747; Strand=-
  SCN-specific regions: Sequence locations=1-59

SEQ ID NO: 65013 - DNA, 59 bp, Heterodera glycines
  misc_feature (48)..(48): n is a, c, g, or t
  Genomic contig location: Contig_ID=SeqID_35465; Location=819..877; Strand=-
  SCN-specific regions: Sequence locations=1-59
aacatttgccttctctagtctggctctaccaaacactcacacgatatntgaaatgctaa

SEQ ID NO: 65014 - DNA, 363 bp, Heterodera glycines
  Genomic contig location: Contig_ID=SeqID_35470; Location=1..363; Strand=+
  SCN-specific regions: Sequence locations=1-86,116-250,280-363
gctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaatccaaacatttaaaaatctataaaaaatttaaaaatgagaattcatgcgagattttctggaaataagcttaatagggcctagttaagctgtaaaaaaaatttggggcgatttgaaagaga

SEQ ID NO: 65015 - DNA, 377 bp, Heterodera glycines
  Genomic contig location: Contig_ID=SeqID_35470; Location=421..797; Strand=+
  SCN-specific regions: Sequence locations=1-1,23-159,189-324,354-377
aaaatctataaaaaatttaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctgg

SEQ ID NO: 65016 - DNA, 542 bp, Heterodera glycines
  Genomic contig location: Contig_ID=SeqID_35471; Location=558..1099; Strand=-
  SCN-specific regions: Sequence locations=1-512
aggtacaacagcgattagaagaggtaaaacagtgattagaagaggtacaacattggtcagaagtggtaaaacagtgattagaagaggtaaaacagtgattagaagaggttcaacattggtcagaagtggtacaacagcgattagaagaggtacaacagagattagaagaggtacaacagagattagaagaggtacaacagagattagaagaggtacaacagcgattagaagtggtaaaacagtgattagaagaggttcaacattggtcagaagtggtacaacagagattagaagaggtacaacagagattagaagaggtacaacagcgattagaagtggtaaaacaatgattagaagaggtacaacattggtcagaagtgtacaacagtgattagaagaggtacaacagcgattagaagagtgattagaagaggtacaacagcgattagaagaggtacaactgtgattaaaagagagaggtacaacaaatggcagaagaggtacaaaaatgcattaataatttttaaaaattgtaaaataaa

SEQ ID NO: 65017 - DNA, 2261 bp, Heterodera glycines
  Genomic contig location: Contig_ID=SeqID_7498; Location=687..2947; Strand=-
  SCN-specific regions: Sequence locations=1-1257,1280-1373,1402 -1573,1597-1634,1656-1818,1840-2261
atgggatgggatcaatcgggcttctggttttttggtgttcgatacttctgtgtcagctgtgaagtgacgtacgatcgacctgaaagacacagaatggagtataaggaacgctgcaaaaaatgttgtcggatggggttcgggtttccatgtacggatgtctgcgatgagattcactgcggcgaatgcaatctcaagttttacaacccggaatgttttgaagcgcacaagaaggcggcttgtattgagtacaaaaaatgcgaaaagtgccgagagacacacaatactcggaacaaacacacgtgcggggaaaagttttgcaaactgtgcaaagtttgtcacccagggcggcaatgtttcatcaaaaaaattcaagtgcgaccgcagaaagcctacagaattgtggcatacgacctggagacgactgtagatgggggagaacaccggcctaatcttgttagtgttgcacgtacttgtaacatttgtgcgggagaggagcgggaatgtgagatttgcgaaggccccagtaaaatcacatggtcagtagcggatggttttgagccaatgagcgagtttatcgtttggataatgggttttcaacgatttgaaacgattgctttcgcgcattatgctgggaggttcgattcacactttgtcttgtccgagctaacaaagaaggaaattgcgacggagttgatgatggctgatttgaaaatttatcaaataaaggcgggaagagtgtactttcgggatttttggatgcttagtcagaataaattggcggaccttccaaaaaccttggggttaaaaactgcagctaaattgtattttccacacaaatacaataagaatgagaattttgggaaggaagaagccgtaaaattggaagcatggcacaatgagaattttcaaacggaattcgaactaggtagggaaaatagcattttttctttgaaaataaaatttaaggggaacaactcaagacgtattgcgaaaacgatgttgaaattttgatggaatcaattttgaagttccggcggttattttggggataacaggagtaattgatgctctcccccctccaaaaacacatcggctttggatgaataaaggacagtgtcacaattgcgggagtcgttatgaagatcttcagggcaaaatttttgaaggacaggcatattccaattatgccagagggagggtatgagagagcagagaaccagagcaaaatagcggtgaaatattttgagtggcttgcccaaagaaaaggagtaaaagtgcggcatgcgtgtaacggaggagaagtggaatttggtgggctgaaagtggactgtgtgataggggcagagaaaaaaataattgagtttcaggttaagaaaaattatattttatcaatattttaatgttattcattcaggggtgtgcatttcacgggtgtccgagatgttttttaccttggactatagcgccaaacggacggacaatggaagagaatcaaagtagaaccgaaattcgcatggaaattttgagggaaaagtgcaaaaatttttcatcggagaagtttgggtagaataaaacatttagaaatatttattaattgtttgttttaggagtgtgatgtcagagaggaattgaagaaaaataaggagatgaaaaagttctttgaaagtgtgccggacaagggaccgataaatccgagggatgcttatgccgggggaagaacgatgccattttgtttgtacgcaaaggctaccgaagaaattgagatatcaatgtttgacatcattagtttgtacccctttgttaattatggtaaaaatctgcttaatttttgttagtttcctttcgcttaagacaccccataccccgttggagtcccgaaaattgtagtgagcaggaattttaatgtgaattggacaacacccgacgacataccctatgatggacttttgaaagtaaaagtgatcccaccgaaaaatcttttgtaccccctgctccccctgcacatcgatgacatgctcctcttccccaattgttgggcttgtgcaaaaagggccaagaatgagtttgtgatgacaaaagatgtaaagaaatgtaaccatcgtccagcgcagagagcatttttggggacattcacctcaattgagttgcggaaggctttagagctaggatatagaattgtgggattctatcgagcgtatcactttgaacaatttgacagtcaactgttcaaaggatatgtgcggatgtttttgaagataaag

SEQ ID NO: 65018 - DNA, 51 bp, Heterodera glycines
  Genomic contig location: Contig_ID=SeqID_35472; Location=884..934; Strand=+
  SCN-specific regions: Sequence locations=1-51
atggggcatcagcacgcggagtgcattgacaagctcggagtagtagccaga

SEQ ID NO: 65019 - DNA, 205 bp, Heterodera glycines
  Genomic contig location: Contig_ID=SeqID_35475; Location=769..973; Strand=+
  SCN-specific regions: Sequence locations=1-41,63-69,178-205
atggctaaaacttcagctcttcttttaattttgcttttgtgttagtgttttatgtatttttattgttagaattaaagtaaaataaaagaaaattattagaaaagaatagaaataatttaactcaaaaaaagataaataaaatttaaataaataaaaataaatttaagatgaaagaaattgcttgagaagaagtttttaaatttaa

SEQ ID NO: 65020 - DNA, 577 bp, Heterodera glycines
  Genomic contig location: Contig_ID=SeqID_35480; Location=82..658; Strand=-
  SCN-specific regions: Sequence locations=1-247,269-351,378-432,454-577
aacactctgaacattgagccggaaaaacggatgactgctcgtggaattgtggattatttgaacaaaaaatgcattcccgggacctcaaaacaaattgacaatgttccgtcgcttccattctttcacaaagtcaccgttggaattctgaggagaacatttgaaagtgaaaggaatttaaaaacaatttaaattgaaatttaattaagagagaaaagatcaaaaaatgttgggtttgcttggcattgttgaggagaagcagagaaaagcaatggatgagctcagaatgcggggcattacatgtgaaaccaaaaacattttgttgggcgaagaagcaaatgaattttcggttggatttttaaaataattattaaaaatatgcattttaggaaaatgatgaatttgcaaaaagcgcagaaaacgaatcggggcaaaatgaagaagaaaatgaatcaaagagcaaattcaaacgaatgttttcacttaaatcaaaagaaaagccgaaaaacgatttttgggcaattgcaaagacaaaatacagcaaattgagcaaaaattcccgagaagaaggcgacaagcc

SEQ ID NO: 65021 - DNA, 4682 bp, Heterodera glycines
  Genomic contig location: Contig_ID=SeqID_7501; Location=1..4682; Strand=-
  SCN-specific regions: Sequence locations=1-71,93-134,156-210,232 -331,353-680,713-864,886-997,1020-2188,2210-3455,3477-3559,3581 -4074,4139-4167,4189-4205,4233-4682
  Gene Ontology: Mol. function=serine protease inhibitor activity; Cellular component=basement membrane
ctgacgaagttgatgagtggcatttgaagagaccgacattcacaggtggggggggagggggggaagacgaagggggtcttgcccgggggcatcggtctcgaatctcaaatttggagtcgcgatacagaacagtcaatgacttttcattttccccaaaggtggtggccgagttggcgacctgtgtactcaaaacaccgactgtcaggtggcgttttctccgtttttcccctctccatccatttggggttggcctgtccagtccggcatgttctgctccgttggccaatgcatttgcctgtccaattacgtgcctatctcctccttttgttggccaagtctttcccccttctttggccatcattttgactttgttttccgtttgaagaagttaaccccggggacagcggctgtgttggcgatgtccaatgcgaatccgtgtggcccggcgcgcgttgtgccaagggtgggctgtgccaatgccccgattattacgtgccggcaaagacgcgggacggcacaatgtgtgttgcagtaagaagcacagcagaggaagaacacattaaaactggttttacaaatataagagcagcgttccaccggcttgtcctttgcccgagccgaataacgcaggtaaagccgaaaagcctaagaaccgaaagactcactcggccgaactttgtcctatccctccccccccccctctctctctccccggccacagaagcgccgtcccccgtcactttgttggccaatccatcgacacacccattggcccccggttcgtatatgcctgtcctttgtaccagcagttcggccgagacggacgactcaaatggaggcgacgggtcgacttggtaagaaacggggggagaaggggatactgaaccaagcagtgcaacagatattaatctgcttgctgccaaggcaagaatcaaatttctttaaatgaatcgtcccgaattgaatcgacgattcccagagggaaaagggcgttgggaatggattgaatggaatggaatttgctaaccaactgtcaaaaggtactgttttctgactgattttgccattccaaggtgtatttacccggatggtgaacgcgatgtgcccattgtggatttgtacaattgcgtgccccacccgcaagttcggcccgaatatttccccgaatacgcaccgactgtcgacggaatttgttgtcatagccgaggcattgccatcaattaaaattgatgtttttgatttgaagctctctaaatagcatttgtgtgcatccaaccgatggaacagggagaagagccatccgtcccacggtggtggtgaggcaaaggcaaaaggggacactttgaggcccttattagcgacggaattcgaaatgatcgtagccatttgaattgatcggcccacccattcgcttttttagccattggcgttgaatcaatcccatcgcttcttctgtaatttgtgctcaggtacaactccgtaaccggtacttgcacacaattcctttgggtaagcacagttaagtcaaaaagcccaaaaaagtctgaaggatccggcacaatcggacggagtttcaccgaataattttcggacgatggagcattgcgagtcattttgcagggacagtaagtggttttgccaatttgttccgctccgtctcgacctgctgtccgttcgttagtccgtctttagcgtgtcggcgtggccccgctcagttccgtcgctctctccgcgcttcgctctccgacgatttccccgtcgccaattgcgtgcggcaaagcggaagttgtgcccccgaaaacacttgcgtgcaaatcggctctctgcagcagtgttgccccaccgtcggtccgttttcgttttctgttcgtctgtcaatgcgtccgtccctttctcagcccatttgtgcagtgccgcgggtgggcgcactttccccttcggggcattgcccacgagcggtggtgccgacgcgttgttcgaccctggcattcaaattgccggaagcgcaccgaccagtcgcttttattacgacgcggagcagggaaggtgagcggaaggaggaaggagaagcagtccaaaattggaaatggttgtgttttgaggtgctccaatttcatttacgagggcggactcggcaatttcaacaacttcgtcaccaagcaggactgcgaacacttctgctccaagcgtgggcgctcctttctttggctttccctcagttcctttccatttcagtggtctgcgaattgggccaaccgttgcgcgtggccgagggccaatggcaaaggtgcgaattgggtaagtaagaggcggggggggggaagggtgtcgtttggccatttgaattggcgccttttccttccgccagctgccgactgtcccaacacgcacagctgcgactcggcccacagagtgtgctgccctaccgcgcgttcgcacgatcacttttcaatttttggtcgaactcttttcattagaaacgatttgcacacagccgaagagagtgggcgaatgcacgggaagtgtcagccgatattggtacaatgcggtgagcaattagcatttattttaatttgggtgctagtgccattttaatgacgttttgcctcaggggactcgccaatgcgaattgttcgacttcaccggctgtcagggcaacgacaacaattttgagcagttgattgagtgccaaatgaaatgccgcaatatcgcctgtctgttcccctgctgtgccatttcgggccaattttgccaattcagcggaaccgcgctgtccccaggggcgtgcccaccgcgacctttccggtcttttcacgcgctgttcattggccgaaggctgtccgctgaaccacgagtgtcacttcgacggacaaatcttcggctgctgtcccctccgggcttggacttgttccttaggctccgaccgcggcacccaatgcggcgccggccgttccttccgcttcttcttcaacgcggaaaagcaaagctgcgagtcgttccaatacgaagggtgcgatgggaatgccaacaatttccaatcgttggacatttgccaggaatattgcggaattgggggtgagtgagtggacggcacggcattgttcgtttcgtccttttaaggctgtcctaacggcggtcagccgttgcgcgaccagaccagcaatcagtttctgagctgtgccgactcgcagccatgcccaagccgcgactcgcgcgagtgcgtgccgatcaacgcaaacggagtgatcgcacatcgctgctgtcccaccaaaggtcgattggcattctctgcttgtaaatccgctgcatgtgccattccgccccttttttcagctttcatttgttcgctgccccctcaagtgggcaccgtttgtcgcaaggcgtcgttgacgcgatggtattttaacattgtgacgcgcgagtgcggcgagttcggcttcggtgggtgcaacggcaacatgaacaacttcgaaagtcgcgagcagtgcaccaaattctgttcttcggcaggtgttttcctacaaattcgaatttgcctttccgttttaattttgctcatttttcctctctttgccttaatgcggctctttccaatatcttttgccctcatttttcagcttgtgccccgggtgaaattgtctatcgccgggagggaaacggcgacggaaggagcggcgacgggtgccaatgggccctttttccaccatttacccccccccccccctcccattgtttctttgtcagtgctttttcctccattttccaatgcgattccaatgccgcccaattgcgctgcccgcgcgactttctttgcgttcgcgacgaattgggccatcgccacgtgtgctgcgggtcgccatcttcggccgtttgtgccgagggcgaaaagcctttttgggaagcggcggacgaaacggtaaaagggggaaaagaaagcgaagagaaagcgcacaacttccgccggactgccctttgttctttttgaaggtccgagaatgccaagcgaatgtcgccggctcgtgcccttccaatttcctttgccgtttttccgcagcccataacaagtcaattattattgatttgtccgattgatcaattaattgatctattagctcatcgattgattgataatttgattagtcatttgtcactttcgtttttctctccctttttaggtatttttgttgcgctccgcggaatggaagtaatttatcactttcattttatctttctaaatttaaatgtcaattctcattctgtcagccgtttgtccctttggccattctctctatcgtacccccaaatccctccgacctttgcgttgctttgtcggcacgagtgaaataacgccgttggggcaatgccccgacggattttcgtgtcaatcgcgcgtctcttccgactctcaaggccattgttgctccgtcgaacgtaaatttttcgaaatttcaatggtgaattcatcccaacgtttagcgatttgtcgcgggggctctccatttttagtcgaagagctcacccaaatgccgaagaattgtgtgcccggggcattcgccgagtgtccgcgcgaatttcagtgcgaaaaaagtcacgcaaacgcaatacaaagcataggaatttgctgtagaaggagtcggagaaaagagaacgacgagaaaactacggcgggtaagcggaaaatt

SEQ ID NO: 65022 - DNA, 2568 bp, Heterodera glycines
  misc_feature (86)..(86): n is a, c, g, or t
  Genomic contig location: Contig_ID=SeqID_7502; Location=1..2568; Strand=-
  SCN-specific regions: Sequence locations=1-250,273-304,327-572,649 -760,782-1297,1320-2006,2028-2114,2136-2568
  Gene Ontology: Mol. function=intracellular cyclic nucleotide activated cation channel activity; Cellular component=integral to membrane; Biological process=thermosensory behavior
ttttgtggctcactttggacctttgcatgggattcggtgtacctggttgacatgttcgtccggtcgagaacaggtaagcaaataancaccttccgatgttttggcaatggacgcacaaaaataacgggcgaatttcggatcggaaattctaaaggggggggggggagggccaaaagaccgcttttttgcggtcggtcactcgtcgcaccatttggcagcatcgggcagagatttttctgagtcaacccattatcattatcaaaatcactttgtgccattcaggttatttggagcagggtctgttggtgcgcgacgcgcgcaaaatccgctcgctttacctccgcagccgccacttcgtcgtcgacagcgcttctctttttccgcttgactttctcgttttttttgtgtggcgtcctctgcccattttgcggctcaaccgtttgctgcgaaaagaacgcattcagcgctttatggaacagacggagacgcgcacggcacggccaaacgcgttcagagtcggcgtggtggtgtggtacattgcggtgatcatccattggaacgcttggcgagtcgggggggggggggagacgcggggaaaaggcggcggaaaggtggggggagacacgggggagaggcgggggcgggaggaattgaccaagggaagggaaacaaaacgggacggacactaacgaacatttattcagcttttacttcatgatctccgagaacatcggcctgggctctgacccgtgggtgtacggcaaaaacaacaaacaaagcatgccggacggcatcaatgacacgctgacccgacggtacatctacaggtgagcagaaaaggagggcattgccattcggagtgttcagcttctactggtccacgctgatcctcaccacaatcggtacggcactggcaaaggtcagtcaacctccgatctgatctctgtctgtcccgttccaaggcgaagtgcccgggccccagcagaacatcgaatttgccttcgtcaccatcgatttgatgtgcggtgttttgatcttcgccaccatcgtcggaaatgtcggaaggtcagccgacctcgcaaatcacttgccgacggaccttcgtccgaactgatcacttccccttcagcatgatcgccaatatcagtgccgatcggaccgagttccaaaaccgaatcgacaacatcaagcagtacatggacttacgcggggttggcaaacaggtgaaagagtgccaaagaaagaaagaaaagcaaatggaagaccaaaaattggaaaaataatggaaatttatgcaaaaaggaatgacatttttgataatgaaatgatggacattccgaaaattaagttggaagtgcgagtgatcaaatggttcgattatttgtgggccaataagcagggactgaccgacgcgcaagtgctcaaagtgttgccggacaaactgcaggccgaaatcgcaatgcacgtccatttcgagacgctgcgcaaagtccgcattttccaggcgagaaaaaagcgggggaagaaaactgtgggaggggagagaatggttaaaagggcagaaaatttcaattttactaaactaacacattaaatttttaattaggcgctaatcggaaaattaaaaaacattggcgacagttgctttggcaattaatgacaccaattagctaataaatcacaacattttcaaaatgtccatcggcggtatatgctttatattttacacatagcaaagtctctaaaataaacttataatcgctgatttgtaattttaatcactcctaatttcctaattaggattgtgaggctggtctcctcgccgaattggtgctgaagttgcaatggcaagtgttctctcccggcgactacgtttgccgaaagggagacatcggtcgtgaaatgtacattgtgaagcggggaatgctgcaggcaattaattgaccgatcagtcgcactcgaaagcactgatcgatcggccgtttgtcaatcgcttatttgccgcaggtggtggcggacgacggcgccaaagtgttcgccactctgtcggagggtgccgtcttcggtgaattaagcattttgaacatcgcgggcagcaaaaatggcaaccgacggactgcgaatgtgagatcagttggctacactgatctgtttgtgttgaacaaaaatgacctttggaccggtaatatttgaagggaccgttaactcaacaaatgaaattgactcattaagcgttgcgcgaataccccgaggcacgaaaaattatgataggaaaggtaggcaaatcaattagccactcctccgagggcttttggcaaacgaaggcgatggacaattagagaaaaccaatcgctttttctgaagggccgcgaattattacgcaaagacaatttgctggacgaaaatgcgccggaagagcgaaaaacggcggaggaacgaatcgaggagctgcgagcgtccgtacgtgtgctgcaaacgcgaatcgcacgacttgtcgcggagcacacgaacacggaaacgaaagtggggggaggcatttcggaatggaaaaactgctgaacaaatacg

SEQ ID NO: 65023 - DNA, 751 bp, Heterodera glycines
  Genomic contig location: Contig_ID=SeqID_35482; Location=1..751; Strand=-
  SCN-specific regions: Sequence locations=1-69,92-751
  Gene Ontology: Mol. function=isocitrate dehydrogenase (NAD+) activity; Cellular component=mitochondrial matrix; Biological process=carbohydrate metabolism
cctgtaagaaaattcgatgctaaaatttgaatgttttctcttcaggcaattgctgtgcctgaaattgctaaaaaattgaaatgcacattaattccaggcaaataaacaaaattcaccaacttccatctttattcccgcacaattttaggcgatggtgttggacctgagctagtttatgccgtccaagacattgtcaaggcgaccggaataccaattgagtttgaggaagtctttctcagcgaagtgtactactcgagatcggccagcattgtcagtgattgtttttggcagatcattaattaagaaaatattaattgataaaggaagatgtggtcgactcgattgcccggaacaattgtgtcgcattgaagggggccatccagtccagccttgacgacaaaacggatgggttgaacacgcagctgcgcaaacggctggacctgttcgccaatgttgtgcacatcaaagccctggaaggcatccgaacacggcacaacaaaatgttggactttgtcatcattcgcgagcaaacggagggcgaatattcgcgcatggagcacgaattggtgccaggtgagcaccaccaacaaaccatagagagcagagcctttttattgaaattgtggaaatttaaggtgtaattgagtgcttgaaaattatgacgcgagtaaagtgcgaaagggtggccaaatttgcatttgattatgcaactaaacatggccggaaaaaggtcaccgccgttcagtgagtg

SEQ ID NO: 65024 - DNA, 63 bp, Heterodera glycines
  Genomic contig location: Contig_ID=SeqID_35484; Location=541..603; Strand=+
  SCN-specific regions: Sequence locations=1-11,36-63
atggcattccgaggccccaaaaatttttggaaatcggaattccgtgccatccctggtctcatg

SEQ ID NO: 65025 - DNA, 181 bp, Heterodera glycines
  Genomic contig location: Contig_ID=SeqID_35484; Location=39..219; Strand=-
  SCN-specific regions: Sequence locations=1-46,72-93,115-181
ttctgctcaaacgattctcagaatgtatcttctcattctacaaaccaaattgaaattgaagcaaagaaaacggagcacggttctgctggtctctcaattctagaaattctacttttgtggctttctcgtttctctgttctcgaaatcgtactttgggcgcttgtccctgtcgttatttggt

SEQ ID NO: 65026 - DNA, 567 bp, Heterodera glycines
  Genomic contig location: Contig_ID=SeqID_35486; Location=53..619; Strand=+
  SCN-specific regions: Sequence locations=1-567
atgaccgtcacatccaacaccgaattccgactcatcgaatgtgtgccaatccttgaggaagttgctcgtgaatttggctgtattacgccactaccaaaccttgggtatgtttctttcgttttacaacactaactccagcatacagtagccatcgtgactatcgtgtaagcggatgtatgatgattcgcacgctgacatcgttgaatcgactctacattttcgatgctgaagactgtattgaggttaatgtaaaatatgtttcatattttattgctattttaggtgaagggtttcttaaggcaagaggacggtacgagccaaaaagtggtcaacgaatattatgaaaaatatgatggactaaatggatttgctgaatttattcggaattgggcctttacctttttctgtttccatgcctttgatgatgatgacacacctgatgaagactaatttcgttaatatttattctatgctctttgttacaaaccgataaacaaatccatcagggttatttgaacgattcaaaatttgcataatattttcgaaacccaatccgacggacataaa

SEQ ID NO: 65027 - DNA, 305 bp, Heterodera glycines
  Genomic contig location: Contig_ID=SeqID_35488; Location=143..447; Strand=+
  SCN-specific regions: Sequence locations=1-305
aaaattccctcaaagtataaacggtatattgcgcaccgccctccctatcatgctcgagatcatttgtatgtgtataaaatttatcaaaaaaagagatagccatttttctgggataacctttaaatataaaaatcctctgtgaaataaaatggcgattgcgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 65028 - DNA, 76 bp, Heterodera glycines
  Genomic contig location: Contig_ID=SeqID_35489; Location=819..894; Strand=+
  SCN-specific regions: Sequence locations=1-76
aattactggagttagcatcatagcagtgcttttccttgtctttttgatgccctcgcaaaatctgggtcgcttctga

SEQ ID NO: 65029 - DNA, 86 bp, Heterodera glycines
  Genomic contig location: Contig_ID=SeqID_35489; Location=1..86; Strand=+
  SCN-specific regions: Sequence locations=1-86
tttgatagaaaaagcatcagagagccttatttaactttaattaaaattggtgcgtttcagagcacgttctaaaaaatatttatgaa

SEQ ID NO: 65030 - DNA, 1674 bp, Heterodera glycines
  Genomic contig location: Contig_ID=SeqID_7503; Location=281..1954; Strand=-
  SCN-specific regions: Sequence locations=1-508,548-754,778-840,952 -1029,1051-1092,1114-1188,1224-1626
atgaaatttgcgaatttatttctgttgaaagtatttattttggcatttttcgacaattaccatttcgcaattggtgaacgtctttacaaagaacgtaagttgctaaaaaaaattcttagtaaaacctattttaataccaaaattaaaccctttttaaataattttcaaatttcaaaaaaaaaaacaattatccaaattttaattacatcatttgtttgtttatatttgtttaaattagggtttctgcccaatcgctataaaaattttcaacaaaaaaattagccataactttgctcaaaagcaactaacattttaatttttaatatcttttcgtaccccgaagagttttctgttagcctaaaaaaattcaaaaaatttatttaactttgaacaaagttatggccaaaagcaatcagggaccaggatttcaaacttttgaacctaaaaaaaattgaattttttgcaggttagtagaatacacttatttgttagggcttcaaattttctgtttaattttaatttgttaaattttttaataatttttttagcgccaacaacactttcgcgctatttaagaggccaaatttgggataacaatgatgcagtggattattatgacgtcgaagtgattggagatgatgtgcaattcccggtgcttgaaacaaggcttgactggaaggacgagaagcaattttggatgtatatgaagctgaaaaacaacacaccaatcgtaatgccaaaaatgggaattttgaattttaaatatattttaatttagctccaagtgaacatcaataaaatggtcactgggttgtcagttggattccgtgcaacaaaggcaaatattatttaataacacatacataaaatttgtttattgaaaaatattttttaatttaaaaataataataataataatggtaaacaatattttataaattaagttaattagtcatggaggtaccgtgtcgttactcaaaaaaccattaaaataaaaaatttttacagaaaataattcataacttcgcacaaaatgaatcaaattttataaatcttgatattattcggtagccctatgtgttttctattaatgatattaagaattaaaaatttggttgctttttaggcaaacttatatcaaaaaatattttattttgtcctaatcggggagtaaattgtcttaaatcgaaaaaaggttatagaaatattttttaaaccaaaaagccttagaaactcattttcaagacatttttattcagtttggagagtaacggtgagcttcgaaatttcctgcatcagatcaggcggctgaacccaattttataccctttcgaaaatccaaccctggatttttaaaattttcaaaatttttgaaatttttaggaaactgtgcatgccttcgttttagaggcgccaaatggcgaaaaagccattgatttcaccaaatattatgcctttgatttgactgagcagcaaatttttgtgttccccacattttctgccttacaagaagaattggagcgccggaaaaatatgccaacgcccgaacaaattttggcaacattacggcaggcattggccgatttggactcaagactgagcgaaaaattgaaaacggaaacagtgtaataaagaaaaattaataattatttagtataatttaatttaattaaa

SEQ ID NO: 65031 - DNA, 197 bp, Heterodera glycines
  Genomic contig location: Contig_ID=SeqID_7503; Location=2363..2559; Strand=+
  SCN-specific regions: Sequence locations=1-110,195-197
atgtttaaaatttcgagttttattttcgtgttgtgtttggttcgcttatgtgtgtccatggttagccaactttcttcaccaaaaaatgtggttaagccgcgctcgacaggttaaaaaatctaaaataaatttaaaaaatagaaattaatttattaaaaaaaaaatgaaaaaaataatatttttagaattaaattcaa

SEQ ID NO: 65032 - DNA, 2888 bp, Heterodera glycines
  Genomic contig location: Contig_ID=SeqID_7503; Location=2665..5552; Strand=+
  SCN-specific regions: Sequence locations=1-4,42-43,65-109,131-224,246- 254,313-797,898-985,1007-1397,1419-1440,1489-2085,2135-2425,2463 -2611,2646-2738,2761-2888
atggtaaaatttaaaaaaattatttaaaaattataattttagaggatttaaaatacccaaaaaaccggagaaattctcatatcgtaaaatcatccatttcgagaggctcattttgggatggcattaaaattcgttttaattacggcaatcaacttaaaataatgttggaaaacagcattgaatataagaacaaaagaaaatttttgtcacttcaaattgtcggcacaattgaagaacaatcagttagtttacagaatattaaaattaattaaaaaataattatttttatttttaaatttatacatataattagatttgcatgagatcaagaatttgggaaaagccgagatcgggatttttcgggatcataaaagtaaaacagaacaggttacaatatttaactcggaaattttgaaagtaaattttttttaatattttgtttgccgtattaatttttccaaaaaatttttggtagacggggcgaggcaggcaggccggcggtagcgatagggctttgccggagaaaattatgaaaatttatttcgaaccccatttggacaatcttaatttcaatttttcttttaatcttaactcttccagttttacacattctaccagtgcttatttttcccggttgcccaaccggcacccggaccggaagtaaacttaaaaaaccgtgatagcgacctgggaggatcggtaattcccaaatcgatcccggtcttggtcacgtgaaagcctacatataacggaacttttttttacgaaaatatataaaatcctattaagttatttgcatttaaaattcaattcaaaatataaaataattaaaattattaatacacttcaaaaaagaaaattattaaaatttcaaatttttaataattttttttaattgtagcctggccaaggctacaatgtgtcggcactccaagcagcggtagagaaggaagaagaaattttaatgggcccccaaattggtggatttgaacatattttaaaaattgctactgtaatgatggaagcaatcaaccagttaaatgccgcagcaattggaccggtaaaatttcaaaaaaaaattatgaattttttttctagtattccactggcgtcaggttttctgtagtttacgggaaatccggctaatctgaattgcgaattttctaacaaatttgcgcctaatcgcgtgacagatagataaatatattaatccatagcaattctcgagagtcttaatctaaagattggttattcaaagttatgcgtccggtgtgactagaacccacggcatttatgctgtgaaatgccctaaccgactgagctacggcgcccacctttagaggttcccccataccctaaatcccactttctcccacattctgcgtacttctggcaccacaaaaaatttataaaattttcaacaaaaaaaaattcccagcgaattttaaaaaaaaattaaaaattagaaatttttcaaattttatttttctacaagataccagaccgaataaaagtggaacagttgcgcttcattggcctcgtgcttgcccaccttgtgctccgtgatgacccaattgttgatccggagactggcgattatgtgttcattgcgcaaatggagccatgcattgatccgatggatccgcacgtgtggcgacaaatgcgcgaagagttggacatacaagtgagcgtaattttgaaattataatttaataggcacgataaaatttcaaattttatgatttttttgttgtatttttcttttgtccttaaatttttgaaaattttgttttcaattttttgaaaataatttctttttttctagccatttcttaaaaaataattttagaaactttttcataaaaatccttttttttaataaaatcgtccgttttggctcgtggcctggaaccaggcctggacttgaattttttgtttttgaaatcaaggttttccgtgccgaacctggacctgggtttcttttttactatttgacctgaatcttgattctggacaaaaatcctggaaaaccaggtctaaaaatgcatgcctgggtccaggtccagttcgaactctagtttttagtaattttctaataaaattcaaaataattttataataaattttttaaaaagttatcgatcttaaagattcgtgcccaattcgacgtgccagcaaattttggtcgagcaaaagcatgcggacggcattttggctcgagaaggaactcgtttgagcatttgaaccgcaaaattatgcgtggcattccgaagagcgcggaattggtcaaatggcgcgaattggcggaaaaatttcgactgatctcactgaatcaccacaaattgccacattttaatctcatttttcgtacattcatcgcttttggtgaagaggcacccaaacttattcttcttgtctgcgcaagtttttttaaacaaattttaaattaattaaaaatattacgaagttgagacaacaatatttcaaaattttgagttcatttcagtttgatttttcatctaagtatttatctaaagtggagactggtgacgcaaatcgggatcttgctggattctcgggatcccgcgggatttgctcgggaccggaatttggacaggatcaaaaggtccctccctccctctccatcgtttttccaaaatcatgggattgatcggaattttgccgggatcccgacatgggatccgtccaaccaagttgtcaggtatacgggatcccgaccttggggttcctctcgagccgttttccaaagtctttgggatgatcggaattcggtcgggtcccgactacggattcatttgaccccagttatccggtctttaatagaaagtttatcccaaattattgaaaaacgaaatatattcggtcaa

SEQ ID NO: 65033 - DNA, 494 bp, Heterodera glycines
  Genomic contig location: Contig_ID=SeqID_7503; Location=5564..6057; Strand=-
  SCN-specific regions: Sequence locations=1-93,130-131,165-280,304 -419,441-494
atgatttatttaaaaaaacggcggtacgaaaatggcggtacgaaaacggcggtacgataacgtcctggcccgctaatcttgaaggtggctcacatttttttgaatttaaattttttgaatttttatttacatttttgttttaaggtttgtattttagtaaaaattactatagtccccaatttttctttatctgatcacttttggagagttgtgatgatcaaaatttcaacaacatttttatcactatgcctttatccgagtaaaattagcatttagtctaaacatttttatcaacaaatttatgtgaatgtctaatgatctatctaatccctcaaaatccgaattgtttcgcgacagatttcagttgttttgacaagatttcgcttggcatgtgatgaatgaatgctaataagtctgcgtttgatcccttttttaaaaaattgtcaaattgatattcattgattgctccttccaataacacctaaaagaataaa

SEQ ID NO: 65034 - DNA, 199 bp, Heterodera glycines
  Genomic contig location: Contig_ID=SeqID_35492; Location=905..1103; Strand=+
  SCN-specific regions: Sequence locations=1-199
tttatgacatccaatttttcatcattttctacgcggattggatacgaatttgtggtcaaaggcattaatcgagagtggttcccacataaattgccaactgtattcatgcttttttcatttcgatggtcatcttttgcttatggacgacattcccatcccacccaaatagatcccggaccaagactcggaactcaactat

SEQ ID NO: 65035 - DNA, 92 bp, Heterodera glycines
  Genomic contig location: Contig_ID=SeqID_35492; Location=292..383; Strand=-
  SCN-specific regions: Sequence locations=1-38,60-92
ggattatttttcaaaacacctcgtagactgggggataattggagactgtgggattaatagagactgggctataattagagcatatacggtaa

SEQ ID NO: 65036 - DNA, 773 bp, Heterodera glycines
  Genomic contig location: Contig_ID=SeqID_35496; Location=92..864; Strand=+
  SCN-specific regions: Sequence locations=1-620,654-725,763-773
atggcccaaaggaacgaaaataatccaaaaaagaattttaattgtgagtaccctccgaagcaaagaaattaaccacaaattgcagttactgtggtgactgtgctggtgcatgaggtgccccacgagatcggcgactttgccattttggtccaagcgggcttttccaagtggaaagtgagtgccaaagccgaactatcgcttttccttccccaagcccatttgcttccctcttcccaggccatgctcatccaacttttaacagctttgggtgcccttgccggctgcgttctttctctttggcacgttgacgcggcagcgcttgcggaagcggccgaacaaagttgggcaattccattcactgccggcggtttcatatatattggaactgtacgtttatattaatccgcttaatatgctaattggctctttcctttgaggtgtcaatgatccccgatttgttggaaaaatcaactgtctgtcagagtgtgaaggaaatttgcgcacttcttctgggactagcaatgatgtacgccattgccttctttgaatgattgcttttccgtgggttgggtgtttttcacttttcatgttgtattcacgggaatgtttttttacttaaaaagcagtcaaaaaattatttggggttggggattcattaatgtattccatttgttaacaaattttgactgcctatgtaaaatttgttgccaattctttaatcattcattaatttatttttaaatgaaaattttataaattaatgcgtacaggta

SEQ ID NO: 65037 - DNA, 207 bp, Heterodera glycines
  Genomic contig location: Contig_ID=SeqID_35497; Location=425..631; Strand=+
  SCN-specific regions: Sequence locations=1-122,158-207
atggcggtggccattctgctgtttttgttgccagctgaaaatcccctcggggcatccgccggaagcaaaagcaacagcaaagagcaggacaacaccacaaattcgagcagttcacgggagggcgacaacaacagcaacaacaatgacgacaatagcatggctggaaaacggcttatggactggccaacaatgcagaaacaattcccg

SEQ ID NO: 65038 - DNA, 59 bp, Heterodera glycines
  Genomic contig location: Contig_ID=SeqID_35498; Location=931..989; Strand=+
  SCN-specific regions: Sequence locations=1-29,52-59
atgtctctgtggaccaacatttgtttaccattttgctgcctcccgaatccgcgcaacat

SEQ ID NO: 65039 - DNA, 487 bp, Heterodera glycines
  Genomic contig location: Contig_ID=SeqID_35499; Location=117..603; Strand=+
  SCN-specific regions: Sequence locations=1-6,29-76,140-173,224 -256,278-321,442-487
atgaacatatttaaaaaattattaaaaactcaaatatttaaacgtaaggaatttaaattaaattcaaaaacaacagtattaattatcaaaacaaaatcaaaaaattaaaattatattaaattatctttttgaataaaaactaaattctagtcaaaagaaaaataaaaccctccttttaaaatttttcaaaaaaaattttcaataaccaattaaaatttttaaacacatcacaagactcccaattcatcaagtttagaaaaaatataatatttttaaagtacacattgagaaaggcaactcaattttatttttaaattgtgcaaaaaaatacattacattaaaataaaataaaaatatatataataaataatagaaaacttaatgtagattatcaaaattaatttattgattattttttgtaagtaaaaaatatatattttagcaaatatcaatttattagaaatgcattaatatgctatatcaaaaa

SEQ ID NO: 65040 - DNA, 1075 bp, Heterodera glycines
  Genomic contig location: Contig_ID=SeqID_35500; Location=1..1075; Strand=-
  SCN-specific regions: Sequence locations=1-54,76-427,451-561,584 -611,633-728,760-789,821-1075
  Gene Ontology: Mol. function=transcription factor binding; Biological process=development
atgtcaatactcgaaaaaattcaagagatcgaaaatgagggtaattaatcaagatgcttctttttgttattatgtgaattcagatggcgaggacgcaaaggaataaggcgacgatggtaggcatagaattttacaaaattaagtcttgttcatataaaaaaaatgatcgctttttacacaaaaaaacgaatcaaatgaactttatttcgtctcaattaattaccattaataggagttgatgctaacaaactccaaattttggccaaactaaaaagttttagttttcttttcaaggtttttaaatttaaattttatcttgttaagcactaagaatttgataaattgaccaagttacatgtcatctacaacgaccaaaaattttgcttttttgatgtaaaaagtatgctaatttttttgaccaaactctatttaaattcatattttttaaacgatttaagaacaaatttaatgtctcattttaaagcttatcatcagatattacataattttgtttccattagcagcttttaaaaagaaaaaacaaaaaacgatcattttttatgataagacctaatattacaatctaatattactatacttggattaactggacaaaattaaaagaatattaatatttactgacaaaatactgattctcatgcgaatttgttttaagggtcaccttggcttactgaaagcacgattagccaaattacgacgagaattaatcagccccaaaggtttaaaattcaattcccagtaaattgtttaatttttattcctccgtttaggtggcgggggaggcggcggcggcgaagggttcgacgtggcgaagacaggcgacgcacgcattggatttgtcggtgagtttatttttatcaaaaaaaactaatttatcacaaaaacaattggtcaattacaatatacaaaacagcagttgaattgtttaaacaatgagtgagctgatccatccgccgtttgtcagtcattcaaaattatttttggcgttgcgttgttcctgatttttgacgagtcgtgccttccccccgccggtgattccaacagcctttcgtag

SEQ ID NO: 65041 - DNA, 1154 bp, Heterodera glycines
  Genomic contig location: Contig_ID=SeqID_7504; Location=2722..3875; Strand=-
  SCN-specific regions: Sequence locations=1-105,127-539,565-586,608 -1154
gcaaaggcgttggagtgcggatattctgtggacagattttatagagcgtggcattacgaagaagaggcggatgacttatttaaaggatacgtgcgattatttttgaagctgaaggaggaggcgagcggtttcccgaagggggttgagacggaggagcagaagaatatttggagagaggaatataaagaaaaatatggaatagatattgaattggcaaaagtgaagaagaatccgggattacgatacatcagcaaattgatgcttaatagtttatgggtaagaaacatttaaggaattgtagaagaattttaacttttaactttaggggaaattttcgatgagaaattgtttgaataagaatgcggtgattgatagggcgtcggaattttataaaattgcgtgtgatcataaagttgagatgtgtgatattgttgaatattcggatgaggcgattagagtgatctacagggacaaggaggactttgtgatggagcacaagtccagtaacattgttatcagtttatggtgagataaatgtcaataatttttaatatttaaaattttccaggacgacgagtatggcgcggttaaaattattggaatttatgagggaggccgagggaaatggcggggagattttgtacacagacacggacagtatttttgttaggcacgatagggacgtggagccgattacgacggggaaatttttgggagaaatgagtgaggaatacggtgggcatgagattgaagaatattgttgtggaggggcgaagcagtacgcattaaagatgaaaaacaagcagacgggggagacggaatacgttatgaaaattagggggattacattcgacgtggacaacaggaagactttgcattacgatacattcagggagatggttcttagttacgggaaaggggaggttgacccggcgttcttcgtgtacaagaatgattttgggtacgtttttcaaacatttgactcattaaaaaatcaatatttaggccaacgcgggattcaaaagtggtgacgagggagaagcacaaaatgtacaggccggtctgccagaaggggataatcgatgaagaacttaatgtgataccatttggattttgttaatttgtattttattgttttttttttgttaaataaa

SEQ ID NO: 65042 - DNA, 536 bp, Heterodera glycines
  Genomic contig location: Contig_ID=SeqID_7504; Location=797..1332; Strand=+
  SCN-specific regions: Sequence locations=1-360,383-536
agaggacacccccggttttgaattgattcgaaacggaacgaccagcatcaaggtgcaatttaatgagcctataaaggacggcgggtatgagatgatcgttctgggggaatttgattcgattttgtctattaatgctaatcgtgtgctcagtagcgacggaagcatatgatgaattcttacgagattgaaatatttctatccaaacatccgacaacccgaaaatattttatcggcgtttttgcttccgacaagatgccaaaattgaaggacaggcattttccgtactgttttgtggcgaataccgaccgggtgggcacgataggtgaacactgggtcgcctgttttgtaaattcgccgacagaaatagaatattttgattcattgggcgattatcccaacgaagatttaagttcatatcttaacctattcaaacgaattctcattaacgaccgcatcgtccaacatcaattctcagatgcatgtgggcaattttgcatttatttcttgacacaacgatgctatggaatcacttattg

SEQ ID NO: 65043 - DNA, 2609 bp, Heterodera glycines
  Genomic contig location: Contig_ID=SeqID_7505; Location=174..2782; Strand=-
  SCN-specific regions: Sequence locations=1-81,111-125,147-624,646 -653,860-860,956-977,1094-1323,1346-1615,1637-1867,1889-2211,2233-2609
atggctgcaaaacgcaatggaacctctcaacaaagcggaccgtcgactaaaaaatgggatttccgatcaatcgggtaagtcatttaaataaattattaaataatatattagagataagcaattcgatttttaatcatataatttttcagaaacaattttattgaagaaatggaaacttttaaattagtggattatcgttcgacgatttgcgaaaaatttggatttacgaagaatattgcggaatttgtgatcaacccggatgtggagcgccccgatgaagcgatgcaggatgcggtcgacacaatgatacaggtggcttttaaaaatacggaagaaaggatgatgaggaaagtacgaatgtttggtgtggccattacgggcgccgggcttgctttcccggtgtgggtgccgtacagggcgtacccgcagaacaatgcggaagttattatgcaggagattaataagctgggacagagcggggatggagaggagaataagaaaatgctgttgctgtctgagccaatcacgatgaaaataacgtgtgtgacaatgcccagtggagaggggccgaggaatgttcataaatttgactttgggttcaaggaacaccagcggataaggtaagtattttttaaataatttaacgaagtaggaaaaatgaatagaaaaacgaaaaaaaaaatatatatatttaaaataattatttttaaattaaatttaatgaagcaaaagcaaataaaataaataaataataaaaaaaaaatttaaaaaaaaaaaaaaggaataaaaataatatttgaatagaaaaaaaaaacaataaaataaatttaaaaataattatttttaaattaaatttaatgaagaaaaaaaataaataaataataaaaaaaagaaaataaaaataatatttgaatagaaaaacagaaaaaaaaaataataaaaaagaaaataaaaataatatttgaatagaaaaacagaaaaaaataataataaatttaaataattatttaaaataagcaaaaaaaaaaaattttttttttaatcaaaaaaaaaattaataattgaaataattaaaataattataataataatatttattaaggatttctaatggggataaattttgtttgttctacgcactggcttcgtcgatgaattatttggttatggataaatattcgtttattcgttttatgaagaatgttgtgcgacagaaagagacggcatatgaacttttacggaattgtgagattaatggaaatgaaatgaattatggagtggagcatttatcgagtgttcagaattattgggtgggtttaaatgaaaaaatgcaaaattaataaatttttcaggatgagatataccccggaaagtaccgggttgttgcatttgagaaatctgcggatccgcggaaatcaatccgtgttttgtggaagggccctatgggacgtgaaaatgtagtgccgatatttttggagaatggtcactgggatggtctgaagaattacgtctgcttttttaatcgtgggagaaaattctgtattgattgcgaatgtttttattcgcgggatgtttttcatacgttggagtgccgggcgagatgttattattgcaacagagttggaggggtgccctgccaaaaggagagtggagtgaagattgaatgcccgaagtgtcgacgttacttttacaactgggaatgctacaactatcatcaaggacatacttgcaaattatggaaacgttgtgtgatttgtgacaaaacttatcgatttaacccgaagaaggaccatgaatgtggagagacttattgccagctttgtagtgtgagccacgaccccaaacgtggatgttatattatgccgatcgaagaaaaagaagacaaggacgtgtacagaattgtcgtttgggtaagttttaataaaatcaacaaaataaaacctaactttcaggattcggagacttcgcaggacacggtttacaagggggaccagaaggagcatgtgattaattatatttcggtgagagtgacgtgtacggaatgctgtgacgacaaaaataggacgaattgcaaaatatgtggggaggagaggaccaaggattggagcgaggcggtgggacatgagccgacgaaggactttgtggaatggattttaactgcttttaccagttatgatacgtacatttttgcacacaacgccggacgatttgatggtaatgataaaatttaatccttactttttttaatcctaaaatttcaggacattttgtatttaattatctctgccgtaccgggaagaacccgataccgctcatcaacggactgaaaatttatgaatttaaagtgcagaattcgaggaaacattcaatgctgatatggagagactcatgcttattaatgccggtgaaactcgagtcgctgaaggcgaccttcaatttggactgtgaggacaaaccctttttcccctactactacaataagaaagaaaattatggaatacgattggaacatctaccaccgatggaggactattcgccgggatcgatgaataaggaaaaatatgcaaaattcgaaaaatggtaagaaaacatgaaaaaacaacaataaa

SEQ ID NO: 65044 - DNA, 801 bp, Heterodera glycines
  Genomic contig location: Contig_ID=SeqID_35502; Location=1..801; Strand=-
  SCN-specific regions: Sequence locations=1-192,216-358,380-801
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctcccccataaatctgggcgcatcggttcagggggact

SEQ ID NO: 65045 - DNA, 143 bp, Heterodera glycines
  Genomic contig location: Contig_ID=SeqID_35503; Location=927..1069; Strand=+
  SCN-specific regions: Sequence locations=1-143
ggcatgtactctccgccacatgttggccaacttcgattgcgtcgtgcagtcgcccaccggcacaggcaaaactttagcttttatgcttccaacgcagcaaattttggtgcaaaagaaactgaccggcgcaggagaaggggaaa

SEQ ID NO: 65046 - DNA, 347 bp, Heterodera glycines
  Genomic contig location: Contig_ID=SeqID_35504; Location=397..743; Strand=-
  SCN-specific regions: Sequence locations=1-1,24-160,190-320,345-347
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctattaaaaaa

SEQ ID NO: 65047 - DNA, 560 bp, Heterodera glycines
  Genomic contig location: Contig_ID=SeqID_35505; Location=1211..1770; Strand=-
  SCN-specific regions: Sequence locations=1-221,243-560
ggggggactgccccgaaaacaaaaaaatcgatttttcaagtgtccgttggggtactcaaacagttatggggagcaaaaatccaccgcagaattaaagtacaggctatagggaagctatccccgaaggattcggtctcgccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacaatta

SEQ ID NO: 65048 - DNA, 739 bp, Heterodera glycines
  Genomic contig location: Contig_ID=SeqID_35506; Location=368..1106; Strand=-
  SCN-specific regions: Sequence locations=1-170,192-739
caaaatgaagcgaatgattttttagttgccaacaaaatacgagtcgatgtcaatgatccgaaggaagaggaacaggtgacacgataaccgtgccaaaaagagattatggagtgcaattgaatattgtctcttatcaacagtgataaactggcgtcgatggcggaatataaaaaatttgtctcaaaattgccgagcattggcgaaaagcgtaaatcagtgggaaatttcacacgtttggtcggtctgcttcaacgacggctgattgacaaattttttactggcattcttcggtgcgaacagggtatgataccaggaatttattttgtcattctttcttaattattttgggaatagccgattgcttaccccctaattgttccattttaattataatttctaaatccctgaccagtaaaatcaataaaaaaacaattttatagacattttaaagaatgcccagcccgacaaagtgattcccttcattgaaaatgctatcattgagagaagggacaaagtgtcaattctccgtatgatcgctattcagtcaatgtacgcaaagggtttgaaaccggttgttctgcactcttactccaaactattggttcaggttctttcatgctgtttttcaaaaatcatttttttaattttgcagagctatggtttttcaatgcttaaatggcttttgaagttacaaatagcaggaataatacgtgacgacttttccgactcaaaaatcgag

SEQ ID NO: 65049 - DNA, 354 bp, Heterodera glycines
  Genomic contig location: Contig_ID=SeqID_35507; Location=970..1323; Strand=+
  SCN-specific regions: Sequence locations=1-354
atgttgccccacggctgtttcccattccgtgcctgtctcgactgtatccaagggccaagtctgacggccacacaaagttatgctcagctgagagaagaaatgcgcactgtgcgacttgatcgcaaccacatgggtgtgttgtgcaagggaccgggaattttaggcaaaatcggtaccagaaaagccgggatcggtgcatgaattttcaatcgggaatttttccgtaaaaaggggtgggtaccatattaaaagtattaacattttttcaagtttaaaaaattaaaaatgaccatttttattgttttcacttctttaaagctaaagcgaacaattaaatcataaatagacaattta

SEQ ID NO: 65050 - DNA, 415 bp, Heterodera glycines
  Genomic contig location: Contig_ID=SeqID_35508; Location=689..1103; Strand=+
  SCN-specific regions: Sequence locations=1-389,411-415
atgctttttctttttgttattgtcggacaacttctgctggccagtgaaatggttgtgcatggtatgtcattatttaattcaaatttcattacaaaatacaggaggccattacggtggttacagtttcgagcaaccaagcattgagcgtgccgaaactgatcaaattgacagcgacaaagacaccatcagcgacgaagcacttatcaatggctccaccacttccacctttggctcatcatcatcaccggcactcattcgtcgtgttgatcgatcggctgatactgatgactcatcagaacatttgcgatcaggtataaatcagggatgggccaaattgaaaaataaaaagcgaaatgcgaaaagccaaaatgtgcgaaaaggcgaaatgcgaaattttcaaaaattttaccaatag

SEQ ID NO: 65051 - DNA, 524 bp, Heterodera glycines
  Genomic contig location: Contig_ID=SeqID_35510; Location=102..625; Strand=-
  SCN-specific regions: Sequence locations=1-111,134-220,243-524
  Gene Ontology: Biological process=growth
gcgttctgtacaatgccacaatgtctttccgcgttggccaagccccaacggcggagacggcgtacaacactttggtacggtggatcatcgaccgtaacaacttccaagtgggccaaagtggccttttcatcaacccaatgccaagtccgttcggcccgtgctttatggtaagaggatgagtctgtcttctcttttttgcaacagtttccctttttagaacgattgccaccccaaaggcatttgcattgcgacggggcccaattcgtaccgctgcgaatgtgcgcatgggtaccgcgacatgtcggtggccaacccgggccacgactgtgtgccgttgtacggcatcaacgaatgcgaaaacacaacactcaacgaatgctctgagcacgcgcaatgctttgatttggtaattaaattgagatgatgcccactcatcattctcatgtcccttttcaaggagtatttgtaccgttgcgaatgcctccgcggcttcaaagacatttctccgaagggcgccgtcgcgg

SEQ ID NO: 65052 - DNA, 232 bp, Heterodera glycines
  Genomic contig location: Contig_ID=SeqID_35511; Location=126..357; Strand=+
  SCN-specific regions: Sequence locations=1-201,223-232
atgctcgccgttgtcgctgtaagtttcggagccaccgttacggtaaggaaacgatattaatgtattttaagaattttttttttttgaaaggtgacttcaatcattataacaatttgtctacagcgaagtcgaattcgaaaattaatggccgagaaaaatggaaaaatgacaatttacggagaataaaagagcaaagatgcgatttaattcataatatttgcatagataaaaa

SEQ ID NO: 65053 - DNA, 324 bp, Heterodera glycines
  Genomic contig location: Contig_ID=SeqID_7506; Location=244..567; Strand=+
  SCN-specific regions: Sequence locations=1-291,313-324
atggatctcagcaagcttgaaccctgtctcaaagaatattacttgaactgttacccgtacgatctcattttcaaatggctttcatattcgaatagtgagtgaatttggcatttagggcacttttatggtaatgctttttgtaagtaatacccccaaaagtgccggcatttattttcatctttcgtattgagtaaattttcagagaaccgtgactatttgtcgaagagggaatttgctttcatcctcgagaaagatgaacatctccgttttctttcctttgtcgaacccaaagaatttattgtaaaattatatcaacttcggtaa

SEQ ID NO: 65054 - DNA, 55 bp, Heterodera glycines
  Genomic contig location: Contig_ID=SeqID_7506; Location=37..91; Strand=+
  SCN-specific regions: Sequence locations=1-16,38-55
ctatttggtgttatgagcaattttgtctgacactggggcgtacccatagtgctgt

SEQ ID NO: 65055 - DNA, 2086 bp, Heterodera glycines
  Genomic contig location: Contig_ID=SeqID_7508; Location=1572..3657; Strand=+
  SCN-specific regions: Sequence locations=1-419,441-658,680-789,815 -1275,1298-1346,1368-1421,1445-1446,1475-1569,1592-1794,1817 -1819,1841-1947,1971-2086
atgtctgttccaaaaccgcgtcgattcacttattttgagcgtctcaagtccacctttaatgccgtccatgaccaggaaaccaaggtaatccaaattttctttttttaattactcatacaccggtcggtccattcgaattacgcccctttttttgatggacaattgcccgtctaaattcggagcttggtttacaaaaatgcatatttttacctgacaataagaaaaatacgataaatgcttattgtttgaaattatcgagacaaacacaattcttgtaattctgcaaaaacaatcacttgggttttcataagttttatttgataaaaaaagaactgcttacgaaaggaaaaccaatttttttttcaaattcgattcctcattttttgcacagtttctgtgcgacaaattgctctccttcttcgaaaactgttcctcaacaaatcccgccgcctcgtcggacattgtcgatttcactgacacatcgatggaaagtggcgttggcaaatttttgaaaaaccatgacgactttgtcaagcaaattttgggtcagtgatgaaatgtttttggggatttcaacttttttttgaaaatgggttaaattcaggcaaatatgtccatttctcggagagaggggagttcgacgtgttcggaattgaggagacaatgaaaaacaaaaatcgggtaagaaattacattaattcacacatttttggcccggttcaccgcccaaaactcgccaccaagacaaaacattggcaagcatatttctgctcctactgctgggtgttgttgattttgaaaattaattattcaaatttgttcaacattcgcaattttattaattttatatagtacaataaacattcctctccctccttacaattagcccaccggaatctcaaatttgtaaaaaattcaactaaatcgagtgcctcattcccctccaaaaacatatgggtaccacccacccatgcacccccacacccaaatttttgtaatttcccaattttgatttttgagatagtgttttatctttacattttcagcacaatgcaatggtgaaaacggttgaccaacactgttaccaagtgctgtgtttgtgcgcattgttctgtccggtggacatgcaaaagggcgtcatggacgcactgtttgcccatttgtgccgtatccaaccggacagagtgttccgccccgtggaccatgcactgtggacagcacttttgctgctgatcaacccggtgaagctgaagcagcaatgtaagcaattatggcgaaatatccatttttatggccaagacatgggtttagattcgaaaaaaaaattttaaatgaaatttggtaacaaattcaaaattttgggaaaacatattggcgggcgacggggagtgaacccgggtacattttattctctccgctcgacgtttaaaaaacgtttgaaattccaaaaaataaaacatttaaaatttttaaacaaatttcttgacttttaacaattccaaagaaagtttcttcgtttttggcttacaatattttatcatatttgtttatcggcatgaaattgggaccaaaaatttttaatttttccatttcggtgccctttgacctcttcccatggttagggactttgacagcacccaaaaattaaggcgacggttctgtcgaggtgttcaacaatttcatggcggtgttgcgccagccttccaaatgtgatgagccggacaatttttgtttgaagggcaccatttcacttgcgttgggtgtggcaataaaatatgcacgaaattcactcggtaaaaaaaaaaaatttttttttgcttttaaattttcctcaaatttttcaggccttggcatttcgcatgaacttgacgaaattgagttggtcaacgacggcatcaaaaacatggcatttgaatacatgcaggcgttcattgtgaaggcgccggcattttttgaattccctttttcaattgacgtggtcgactcgctgatcaaaaatttcatttgctatttccgcgacaaggtggacaatttgattgtacagtttaacaaatggtaccaaaatggggtcaatggcatttcgtag

SEQ ID NO: 65056 - DNA, 102 bp, Heterodera glycines
  Genomic contig location: Contig_ID=SeqID_35512; Location=331..432; Strand=-
  SCN-specific regions: Sequence locations=1-102
atggccaagctgatgctggcacccacccagctgtggtgcttgtacgtcgacgttgtcgtcctccaatttgacggcaacgcaatggacgcaatttcgttggcg

SEQ ID NO: 65057 - DNA, 443 bp, Heterodera glycines
  Genomic contig location: Contig_ID=SeqID_35514; Location=416..858; Strand=+
  SCN-specific regions: Sequence locations=1-284,313-320,343-443
atgcaatattttgttggcacccgctatcaacgaggtgccggtcttctgaagaatgtggcccgtttcctgatgccggttgcgtcaaatttgctaaagacggtgtcacgtgaaggacttacggccggcaatcgagtgcttgaagacatttcccagggcaaagcgctccgagagtcaattcaggcacatgcaaaacatggtatggagaacttggctgaaaaactgagacagtgtggaaagggtgccgccaagacaacaacaacactgacaaaaaacaaatcaagcgttaataataagaagaagaaatacccaagttcagtgatgacaaagggaaagagacatgtaattgaccaacttacatttgcaccttgagttgctctgacgaccaaaaaaaaaaatgtataaaagggataccaaaaggcgtgtgacgtgcatacacaggaaaa

SEQ ID NO: 65058 - DNA, 783 bp, Heterodera glycines
  misc_feature (78)..(78): n is a, c, g, or t
  Genomic contig location: Contig_ID=SeqID_35516; Location=51..833; Strand=-
  SCN-specific regions: Sequence locations=1-137,159-191,213-622,662-783
atgaccgtgccttcgtttccacctgcacccactttggaacttaatgcagcgttgaaagccggctataccgtcagaaancttttttatgtcctacaatacgaccaatggagcgacaacatcttcaagtcgtacgtgagcgaaatgatggctttgaagatccatgccactggcttcccgtcgtggtgcggcagcgaaggggaaaaagacgaatatatcgaggaatgccgacaactatttggaataaaactcgacaagcaaaagatgaaagctgagccggggaagcggtacattgccaaactttgcctcaactcactttggggccgcttctccatgaggaatctactttcgaaggcgctgataacagatgactgtgacaaactactacaattgaatgacaacaaaaaaatcgaagtttcgggcgtcgaggaaatggatgaagaaaatgaaacgtatttgatcagctacaaagagaaggaggaatttgtcgaggaaaatccatactccaatgtcgtcatttcactttttacaacatctgcagcacgactacatctctatggaattttaaagaaagttgcggatacacctaaatgcgaagttctatattttgatacggtaatttgacaatttaaaaaatatttaaattttatgaatttttattttaggacagcatcatctacgtgcatcctgaggacaatgacccactccctacaggaaagggacacctcggtgagctgacagacgaaaagccggaccatgacattttggagttcatcagcgcagggt

SEQ ID NO: 65059 - DNA, 128 bp, Heterodera glycines
  Genomic contig location: Contig_ID=SeqID_35517; Location=467..594; Strand=-
  SCN-specific regions: Sequence locations=1-64,108-128
gtcattaaaaatctgtcgaaaaataatccccccgtctccattaaaggccctgtctccaattatgtccccctttctgaggaggttgaaaaataatccccccggggccttaattagagcaaatacggtat

SEQ ID NO: 65060 - DNA, 327 bp, Heterodera glycines
  Genomic contig location: Contig_ID=SeqID_35518; Location=269..595; Strand=+
  SCN-specific regions: Sequence locations=1-327
atggacaaaaaagagaagacggagggcaaagcgacaaagaaaggacggctgcagaagaggcggacgacaccttatgacatttgggaggacgaaggtgcaaaaaaagggtggaatttggggattggcattattgacacttggacatttaacccaacgttaaagcatcctgataaatttagttcgttcgtttaggcgaacaaatcactgccaccactaaatgcaaacgcgtgaaatacgtgccgaatttgctcccggctgtggtgccacctcccgagggaatgtcttacaatccgccgattgacagttatttggtgaggaaataactga

SEQ ID NO: 65061 - DNA, 95 bp, Heterodera glycines
  Genomic contig location: Contig_ID=SeqID_962; Location=325..419; Strand=+
  SCN-specific regions: Sequence locations=1-95
ggattatttttcaaaacacctcgtagactgggggataattggagactgcgggattaatagagactgggctataattagagcatatacggtattat

SEQ ID NO: 65062 - DNA, 1855 bp, Heterodera glycines
  Genomic contig location: Contig_ID=SeqID_963; Location=296..2150; Strand=+
  SCN-specific regions: Sequence locations=1-34,56-353,377-657,679 -720,745-754,777-882,935-948,971-1052,1084-1161,1185-1246,1290 -1420,1442-1495,1517-1578,1600-1855
atgaatatgtcgtgtcactttacggtgccatcggggggcctttcctttgttggggtaagctttcactttatttgtccatcatttgcagtttgtgggtgttgtgttgtcaaggatttttgttccattcccttttccgaatgattcggtttcgattggtaaattaaaatggataatccccccgctccccatcggttcggttcgatctaatcgtcgtctcattttttacatacatttgtttactgaccgaaaagggttctctttcctctcattggtcattcccgatcagatcagccggaaaaaacttcatttttcaaacggtttattagctagggtccgtccgggtccgtttttacaaaaaaaaaaaatataaaattatctgcaaaattaactaggtcgttctagagaattagacagttttcattcatcagcaaaatcggcatttaagaaatggcaacgccttttaacaaccgcattttcaaagtgccatccaacagaataaattttctgttttcgagaagctatttctttctttctttttttgctaaatttgctagacagttttcggaacattttgatcgcaaacaaaaaagaattagtattttttaagccttactaatgtaacttcataatattggatagagaaaggcatttagactaaattaaaacaatattcattaaatcaaattaggggatacacaaggcaaagtgccaccaaatgtcttaaaataatttacaatttgctttgtcaaaaagtacataaaaacaatttgtttttcgtgtctttttattgtaaaatataatttccggacattttaactgattggcacattacgtcaaagtgtttcatggtgaaatttttgtactttaaattgttttcaacacaattaataatttaaaaaataaatttaattttcttttctttttcattataaatgaagtcttacattttcacactcagaagacaaatattttttaaatactctgaataaactttttcaatttttttaattgtaaaattgccaagaaaatatttattctgctttgttatttcgtaattttttttaatattttcaaattaattaagctaaatgttgtccatcctttcttttgtgtgttattccatttatgaactcgtctccatcccgttgtatctgcgctctgatcactaaaaaataattttcttcaccgttcttccaatttttgagcatcattggcattttggtaataatttcaatttatgggtcagataatttatttttttataaatttaattgtttttttaaataaatgtaaggaaattgcccattttgtggtcgatgttgtgttctatcggttgcccatttttgctcccacttgcccatggttcggcacgtcgcccttggcactttacaccattggcacatttttggtgtattttttcgaatatccaatttatgtgcttcatattgccatcacccttaatcgctgctcgtgcgtttgggccccaatccggcacaaagaagtaaaacaaacacataaacaatttacaccattacattttctcagttttggtgccgtgcttgtgagccgacaattgcgtttgcttttgctctttctttggcattttctgcccaccgtttggtcactattgcccagttggtccaactcgacaaaacggacccgtccaagggctcaattccgctcattgtcacctaccaactttattttgtatgttcaaatttttgcgaattcatttgaaatttttgtggcacttcgtatcgctctttgattttcttgggattttcagaaattgaacctaacttttttttaatcaaaaacaggaaaatcgcgttttctaatattttattgtaaaaaa

SEQ ID NO: 65063 - DNA, 588 bp, Heterodera glycines
  Genomic contig location: Contig_ID=SeqID_963; Location=2800..3387; Strand=-
  SCN-specific regions: Sequence locations=1-186,209-295,318-382,404 -559,581-588
atgaaaaacaatttcgatatttatccagcaactcctaaaaagcagcttaatgttcttatttcgacaaaatatataagaatatattaacaaaaaatgtgtaaaaatcatcaggaagagatttgcgttgtccatggcaatgttttggcacggagtgcacggcacatggccaacaacacccacgggtgactttcggtgccaatgatttccaccaggggctgctgcatgaacagaaagtagttgagctggccaacatcaaaaacattgtccagcaggccaaagtgcaagctgaggccaaaacataaatatttatacaaaccgtttttcaagcttttttataatcaaaaataatgaacaaatttataaaatgaaaatttatgtgagattgaaaatattccaataacacggaccacttagcaatgatttgctaattcgaccttattttagaaacacattgatttgacaatcttctgactaagaattccaaagaattgtaattgaaagaaaaagtgtatcatgtcaccaaatttgtgaagattaagcaataattagttgggatttttacataaaaatatgaaaaaggcgaataaa

SEQ ID NO: 65064 - DNA, 1134 bp, Heterodera glycines
  Genomic contig location: Contig_ID=SeqID_964; Location=1075..2208; Strand=-
  SCN-specific regions: Sequence locations=1-32,56-570,592-670,692 -910,933-1134
atgtcagttgaaaaagatgggtgtatgggtaatccaatattaaatatatacatccatcaatcacatttcagatgttttgacaagacggtgatcactttgttgaaggattggcagtcgtttttttctggcggagtttcgttggaacttttggacgtcggactggccggaatggtcgtttggcagctgtattccgaacgattgttgccactcattggaaaagacaaaatcttcgcatttatcaaaatcagttacaacggaattttgtgcttgcgccatctcaccggatttggacttggcgactttgtcaaccttcaaaagataagtctcagcattatgactgaagatgagcgtctcggcttcacctccgttggcgaaaacgaaatgaccgctagccaaagagtcgccgagtggcttcaaacgccgctttcaaatggtcagccgaaagtgctcatgaccgactttgcttatgaggtgtacaaagtccaggatttgcgtcgtctgctcaaagaggtggagcaataaaacgattttaatgtccttgtttctaagattattcctttttgtgggttggattcatagaaagaaaatggttgtccttttgtttgctgtccaaacttttgtgcaaggggttcagggagtcattccagagatggtcctttggtttcgacttgggcgggggaatacccccgggcgacaagttttttagcaaaaatttaacaaattttttttttgaaaagtttgggtgaggttggtcttggaggagcaggggtttttttccctccaaaaaggattttaatacagaaattttttggtttttcttagaaccttttctttcaaaaatagagatatgagaaaaccgtagcctaccttaacacatttgtaccttcagctgttcacgtccgcttcctctgctgccaaatactttttcattctgccaaaaatggcttcagactcgttgaatttggtgaacaacaacacgcaggaacgcatgatggaccgaatcatcaaagaaaagtgttggctcatcagagccccaattggtgacgaagtattcacgaacgaattggatgaaaaggagctgaccaaagtctgcgagaattcgatggctgccggtttttacgaaaaagacattgg

SEQ ID NO: 65065 - DNA, 702 bp, Heterodera glycines
  Genomic contig location: Contig_ID=SeqID_965; Location=56..757; Strand=-
  SCN-specific regions: Sequence locations=1-67,89-563,587-702
atgtgtatccctaatctttgcttgcttgtccatttcagtgttttctcaaaattgacaattactccgatcatttgtaaagaaatgactgaaattgtttgcaaaaaaattgtcattcgctggaccgaaaaggaagaatactcggcgattgtggctacaattgatgaaggcgtgacaacgcaattcgtatgtccagtctggccgcgatacaaattcattggtttcaaccacatcgaattgcggtgagtgaaaattcctttttaaccatattagtgttcatataatttttttgcatagctaaactaaagtctgtgtatcatattgcttaagaaacggggtcggacgttcattggacagaaaaatgatccattaaaagcataaatctgaaaagaggggatttttacggtcaatgcttaagtattgttggtaccaaacgttaaaggctatagaatttttttaaaccaaaattaattttcttgaatatactcgaaaaagctgcgtttcgtttttctcgttgtagtttttcttaatgtcagttgaaaaaggatgggtgtatgggtaatcaatccaatattaaatatatacatccatcaatcacatttcagatgttttgacaagacggtgatcaatttgttgaaggattggcagtcgtttttttctggcggagtttcgttggaacttttggacgtcggactggccggaatg

SEQ ID NO: 65066 - DNA, 575 bp, Heterodera glycines
  Genomic contig location: Contig_ID=SeqID_965; Location=1196..1770; Strand=+
  SCN-specific regions: Sequence locations=1-46,213-230,252-373,395-575
atgaggaggagcattaaaatctgtaaaagtgataacacatacagagaaagaaagagatggacaccacgaaagagagagacggagagaaagagagagagagagacagatagacatactgacagagatagaaaaagagcgaacaagagaaaggaaaaagagacagacagacaaagagggagaaagaaaaagagagacatacagaaagacagagatggcgaaaattggtagaagggatgagagacgaacagagaggcaccagtgaaaaaagataccgtagattttttatttttgtagttatttttctcaaaaatttttggagagagagagagagggtggcggtgctgatagccgacgcaatataaaaatttgacccagaaattggcaatttccttataattccttaaaattggctcaaatcgcaaattctggtaatttctttgaataaaacctattaataattcaatttcagcttcaccgagcttccttccacaaaattcttcttgaaaaagagttccgcaaaaaagagatgtgaaaataaaaaagtgaattcttatgtgataccgagtttttattaa

SEQ ID NO: 65067 - DNA, 2228 bp, Heterodera glycines
  Genomic contig location: Contig_ID=SeqID_965; Location=2276..4503; Strand=-
  SCN-specific regions: Sequence locations=1-223,245-341,389-422,451 -528,553-983,1038-1072,1105-1133,1167-1194,1251-1320,1342-1746,1768 -1862,1884-2017,2039-2228
atggccgaaacggtgtggccaatgatcagcaacgagaacatcaaggcaatttgcttgtatagcgggaagcgtttcgtggtgctgcgcaataccaatcccgcggcgggacgctgcgagtgcgaaaagcgattggtgtcgcattcgatggccatgtgctgtacggattatgctcgaaaggaatgggcaccaatacagtgtcaatgggtgcgtcgtaattatcatcaattaacaaaatgtgtaattttaattggagtaaggacgggaatgggaatttaaaacggacgggacttgtcgggaaccgggatttaaagaattagaaatttttattatttttcccaaacaaaaatattaaaatgtaaaaaatatttttttcatttcatttatttttcatgtgaaaaaaacaattagactaaattaaactcaaaaaatgttttaaaatttattttaattcatccaatcccttccaaagaaatgaccaaatacaatgcgtatttcgtaagggactagaagaaatcgaaatagaactaaatttattgtaaatttaaataattgaattaaacgattagaggataaatctggttttgaacacaaaggcttttaacttcagaaaatttattggcaatttttgaaaaatcctatgtatgggaggggggccggcagtgctggcagacacaccgccggagaaaagaatctgaagtttcaatttgattttcagaaatagccaagtttgggaggttttgagtcgattttttttgaattaaagagtcgttactgccagcgatgccgactggcgccgctgggcggtgcgcggggctagcaagggcgtagctaagctaggccggagctttaggcttaagcttaggctttattttgtaaaatttattgtacggcggagttgtccatcagtcgaattgtcccattagctgagttgttcgtcagctgactaaaccagaagccctttaaataattaatggatttttgcgaaataataaaaatttataatttgctataatttagttaaaaaatttttaaaaaatcaatttgtctcattggattcaatcaattttggtacttattttagttaattttttttaaaattattaacagacagatttaaaatgttagttttttggaattaaaataattttaaaaattgaaaatattttgaagtgaaggtaaaaaactgtgacgtagtaataaattaagttcaataaaaaaagttttataatttacttaaaaaatatattatacactaccaataaaaaataaaatgaaaaacatttgttcataggggggaaggatttgatcgcgcattgctgcgcaattgcttcaagctttttcaaaatatttaaatggtttttgaacataattttggcctttcatactttcttagttatcagattgttttattggtctctgattgtaccgtaatcattttagtgtttggacggtaacgacaagaacactttctggcaggagttatgcaaatttttgcatatttcgtcgatggaaccgatgttgacaaaactcacggaagtaaaaggggggcattttggaatttggcacaaaaatggcgcaatgaaaattgtgcactcgtaggcagaaaagtgtgaaacagccgaaaaagagctctgaataggaatgatttaagaaatgtggggcacctgcgagtgagccaagagcggcacgtggtcccgcgtgggattttgctggatcctaatccgaaaacgtgctgcaaaattaacgaattgaaaaaactaagaaacatttacgtaaatctgaaaaaaatatttaaatctttctggccttcgtaatgaaacagtggtacttttgatcagacattcttatgaaattagaagaaatctgagcaaattttctcagaatttgggaaagattttctttgttttagtgttttgtccatatttttcttttatattctactttttttgtccatgttaaaacttttccagcatttcggtgagaaattcgttcccatcaactccttcaacagttcattctcccaaatgcatggttcatttaaacattccgagctgcacaatgtgccgtcgaataacactctaactaattgcatttggggctgctgccatttcgaaatgcactctcgaattcgtcgtgaaaacttacggaaaactgaagaagataatgatcagatctgttttgataagaatgccgtcttctttagctttcgggagacggacattgggtaa

SEQ ID NO: 65068 - DNA, 564 bp, Heterodera glycines
  Genomic contig location: Contig_ID=SeqID_7509; Location=788..1351; Strand=-
  SCN-specific regions: Sequence locations=1-319,342-371,395-418,440 -529,553-564
atggtggtcaccaacaaggaatcgacaggcagtaaaccgacacacatgcagaaagccaaacaacatcgagagggtaaaacattgagaaggcaccaagtcaacaagctcttgtccagcgctgcaacgttacgaccaagacgcaagcgagaatcggttcccaacagcacaacaccaatcgtgattgatctttcttccgacagcgaaggaaactcatccgatgtcgagatcatacaagacccagttgcggatcaacaaatcagctcatcgaacaaacattcaactgctccactgccgaaagaactgcgaagatcaacagcaacaaagcagagttcatcaaattccacgcgaccagtatcattccgcaagcgaacacaaggaaaagcagctccttccgcaggaataagccgaacattcgaacacagcagccaaacaaaagccttgtcgccaacaactaaagaaaagagggcaaaccaacaacacgccatggcactggaaggaagtaccgatccaacgacaaatacttatgattggcaatcagcgaaattctccaagcatatgctttaa

SEQ ID NO: 65069 - DNA, 1998 bp, Heterodera glycines
  Genomic contig location: Contig_ID=SeqID_7509; Location=1493..3490; Strand=-
  SCN-specific regions: Sequence locations=1-580,602-877,902-1245,1269 -1940,1962-1998
atggtcagcctaatccagaagggcatcacattcacactcaaggcgctggatagtgccagaacgaccacggcactttcactacatccagacgccgacctctcaaactgggaaaacgcagtcaaattggagactcaatgcactcgcgtgaacagagaagtccaaacaatcgaagcacaactggacaatctacgcgacctctccaacaattggattgacctgctaaaccgcctagaaggagcagaaaaagacaaaggcgagaaagaatacgtcaaattcgacacgcatgagaaaattgccgaacgccatgacgcagctacaaccaaactccgggatctgcgggatctcgaagcaacgctcagtgccgatgccaaactttaccgaggcagaacagaaagagaagcaaaggcggatcagcaggcaaatccgccaccacaaacagcaatgccaccaatggcagcaccgacattcacggcaccgctctaccaattccagccaatccagcttgacaaattcttcggccaaaagcgaaaatggcccgaattctacgagtccttcaaatcggccatcggcagccaatcaatcagcaaagcacagaagctgaacttgctccgcaatcttctgggcggagaagcacgggaactcatcgctgggttccgcctggaggaccaaaactacgagacggtccttcagttgctgaaggacacttacggcgcacccgaagagcacatcagagcgctacactttgagctggccaatctcaagccgtgccgaagtcttcgagacacaaaagaattcctgcttcagctcgaacgactgacaagagagctgaacaatgccggagaggacatcgagggaccgcaggtgttcctcatgttggagaaaaagctgactccagcattcctacgcaacatcctcaacaaaaagggagaggatccggcaaattggacaacaacaaaattccgggacgtgcttaacgaagcagtccgcaaagaagtccaaatccaagaagtgatgggcgaatatggacatcactacgttcaatcaaaggcagaagtcgtttcagcagcacacgtccaatcgcccataacagcaaaccaaaggtcacgaaggcctaatcaaccaagcacacaacggcatgagtcattcatcgcctcaacactggatgagagtctaaggcagcaagcctataagaagcaacaggacatgcaactagcaaacagtcggcatccacaagcgcgagaccaagcacaaagcatcaacaggattccgccctatccttgcacgttctgcaacggcaatcattggcacgacgagtgcaaaaaagtgagcacactcaacgaacggatcagcatcgtcagagaaaagaagttgtgcttcaaatgcctgaaggcaaaccatcaagcatcgaactgcgctcgaccgtccaagtgctaccattgcaaacgtcggcatcccacagcactctgcagagatcagtgcaggtctgagaatgacatcaatatgccaagcaactcgtacagtgaaaagaagccaaatgaccaaaacggcaggcgatcaacagcgatcgaacaacagcagatgtgcaatgccgtccaaagcagggacaccagagcattgctaatgacagcaagggccacgattttcaatccggcacaaccaggcctcagcatgatggcaacagtgttcattgacccgggaagccaccgatcgttcatctcaagcagtgcagccaagcagttggagctgaccaaccttggaacggaagaatgtttcctcacaagctttggcgaaagagagccaaagagatacttaagcgaccgcgtcgcaatcggcattctttgtcctgacaacgacagattcatcttcaacctgaacgcgttgaagttcctgttgaacgaaatgccggtactacaactgaatgcggtggatcacgacgagcttcagcagaagaagcttaacctgccaaatgcgccacggcaaccagacatcttgctttga

SEQ ID NO: 65070 - DNA, 626 bp, Heterodera glycines
  Genomic contig location: Contig_ID=SeqID_35523; Location=392..1017; Strand=-
  SCN-specific regions: Sequence locations=1-626
atgcgtttctccgctcctcgtcaagtgctcaaatatttctataaacggacaaacgcattttgggacaaatcgatgctccacaaggagcgagtcgcatatgcaaagctccggctgaagctgtacggcgcgttggtgctttccatgtggtatatgtagtaagtgccggtgaatgttttttgggcggattccctatgaagccgattcgccacttaattgtgacagaattatgcaattccaattttgctgcctttttgtggtacccctggggccagttttggtgccccaatttccacttttctccgttaatttgacttctgtcagtgaattcgccactcctccgcctgacgtgcgctttgacatacggtggttcttcagcagctcatttgccaattatgtgcagacaaagggtgccggtggcttggacattgcggatgagtgagtgaaaatgacaagttaccgtaggaaatggcatggccaacaaaggcacgggcttactgtaccgaacaaaacactaaaatttaatcccctttcaggaccatgtacaaacagttctcattttcgaagggcagattgttggagaatgcgctcgaaacgccggagggacaagcgatgggattgtccgaaag

SEQ ID NO: 65071 - DNA, 660 bp, Heterodera glycines
  Genomic contig location: Contig_ID=SeqID_35524; Location=108..767; Strand=-
  SCN-specific regions: Sequence locations=1-293,315-660
atgacaaacaaattcacatgtacatcttttacgggaataggccgttcatgtgacaaatgcgtcgacggacattcagccgaacagcacggaatcgcaaaaagtggtcgattgggtgaataattgggtcgcccctttctattttgtcacatttccactccttttttgcatagatttggaaaaccgaggcaaatccaacactttcttccgccgtttgtcagcttcctccgttactttggtccttttctaccattcgcttggcacacgttcggtcagtcagaaattgtgctgcaaaatgtatgaaatgctgtgaaatttctccataaatttgcttccattttaaatttttcaagatttttcacacttaaaagatgagaaatccgatcatatttttttgtaaacatttaatattgttttaaagtccaaaggtgaaaaaatgttttttatgttccgggcaagatcgaagatgagataatgcggaagggggggggggggaattctttacatggcgctttttttatcggagctcactttaatcattaataattcctaatattattcgaactcattttttttgttttttagccatgctatttgtcattgcccttctcgtgattgcactcatcgccttctgtttggtatcggtgtttatcggcacttggg

SEQ ID NO: 65072 - DNA, 207 bp, Heterodera glycines
  Genomic contig location: Contig_ID=SeqID_35526; Location=1..207; Strand=-
  SCN-specific regions: Sequence locations=1-207
tcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaaactattcccgaaggattcagtctccccataaatctgggcgcatcggttcggggggactg

SEQ ID NO: 65073 - DNA, 406 bp, Heterodera glycines
  Genomic contig location: Contig_ID=SeqID_35527; Location=415..820; Strand=-
  SCN-specific regions: Sequence locations=1-7,30-298,327-406
gtttgattgaattgtgtgagggaataaagaaagggaaaaatttaaatgcggaagcattttcaaaaaattggcaaaaaatggtcaaaattggcacagaaaatgggggaaaacaatggaaaagcgaagggggcgaaaaaatagcgaaaccaaacgaaacgatacagaaaatgcattttgaagcgatgaaaagcataaaacaacagggaaatgacacggaattggatgagataattggcaaattgatgcaaggttttagtcaactattaatagaaggagcaaatccttgctaatcgttttcataaatttaaaattcttttattaaaattggataaaagaaaaagcaccccacccctccataaatttaccttacctatttagaatctcagataatgcacgtttgaataaa

SEQ ID NO: 65074 - DNA, 242 bp, Heterodera glycines
  Genomic contig location: Contig_ID=SeqID_35528; Location=113..354; Strand=-
  SCN-specific regions: Sequence locations=1-242
tttaggcacgtcattcgtaaacgtaaggaggaggacaagcccatctggtacagcaaataccttataaatgacccgaaactcggcacccgctacttttggacttttgctggggtgaccaccgttctgttcggtgcatacattcgccgctgtcttcgctgattggacaaaacgatgggaatgtcttattttcggaagtgtatatgttatttagacggaataaattgttaggataatctcaaaaa

SEQ ID NO: 65075 - DNA, 394 bp, Heterodera glycines
  Genomic contig location: Contig_ID=SeqID_35529; Location=67..460; Strand=-
  SCN-specific regions: Sequence locations=1-394
atgtcagaccgccgaaaagaagccgaggaaaaaatggaaaaagcaatgtaaattaaaattaaaatgccatttttaaatttcaatttcaattttaaattttgttttcctttttttcagtttcatttctgccgattgttggctcggagtgttcgatttgctgccaccttcacaacttggccttggaattgcgatgatcagccaccgatttgactattacgtggacgaacatttcaagacgcgaaaaagggcattggcatttattcgaattcgatacaaaatcgaagaaaatggcaccaagggaatggaaattgtcaattctaattgtgaatcattgtcaattccgcaaattcaattgccaaagaaaatcatcggattcaaacggatcagcatctag

SEQ ID NO: 65076 - DNA, 1248 bp, Heterodera glycines
  Genomic contig location: Contig_ID=SeqID_7511; Location=1308..2555; Strand=-
  SCN-specific regions: Sequence locations=1-91,117-411,452-616,638 -918,944-1042,1065-1248
atgcagcttctggctgacccgcttctgaagcagattgccaacaaaactgcatttgtttcaattgaggtggttacttttttgtataaaaacgaaaaaataataaaatttattaataacttttgtccaaaaatgctatttttacgattttagcttataaataatcacttttctgatttattacctctaaattattatttagttgaaccatttacagtcttttctagaaatactgttgcgtatttttaggaatttgcaattcgcttcaaaaacattcgcatgaactgttcgatggaaattggcaacgaatgtgcggctggcaccaagctgatcatgttggcaatgtcgggcagaacctcatttgagaggcgaacgggcgcgagagagacatggatgaaagaagcggtagggaacaatttaattgaatttattattattaatttaataatttattggcgaaataacgggggaaacaatttaaagcactaattaagttggtttcatcattgtattgatgaaacacgttgtgtaaattatttaattgggttaatcaattttgaattttaaggaattcaattaatgagaaatgtcgaataaattaatagtgagaaaaaaataattgaaatattcaattaaaaactaaatttgatcataataggactggctgcactcatttgaattttaaaatttgaacaaaatggacattaattgttttttattgattggataaatataattttggatttaattaggcacccggagaaattctccgttttttcgttgccgacccatcggcaggagaagcggcagatgtgaaacaaaaattagaagaggagcagaaaaagcatggtgacattgtgtttttgcacggctttgtggataagtacaagcatttacatctcaaagtgatcagcaaatgacaattaattaattaataattaattttctttcaaatgataaaaacggagaaaaaaaagcatttattttggcaattctttgacaaatttaatatgtcggatttacataagcctatatttgcagtggttcggtgctctgacatggcaacaacggcactgtgccggtgccgaatgggtggcgaaggtggacgacgacacggtggtccatctgcgccggatggactattggataaacaaaaaatttcgccaaattgccgatgaccatccgctgattatttttggggatatggacgccagtcgaaagccatttcgggacagggaaatcaaatggtag

SEQ ID NO: 65077 - DNA, 1290 bp, Heterodera glycines
  Genomic contig location: Contig_ID=SeqID_7512; Location=76..1365; Strand=-
  SCN-specific regions: Sequence locations=1-71,94-113,146-278,322 -467,489-497,520-536,558-617,640-653,679-852,883-896,924-1193,1216 -1290
atgacaacccacaaaagttggcagtttcatgaatacattaaaaaaaaggtgaattttgttttaaggtatgccatttcaaggatcaaagaaaaatacttaaagatcgatgtaacattttttaaaataatttttaaatttattattagatttgaagggaactgcattccaatcgtttaaatattttgaaactcgacgaacggaaatccgtcaaatttttcggattgaacaaaaactctgtagaactgttgacaaatacaaaaaagaattatttgggtttgtattttaaatcaattttaatatgaatttaattaaaaaattttagtgatgatcaatcacataaatattgtgtgtatactcgtagaggtgattttgttaattttgcttgggcttccaataaagacttcactgagcagggcatcgaattcggagttaaatatttaatggtaattaaatcaatttacgttttcaatatttttattcaaaattaagggatcctttaaaaacatttctgtcgtcttgttgggagaagacaaacaatttttgaaggatttaaaaatcaatcaacaggtaataatatatagatagggcttatatttttaggctctaaaaaattcataaaataagctttaaaaatggaataggttctaaaaagctttaaatttaataaataataattttggtcctttggtcgcttcttaagaatgtgtttttctttttcattgcatttttttaaataagttttggcatattgccaaaataggcaaaaaaaaaaatggtttttcaaaattttttaggcttttcggtttaaaattaaaaacctagaaaataggccctaataactcgaaaagtaggtttattaatatgataaatttaaattttatagttaattgtcaacgtttatttgccaaaagcaatgccgcgaattaatgacttggcattttccatcataacatgcgattcgttgctgataacagcaaatacttcaacatggggttggtgggtcgcttatctgatgccggataatgccaccattttttacaattcaaaattcggcaaaggtaaggcttgtttttttttgaaaattgaatttcggttttgcactcatctaatttacttaggttttccacataatcgagaaaactttttggctgaatgggtaccgatacaattgttcaacggaaagatgactttagattaaattattattaaaattatcaagaacctacttaatccaattcgctgagctattgttaaattaccattttacaattatttaattgttttaataaa

SEQ ID NO: 65078 - DNA, 54 bp, Heterodera glycines
  Genomic contig location: Contig_ID=SeqID_35535; Location=207..260; Strand=-
  SCN-specific regions: Sequence locations=1-54
atgcgcacccgtccgatctggacagttaagcaacgattgctgactagccaaaag

SEQ ID NO: 65079 - DNA, 677 bp, Heterodera glycines; identical to SEQ ID NO: 63383
  Genomic contig location: Contig_ID=SeqID_35535; Location=268..944; Strand=+
  SCN-specific regions: Sequence locations=1-60,82-677

SEQ ID NO: 65080 - DNA, 1421 bp, Heterodera glycines
  misc_feature (1242)..(1244): n is a, c, g, or t
  misc_feature (1259)..(1259): n is a, c, g, or t
  Genomic contig location: Contig_ID=SeqID_35537; Location=1..1421; Strand=-
  SCN-specific regions: Sequence locations=1-227,250-437,474-725,753 -1025,1064-1421
  Gene Ontology: Mol. function=cation channel activity; Cellular component=membrane; Biological process=olfactory behavior
ttgcgcttggtatcacggatgagatgcgaactgaaccggccgactcgcgcttctccgagcacgaggcccaatggcggatgaacaagcgtggcatggacggcgaaacgctcatccacctgttgttgaacaggaaggagttggtgtgccatgaagtggcacgtattttgatcaaccgttacccgggcatggccagggacatctatttgggcgaagagctgtttggtgaaattttgaaccagttaaagtcaatttaagaatttcaatctgtttatttggttctagaaatgcccaaatgtgatttttgtaacgttcaaatcaagaattcccaaattgcgttataaactctcaatttaattgccgcctggtcctggccaagaattatcataaaattttatgggaaaatctgcaaaattgatattttggcataattacggaaattttcttgaggatttcattttttcaaatttaaaatccgatttattgtcatttcaaatgtcatttttgtcgaacctaaaaattaaggccaaggttgtcttcatttggcaattgtcaacgatgattatgacacggtaataacaatttgaaatgataattttttttcatccttcacaggccaaaattctgctggaatacggtgcttctgtaaatgcgcgtgccaacggcgatttctttatgccggatggctatgagcccggtcacagcaatcgaaacatggattatgaaggtaataaaaatttttaaattaattaatagccatttataaattacttttttttacttaggctatgcctattatggagaatatccgttggcgtttgcagcttgtttcgaaaacaaagacatttatgacctgctgatacagtatggtgcggacccggacaaacaggacactttcggcaatacaatagtgagcgctacaatatatttcaatgaaatcgtaacttttcagctccacatagtgcgtgattcacaacagaaatgtaagccttttgtaatttaagttgtatgttcgaaattgttgtatgtaaattaaaaattacaaaaaaataaaaaatatttaattgcacaatttttgctaaaaaaaggttgtttaagtcattgtacagctattcggccaagcattggcacaaaccggcacacagtctcgagaactttgctggccaaacgccgcttacacttgctaccaaattgggcagaaaacaaatttttgaagaaatgcttgaattgatgaaagtgagtggnnngggggaggaataatntagtaagattgatcatttgatcagaaaagggttgataacacggttcaatgaaaaatagtcaaaaaagtttccgaaaatcggaaatacgtctaagccaaaaataatcggaaccctaatggttatatgaaagcatagcagttagaaattgtatggtttttcaaa

SEQ ID NO: 65081 - DNA, 679 bp, Heterodera glycines
  Genomic contig location: Contig_ID=SeqID_35538; Location=429..1107; Strand=+
  SCN-specific regions: Sequence locations=1-657
atggttttagcaacgaaactccttgtcaatataacgtatatattaactagcgggtgcgtgaaccgtcgaatctggacctgggaaaaagcgcttcgcgctttgggagcttcgctacctagattagctatgggttgtggagtaattgttggtccagaagagagttacaacaaatgttagaagaagtacaaaattggtagaagaggtacactgggatttttaggctgctttgtggagaatagaagaggtacaacagcgattagaagaggtacaactgtgatcagaagaggtacaaaattgttagaagaggtacaaaagtgattagaagaggtacaactgtgattgaagaggtacaactgtgatcagaagaggtacaaaattgttagaagaggtacaaaagtgattagaagaggtacaactgtgatcagaagaggtacaaaattgttagaagaggtacaacagcgattagaagaggtacaactgtgatcagaagaggtacaaaattgttagaagaggtacaaaagtgattagaagaggtacaactgtgattgaagaggtacaactgtgatcagaagaggtacaaaattgttagaagaggtacaaaagtgattagaagaggtacaactgtgattgattagaagaggtacaaaaattgaatgcaatttattataaattttaaaaa

SEQ ID NO: 65082 - DNA, 812 bp, Heterodera glycines
  Genomic contig location: Contig_ID=SeqID_35540; Location=267..1078; Strand=+
  SCN-specific regions: Sequence locations=1-812
  Gene Ontology: Mol. function=calcium ion binding; Cellular component =extracellular space; Biological process=glucose catabolism
gcactccgacgacgaaagctgctctttggctttggggttggcactgtcatcggcgccggcttttactacatggacaaaaacaacgaaaggcgcttcaaacgggacaaagtcagtccatttgaagattttatgtcgagtgtgaagtccatcaaaatcgagacggaagtttgcaattcatttcaatttgaggacgtttatttcgtgtccaatgcgcatgcggccaccgttgacaccaaagcggcgctgaacaaacgcccgtccggctcacttccgacccgcgcggagctgttgaaaggaatgcgtgacgaggaattcgacatccttgtgattggtggcggagcgacgggcgcgggggtggcattggacgcgcaaacgcgaggtcatccattttttgtccacttgtgccgtggcactttcagtgcacttggcaatttaaggtctgaaaaccgcgctggtcgagttggacgacttctcttcgggcacaagtgtaatttgtcttccccgtcttgtctttccctccgttttgatgccttttcccgcttcagtcgcgctccaccaaactcatccacggcggagtgcgctatttacaggcggccattatgaagtttgaccgtgagcagtacaaaatggtcaaagaggcgctgttcgaaagggccaatttggtgggcaaaaaaattcgatttggttgaaaattgacaatttttacatttaaaaatgtttcagttggaaattgcgccccatctgagctatccgctgccgattatgctccctatttacaagtgacacacacgtttttgttttatttatttttt

SEQ ID NO: 65083 - DNA, 864 bp, Heterodera glycines
  Genomic contig location: Contig_ID=SeqID_7513; Location=305..1168; Strand=+
  SCN-specific regions: Sequence locations=1-315,498-510,532-533,555 -799,821-864
  Gene Ontology: Mol. function=transcription co-activator activity; Cellular component=nucleus; Biological process=regulation of protein activity, epigenetic
atgccgccatatggtccggctcacaaccaacagcaacaaatgatgccaccgtcggcgctggtcggcgttccaccgggcgcagctgcaacgaacacttggatggattggaattcgtcagcggcgatgccaccacgcggcacttacccgatggcgccgacgaacgccatgaaggcgggcacacagacgggcacgtacattccgccgcagagtggcggaatgatgccaccgcctgctgggcaggtgccgtactacgccgttgggatgcccacgtcgaccactgctgtgcacggtcaaccgatggaaccggctgcataccatcagcaacaacagcagcaacattaccaagccgttcagcagcagtacacaaattaccaccagcagcagcagccgaacatgatatacaactcacagcaacagcaacaaatgctcttccatcagcagcaacaacaacagctcaatcaacaaatgatgatgcagcagaggcagcaacagcagcatcgccaaatggtcgcgacggcaacggcaccaccggcggcagggacagcacagcagaaagcagaacttggcggagtccaggcaggacaaccggcggtgcaactgggaagctacgcgtcgtcagcagctggtggtggtggtggtggcatggcgccggcggcgggcggtccgtcggcagtgaattctgctgcacagcagcaacaccaatggcctggcagtgtgacgcctgttgaggacctttacgtacgttttcatcggcgggttggttttggaaagagcaaaaatgcttgggattttgttttaccattttttatgtccccatttctacgcattaacctaaccatcgccatgtatgatataattgactaa

SEQ ID NO: 65084 - DNA, 166 bp, Heterodera glycines
  Genomic contig location: Contig_ID=SeqID_7513; Location=2036..2201; Strand=-
  SCN-specific regions: Sequence locations=1-166
ctgctcgcatccaacagtcgacgactgtgaaaaacaaggacattcggaaattcctggacggcatttatgtgtccgagaaggtggccattgccgatgaatgagcacacaaagataaaaaacccattgttaccccttttttgttggtcagaatggataaagaaatgtt

SEQ ID NO: 65085 - DNA, 258 bp, Heterodera glycines
  Genomic contig location: Contig_ID=SeqID_7515; Location=269..526; Strand=+
  SCN-specific regions: Sequence locations=1-258
atgaacagatcagacagctttcgcctgctttcaagtgtcgcagttgaaggtattctaatctttgttggtatggaatgggtggaaggctgcatttgaaaagaactcttttggtgaaatatttttgacatttttcaatttttttaatattttttagaagagatggattccaaacctcaggagcatattccaataacggtctaacataagttttgtacaaaataatccaaatcctagaagattttgatttaataacccgaa

SEQ ID NO: 65086 - DNA, 2022 bp, Heterodera glycines
  misc_feature (1940)..(1941): n is a, c, g, or t
  misc_feature (1966)..(1967): n is a, c, g, or t
  misc_feature (2018)..(2018): n is a, c, g, or t
  Genomic contig location: Contig_ID=SeqID_7515; Location=19..2040; Strand=-
  SCN-specific regions: Sequence locations=1-86,108-137,161-229,251 -582,623-688,710-1248,1271-1839,1861-2022
tttagcataaatcaaaaatattccccccttaccaatgtgttgttaagaaattttaaatggaggtgtattccaataaaggcgtttaccaaagaaagattttgactcctaaaatacccaaaccttttatttagcacccattaaaggaaaagcttaaattttttcaggcaagcttaaaacctgcccccatctaaaaaaaagcactattcggatagcatatctttttcaattaaaaatacaaacaaaataaataccataaccaaattgagaaaaaggctattcaaaagggaagaaattctatttataaatatatacaaaactttaatgtcaatccctttgaaatacctaatctgatttatgaagataaatgctatcataacagtgctgagaaatgtgaaatatttgccaacttatttgccaattcatttaataataaggaaacagacccaagcaatacatacttgggtaatattatagaaaatgatcaatgctttatatcggatataaattttaacatcatcgagacccaaaatcttatgaaaaaacttccgaacaaaaatggcacttctccagataatattagctataaaattttaaaaatttgccattcttctctgtcaactgttattactgacttgtttaggatctcattagacactggttcacttccagacatctggaaggaatcaattgtttttccgctttttaaaaagggtgacaaaaataatcccgaaaactataggccaatttcattaacctgctcactttgcagggtaatggaaagaattttaagcagacattttacaattttctactaaaaaacaaaaaaatttcggaataccaatttggttttgttagaaataggtctacaacgagtcaattaataacagttgtggaagattggtatgaggcaattataaatggaaaaaatgttgactgtatttatattgactttcaaaaagcatttgactcagtgccccatgaattacttttatacaaattggaaaaaattggtataaggggcaaacttttaatttggataaaggattttttgagtaataggacttttcgtgttaaaattgaggaggctttatcctcgaataaaaaagtttgctctggcgtcccccagggctctgtcctgggccctttattatttttgatctatattaacgatcttcctgatgctttgccatcaggagtgagaattaaattatatgctgatgatgttaaattgtatatttgttataaagcgagagctgacacagaaattatgcataaagcattgcataatttatccgaatgggcaaataaatggcaaatcagaatctcaattaaaaaaacttttgtacttcatttagggaacaaaaaccccaaagaaatatataaaattgatggaaatataataaatgttgtggatacaattagggatttaggcataaatattgataataaattgcaattttccaatcatgtcgcacaaataataaagaatgcatatttacgtatgcgttctttatttcgggttattaaatcaaaatcttctaggatttggattattttgtacaaaacttatgttagaccgttattggaatatgctcctgaggtttggaatccatctcttctaaaaaatattaaaaaaattgaaaaatgtcaaaaatatttcaccaaaagagttcttttcaaatgcagccttccacccattccataccaacaaagattagaataccttcaactgcgacacttgaaagcaggcgaaagctgtctgatctgttcatggctcataaaataatttatggccgaacagatctgaatccctttgaaatattcaaaccttctgaacgctttaacattcccttttatagacttaattcgaaatataaactaggcaaaaaatttatacctgttgcagggcgagtaactaaaatttggaaccaactcgatannaagctttattgaaataactcattannatcatttaaaaataaaactaaaactatttcattcctgtaaaatagaccggnaaaa

SEQ ID NO: 65087 - DNA, 546 bp, Heterodera glycines
  Genomic contig location: Contig_ID=SeqID_7515; Location=1368..1913; Strand=+
  SCN-specific regions: Sequence locations=1-51,92-423,445-513,537-546
atgtctggaagtgaaccagtgtctaatgagatcctaaacaagtcagtaataacagttgacagagaagaatggcaaatttttaaaattttatagctaatattatctggagaagtgccatttttgttcggaagttttttcataagattttgggtctcgatgatgttaaaatttatatccgatataaagcattgatcattttctataatattacccaagtatgtattgcttgggtctgtttccttattattaaatgaattggcaaataagttggcaaatatttcacatttctcagcactgttatgatagcatttatcttcataaatcagattaggtatttcaaagggattgacattaaagttttgtatatatttataaatagaatttcttcccttttgaatagcctttttctcaatttggttatggtatttattttgtttgtatttttaattgaaaaagatatgctatccgaatagtgcttttttttagatgggggcaggttttaagcttgcctgaaaaaatttaagcttttcctttaatgggtgctaa

SEQ ID NO: 65088 - DNA, 695 bp, Heterodera glycines
  Genomic contig location: Contig_ID=SeqID_35546; Location=80..774; Strand=+
  SCN-specific regions: Sequence locations=1-57,79-276,315-695
  Gene Ontology: Mol. function=potassium:chloride symporter activity; Cellular component=integral to membrane; Biological process=transport
atgtacatcatcggtgctgtggaaatatttctcatctacattatgccacaggcgaaattgttcgaggacatggtgagcaaatcaaaaatgtgcaaaaaattaaataaaaattcgagactctctcgagagcaaatgtaatctgatcaatttgatcagagtgatttccgatcagcaaaagggggtggcactcttttggcattttccccacttgtccaactttcccatctcatctgatcaattgatcagaataagagttatttccgatcagcaaataggggtgggactcttttggcttttcccccttttttgcccaacttccccccccccccacttcccatttcagtaccacaattttcgtctgttcggctcacttttgctcattttggtcggtcttattgtgctggcgggcgtcaaaattgtgaacaaatttgcgctcccggccgtgctgattgtgatcgcgtgcattgtgttcacttttgtcggcattttcctcaaatttgacgggtccgactcgctacagtaagtgcggcccctgtcccgccataaaagcacaaaacatttctcattactagagaccggacaactgaggcacgatgagggaccccgagtcggggtcccaactttaatcccgcgatcccgagaaaatcccgcaggatcccgaacttaatcccgcggaatttgaacggggccattga

SEQ ID NO: 65089 - DNA, 1080 bp, Heterodera glycines
  Genomic contig location: Contig_ID=SeqID_7516; Location=142..1221; Strand=-
  SCN-specific regions: Sequence locations=1-109,293-399,436-500,522 -577,603-949,971-1080
  Gene Ontology: Mol. function=structural molecule activity; Cellular component=microtubule associated complex; Biological process=N -linked glycosylation
atgaattcccaattgctttgcatctttctgctggtcatttgcaccgtttccattggcacactgacacaagcaaagccaattccggaagaagctgcggcaaccgaaaccaaagcggacgaaggcaaaaaagaggagccgaaaaaggaagaagccgaagcgaaaaaggaagaagcgacgaaggaggagccgaaaaaggaagaaacaaagaaaggagagggcaaaacggaagaagctaagaaagatgaagccaaaaaggaggagccgaaaacggaagaggccaaaaaggaagaagcaaagcccagtgccccggccgtcttaactgaagctgccgataatgtgaacaaagcggtcgatgacttaagcgttaaacaggtcaattaattatacaaaaagtcaagcaattaattataataaatgtttacttaaaataataatcactcattaggcaaaagcattgaaaaacgcggccgaagcaacggcagagaaaacgccggaagagcaggaaaaagcattgaaagaagtggcagaaaaaggagggaacgaacagctgaaggcaaacaaaacaaaagcatcgaaacaattaattatttattaattaccccaattaagacggctgtcaacaaaattttggaggcaaaagcgaaaaacgacgcggaattggaaagcgaagtgaaaacgaaaacggcaacactttctgaggacagcaaaaaggccagcgcagaggtgaaaaagcaatgaaattatttattgaaaaagcaattgtcagtaatttgattttaaatgtcaatttattttatttttttgcccttttcagttgactttgataattgaagacaaaaagacgactttggacgagaaggtgaagcggacggaagagctgacagccaaaatgtcggacaacacgaagaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaataatgaaattcattgattaaa

SEQ ID NO: 65090 - DNA, 799 bp, Heterodera glycines
  Genomic contig location: Contig_ID=SeqID_7517; Location=545..1343; Strand=-
  SCN-specific regions: Sequence locations=1-77,104-122,171-390,412 -564,617-778
atgaggcacaccccacggcaaattcataatggtggacgcgcggcccaccgaaacctatccaggtcaaggaagtgtagtgtcacagcagcagcagcaacggaggagaaggaaggagtggagaccaacaacaacgacgacgacaacgacgcggacaaagacgaagacaaagaagtgagtcggatggaatcgaggagaattaccaaaacggggagaagagggatgggtaatcaaaccaaaaccggagagggatgggtaatcaaagggatgggtagcggtgggtggcattgcgcggtgggcgccgcgcaaaattatgattttctgactttgatctaatcacacacacacaaaacgggcggaggaggagcagagcacagaacagcaataaacaatcaaaatagtaaaaatgtcaaacaaatcggtggggtaattaattttaaaaatcggatttaatttattacaataaaaaaaatggggagaagcgagagattccatcggtgacgacagcgaaggtcaagtgcgcactttttgtattgggtacgagtaaaaaatgaaggccgaaaatagattattaaaaaatattctattaattttataaaataaagaattttcaattaaactttctcgggtccgggtaccccaccgagtacagacacacgcggcttttccaagacactgacccggtacccggatccgaatttcagtgaatccaaatgttcggtatccgacccggtaggtccgggtcttatcgtacaaaattcactggtaagaattggaagggaaggaaaaacagagaaataaa

SEQ ID NO: 65091 - DNA, 1142 bp, Heterodera glycines
  Genomic contig location: Contig_ID=SeqID_7517; Location=1867..3008; Strand=+
  SCN-specific regions: Sequence locations=1-155,205-346,377-555,577 -903,927-1142
atgctctttttcccaattgccactgttttgctcggtgtcttcgttggctcccttcaggggaaacccaccggtacagcaaaaagcgatccaatcaaaactaattatctgcgaatttcagaacaaaatgccgaaattaagccggcagcacccctcggtaaaaaagaaaaataaataaatatttttacatttttcatttttaaatttcctacagaggcaactcgcaacgaaatcaaagacacgccgcaacgcacagagaacaaagaaatttcgcgcagcgaaatcaacgaaatcaaagagattccgcgcaacgaattcaaaacggcgccaatcactggtgacagttttgaatatttaaaaaattaaataaaaattaattgttttaagagagccgtgaaagaccgttcattaaaagcgaaatcatccgcgacatcagctccgcaatgaacttcttgaacgagcaaatccgggagtactcggaacgaaccaaggacagagtgagtggagaggccaaggggaagcgaaacggaactcaaaatggacaattagcaggaggaattcaagggcatcattgaggccagaaacaaactcgagacggccatcaaaccattgcacggaggtgagcaaacaaattagggggcagcactaattgggctacatttggacaaattttcagtgatggagtccgacatggcttcttcgagcctggagacgtcgatgaccaactcggccaacatcgcccgacaagccctggaggagttgcccgtgaaacaggcatggcatttttgaagtaattagcactaattaaccctatttaatttcacaggtccgacaaatggaacaaattgcggaggagggaaagagcaaaacggtggaggagcaggagagggcactgcgcgagtacgcggagaagaacagcgaaagtgtgaaggtcggcggagcaacccccattcaacacaacaactcttcctctaaacggtcccataaaatttcagaaggctgttgaccaagtgttcgtcgccaaggaccgggcggacatcgctttggagacgtacttgaggagccacgctgacaccttctcccaggaggcgcgaaaggccaacgaccaggcaaaaagccaaattcaaaaggaaaagcatagctaa

SEQ ID NO: 65092 - DNA, 284 bp, Heterodera glycines
  Genomic contig location: Contig_ID=SeqID_7518; Location=108..391; Strand=-
  SCN-specific regions: Sequence locations=1-92,116-180,214-215,237-284
atgccgcaacaaaatgcgtttaatcaaccgccaaatggtcaaggccaatttggcccgaacggcttcaatttgaatgatcagcaaatgatggcacaacaacaacaacaacaacaaccgaacattgggcaaaacgcatttggacaaccacaacaaatgccaccgaaaggcaagttgattatcattttataatttttttaaatattaaatatttttgtcttcagcagaaggaagtggtggcattttttcaagtttggcacgcaaattgatgaattttatggccaaag

SEQ ID NO: 65093 - DNA, 182 bp, Heterodera glycines
  Genomic contig location: Contig_ID=SeqID_35552; Location=127..308; Strand=+
  SCN-specific regions: Sequence locations=1-182
atggctgaaggacaatgcgacgttgccgttggaggtgtacgcgtcgcgcattctgaccaatccggacaacggttcgctgacatttgtccactttgaggacattgacgagggcgactaccaatgcttggcattcaacggaaatggcacggcatattcggagaaaatgcgcctgcaacaagcat

SEQ ID NO: 65094 - DNA, 266 bp, Heterodera glycines
  Genomic contig location: Contig_ID=SeqID_35553; Location=615..880; Strand=-
  SCN-specific regions: Sequence locations=1-266
atgcgccggcttgtgaccattgacgggcacctgctcaaggcggggacgatggtgtgccaataaatttctgcggttcaaatggataaaaaagtgccaaataattaaaaatgattctttataatcaattcaggtattcgagaacccgacagcaattttgtcgagaacgattcctggacgagaatggaaagctaaagcgagtgaatgaattgatcccattctcagttggaaaatggtaacttttggtggattgtaatatatttaataaa

SEQ ID NO: 65095 - DNA, 511 bp, Heterodera glycines
  Genomic contig location: Contig_ID=SeqID_35554; Location=122..632; Strand=-
  SCN-specific regions: Sequence locations=1-49,71-466,488-511
gtccaggcctggatccaagtctcgaggagcctggatttttcatggacctggattttcctggatttttgtccactaaatccaggtccaggtttttccaaaataccgatctctaatcaccatatcctcaaaaggtactgtacaacatggacaacaaaatcaaggccaaactgcacttctgtcagtgggccgaacaccttaaccttggacaaaaattcagaatgtggcgctacaagaaagaagacgatccgtattacatcaacacgggtatcagcaagctcaagtcgttcataagccaagatccttcgcccaaggaaatctgtttttagaggatctgatcttcttttcaagtacaaacggttcccgaagagaaggcggaaatcagtactagggctcccatttttaggtgctaaaaatgatgggaaaataggtgccaaacagtttcaaatttagggggtgtaaaatcgtaaattttattcaaaaagcaattaaaaattcttttcaagaaaataaa

SEQ ID NO: 65096 - DNA, 52 bp, Heterodera glycines
  Genomic contig location: Contig_ID=SeqID_35555; Location=948..999; Strand=+
  SCN-specific regions: Sequence locations=1-52
atgatttctacaaacgatgacactgattcaagttggatagccattgacaacg

SEQ ID NO: 65097 - DNA, 1020 bp, Heterodera glycines
  Genomic contig location: Contig_ID=SeqID_35556; Location=143..1162; Strand=+
  SCN-specific regions: Sequence locations=1-62,86-124,146-205,228 -289,313-775,797-960,982-1020
atgacaaccaatttgtcatcattacctttgccattgccattatcccccgaggtgtcgtttgtggtgcgcagcagcagcagcggcacaatcagtgggcacaacggcaaaacaaacgatggcacggcaaaagcagaacaaaagcagaagcatcagatggaaggtagaagcagaaacacaacaagagaagaagggcgaaaatcaacagaaaaggcaatggaaaaaacggagaaagggaaaacgaagacgacgaccaaattgataataacaattagtgcaaatgacaacggcactttggaaaatggggacaaaggaaatggcacattgataaacggtgctaaagacaacggcactttgataaatggtgccagcaacgcaactttggaaaatgggaccaaaggcaatgacacttctggaaattgtgccaatggcaacgacactttgataaactgtgccagcaacgcaactttggaaaatgggaccaaaggcaatggcacttctggaaattgtgccaaaggcaacggcactttgataaacggtgccaaaggcaacggcactttgataaacggtgctaaagacaacggcattttgataaacgatgccagcaacgcaactttggaaaatgggaccaaacgcaatggcagttctgtaaattgtgtcaatggcaacggcacttttgggaattgtgccaatctcagcgctaacacggaaagaggaatttgtgcgggcagttatattttggcgaatactactaaggagaatgatattttgaggaatggtaccaaggacaaggacaatggcacttatacggacaatgcaatttttatgaatggaaccattgccaacggcactttggaaaattattctgccaaaggcaatgacacccttataaatggaggcacaacaacaacagttttacccagcaaaataatgggaaaaagtgccgtttcgactccgacaaatggcacaacaaaaacaacaccaaatgaagcaattagcaaaggcaacaacagcaggtactaa

SEQ ID NO: 65098 - DNA, 694 bp, Heterodera glycines
  Genomic contig location: Contig_ID=SeqID_35557; Location=12..705; Strand=-
  SCN-specific regions: Sequence locations=1-81,103-694
atggaaaacaccaatgttcgaccagataatataaaggagaaaaaccctttacagttcgatttgaacattcccttaccggaaataaatgaagaatatgaaaatgtgaaagaagccttagagcctaaggataaggaaatttcggacaaaaaagcatcgctaacaaaagctgatcaagaaaaaaatatgtcaaataaagatgtaccaataacacaagaattaaacaagttgtcaataattggcgagccgttgataagccgagaaaagcaattgccagttaatccaaaaaggacgcaattggagaaagaatcggtgagaaacccttttataaatgaacctataaaatggtggaagaaacgatttaaaaaatggactttatgtggtgcgacattaattcacatattttaaggtcactaattcaagcgccaattcaagtaaacaagttgccctaactgatatacatcccgaattgtcagaaagaaatgaagcaaagccgctacaggtggaactaaataccgaaatgtcaaatagaggcaaagcaaagtctgtacaaatggagacaaatcaccaattgatagaaaaaaataaaataaagtccgttcaagtgggaccaaatgcgagattgattgaaagaagcgaagcaaggccagtacaaacgggatcaaaggaagcaattgacagaaagcagcaaagcaaa

SEQ ID NO: 65099 - DNA, 1577 bp, Heterodera glycines
  Genomic contig location: Contig_ID=SeqID_35559; Location=48..1624; Strand=+
  SCN-specific regions: Sequence locations=1-72,96-146,168-212,234 -283,306-1577
atgttcaaatgtaacgtcattcaggaatcaagggaatttttggcgatcctgttttcattcaactcaaccattcacaatggaaagtgggagttagagcttgccagcggtgctgatgttacagtgatggacgagatcgactggaaaaacattggaaaccaaaaattggaaccatcccgaggattggttgcctatggcggaaaatccatttgtggcattttgggaaaggcaaaggtgaaagtgacgcacgaaggcagaacaattgagtccaatattcatgtcataagtggtaagcacaaaaatttgtgcggtcgcgatttgatcatgggactgaaaattgatttgaaccgagctttcggaatttcgacaattcgtgccgtggagatcaaacaggaattggacgcatgtttgggtcaatatccggaagtgttccaggacggtgtcggacgatgcaaaaagatggcgtcactgaagtttaaagagggatgccaaccgaagcgatgcaagccgagacctgtgccattttcacttcgcaatgaagttgaaaaggttttggaccaatggcagtcggagaaaatcatcgagccagtggcaaccagtgaatgggccactccgctggtcattgtgccaaaggcaaatggcaagcttcgactgtgctttgactacaaagtcactgtaaatccatgcttggatgtgcatcaataccctcttccacgccccgaggagctgtttagcatcttgaatggaggcgaaaaattcacgaaaatcgatttgaaggacgcatatttacaacttttgcttgacgaaaaggccaaaagttgtctcacaatttgcacgcacaaaggacttttccacttcgctcgattgccattcggagttgcttcggcacccgcaatttttcagcaagtaatggaagaagttctgcagggcattgatggcgtggcggtttatctggatgatattctgatcacagcagccactgatcagcaacacatcaaaagaatcgatcaggttcttaaacggttgtctgagaatggtcttcaagtaaagcatgaaaaatgtgagttcctcaaaccggaaatcgaatatttgggacacattgtggacaaaaaaggtttacatgcgtcacctggcaaaattgaggcaattttgaaaatgccggagccgaaaaatctgaaagaattgcagtcatttctgggaatggtgaactactatggaaaatttgtggcatccctggcaacgctttcagaaccgctcaatgaattgaggcgaaatgatgccaaatggacatggacaaagagccaacaaaaggcattcgatgtgatcaaaaaggttttgacatcaaccaaagttttggtccattatgacccgaaaaaaccactttttctggccgcggacgcatccgactatggagttggggcggtcatttttcataaagatgaaaaaggaagagttggtgtgattgcgtatgccttccgaacgctaaattcttcggagcgcaattactcgcagattgaaaaagaagcgagggcaatcattttcggagtcgacaaattcaagcagtacttgtacggtcgaaa

SEQ ID NO: 65100 - DNA, 779 bp, Heterodera glycines
  Genomic contig location: Contig_ID=SeqID_7519; Location=842..1620; Strand=-
  SCN-specific regions: Sequence locations=1-157,182-657,680-779
atgggacgcaaaaagacggaggcggtcacggttttgctgaaggatgcggggatagcggatcgcgttacgatggaccaatacattgcggagtacgacaaacacgtccttcaaatcatgcgcgctcttacggaggtgcaattggtgtgccttgctttcgcttttttaaaatttttgctttgctacgcttcgcttctttttatttcatttaatgaagtgtaaatgcaattgttaggaattgcctggtgccaccaaattgatcgaccatttgtacgcccacaacattccaatggccatctgtacgggatcggacaacgaggagtttgcaagcaaaatgcttaaatttgacgaatggcttaagaagattccgcttcgtgtgctgtgcgggagtgatccaggcgaatgaacgctcaaacccaatttgttttattgtaactgtttcagaggtacgcattggcaaaccgaatccggacgcatacgaagtgaccattggacgttttgctgccaaaccgacttcgccgaagaatgtgctggtgtttgaggactcaattaacggagtggaaagcgcgttgggtgcgggatgcacggttcgagtttaaaactgttacaatacggtacatcagcaaatttgtttccttgttcaggtggtgatggtgcctcagcgtgagtttctgccgaatgattggcccgagaaagaactccgttcgcgtccaaattttgccgccttgctcgattcgcttgacaatttttgcccgaagcaatttggattgccggattatcgc

SEQ ID NO: 65101 - DNA, 227 bp, Heterodera glycines
  Genomic contig location: Contig_ID=SeqID_7519; Location=3989..4215; Strand=-
  SCN-specific regions: Sequence locations=1-71,93-227
ggccggccaacgcctgtccatgcgttttcaagaacatcaggttgagcgaagtgtgggacgaatgttaggtcatttaaaacaaatttttaagttactaaatatggaagcacaaggagcaccggtcatggcaacgaatacaaaagtgcagattggaaagtgatacggcggaaacaccattttttgttgtattgtttgaatattttgagtttaatacattttgaaagata

SEQ ID NO: 65102 - DNA, 213 bp, Heterodera glycines
  Genomic contig location: Contig_ID=SeqID_7520; Location=720..932; Strand=-
  SCN-specific regions: Sequence locations=1-21,43-213
atggcagctaatcggctgcctccggcagagccggaggccgaggaagagccggaggttattccatggcaaggtaaaagtttatgccttttaaactaaatcgcctaacacaattcagcgcgtagcgcggatgacgatgatgatcatgatgatccggatgcgcccgacaattggcgaagtatgctatttattttagtgttttttcaaattgaataa

SEQ ID NO: 65103 - DNA, 224 bp, Heterodera glycines
  Genomic contig location: Contig_ID=SeqID_7520; Location=312..535; Strand=-
  SCN-specific regions: Sequence locations=1-51,74-224
atgacacagcagcaaggcgcaacagacactgaccttcgaacggtttgtttagtttttcacatttttaaattggacatcactccgttcagttccgcgactttttattccaatataacgcagtcaccgagcagtgtttcgacgcgtgcatccgcgatttcaccagcagagacataagcgagaaggaggaacggtgctcaaaaaattgcatggacaagtttttgaag

SEQ ID NO: 65104 - DNA, 333 bp, Heterodera glycines
  Genomic contig location: Contig_ID=SeqID_7520; Location=1739..2071; Strand=-
  SCN-specific regions: Sequence locations=1-131,154-333
catgaatctcgacggaatgtggtaatttaaatttccactttgggtagaaacattcgtctcactgcctttaatttaggcggatatcacctgttataaatgtggcgaaaaaggccattacgcaaatcgttgtacgaagggaattttggcctttttgtccaacaccgccacagcgagcgaccagcagagagaacagccgcgagacaatcaacagaagaaatacgccggcggagagggggggacgaaaacgcaaaatgacggacaggaaaatttcgattgatattttgttttgcaaatttatttgttgctatttccctctaagagagaagaactgaa

SEQ ID NO: 65105 - DNA, 495 bp, Heterodera glycines
  Genomic contig location: Contig_ID=SeqID_35567; Location=336..830; Strand=+
  SCN-specific regions: Sequence locations=1-129,158-495
atggtcgggtcacagacagccgatgcccatttggacgtacaatcggcacaaattgatcagttggacaccacactgaatgaccaaacattgcgcagcattgttgatgaagcatcgcaaaacatagacaggtattaaatcaattttaaaaataattattcactttaagggataaaataattcttaatttaagggattttttagcttagttaaagattattccaacataatccattaagagaatttttttttaaatttgggccaatttcttagagaattgcgtaatttgacttacgcttgctaattgcgtttggtttatttcattattctcatttgtcagggcaatttcgaagacaaatgaagagctgaaaataagcaatccgcaagacttgctgaaacattttaaatttgttggcaaacggccgacgagccaactgagccgagcgcgtgaaatttatgaggagagtttgcgcttgattgagaagcatgtcgaactcg

SEQ ID NO: 65106 - DNA, 4237 bp, Heterodera glycines
  Genomic contig location: Contig_ID=SeqID_7521; Location=529..4765; Strand=-
  SCN-specific regions: Sequence locations=1-26,57-206,228-321,344 -949,971-1136,1158-1215,1237-1444,1466-2069,2091-3273,3300-3337,3360 -4237
  Gene Ontology: Mol. function=coreceptor activity; Cellular component =integral to plasma membrane; Biological process=cell surface receptor linked signal transduction
ccgacatcaataaagccagggcatggaaattcagattttttaaaatcaaattatacgcatatttggcattatgtttcgacataaaaacaaaaaaagcggtcggggtcgttttcgcgccgccgttttcgcgccgtcgttttcgtgctgacgttttcgcgcgggggtcgttttctgcatttcaggctacggggagctcaggaaaaaaatagtgaaactataaatatcatccctattcataactgtgcttattgaccttagttctgttgttgcaatgattcctgactaaatttggcttattttggtcaatttaggaaccaaagtgagaatttaaaaaatatttttgttcgaaacgggttcgtggttcgaatttagtcgaaatggataccgaaaacccttggaagcatgtttttatgacattaaaaaaactttcttcaaaaaagggggtgatcccgagctaataaaacattggaatttcaaaaaaattttccttggaatcaaaatttaggttcccccgggcaaagttacccaaatggactgattcttttgcggataattgcctcccggggacgaaattggacagtgagcaaagggaaaacataacgaaagagcgaaggaatgaatttggaaaaaaacaaggcgtagataaaatcggagaaaaacgtaaattataaatggggaaaagtggaagggaacaataacaatgatggatgatgggatttggggggatttggggggagggcatttttatcagattagtgacgatggcatttccacttttagacttattgtaattggaaaaacgcaaagacaaaaaaataatatccaataaattatcaaaagatcgcatttctttttgcaaattacggaggaacgaaaaatttacataaacgaaaatgttgaaattcaatacccaaaaagaaacaaaaaatgagagggatttacttggaatttgttttttccgtatataatccaaatcaaaatccccccaatagtgaaaatggcgaatttatcctccggtgaatgcgttaatcccttaatttggcacagatggattagtggcacttcgccaatggtgaaagaacaatctgaaaaagtggtaaattgtaaaatgtgagaggaacgaggaaacattaaacaattataaattaagtattaggggaggaaattgtgcagagacaatcaaagtgagaaagcatttgaacatggaattataagtaatttttcattagaatttttaaatttcattgcatttttagcgatctctaatttccctttctctctctctctctcattcccatttttgtccgacaattgtcattatttgccgaacagatcaaattgccacaaaatatgccgccaaaaaggaaaaaattgcgacggactgaattggatgagaagggagggaatggcacagaaagaagtgccattgtttgtcgaagaattattttttcgttgaagggttttcatccgatccaaagctcgaataacaaaaaagccttatatttaaaaacagcgaatgtttttctgctttagtgccgccccaaatcactgcccaaccgacggaagcggtgcgcgagggcgaattcgtcactgttcgctgtgagtcgcaggacggaaatcctttgccgcgcttccaatggcttttcgacaaccgcacgcgggtgccggacgcgtggttccacgaacggcacgaaggtggcggtggaagcggaacaaagccacgcgcgataagcacgttacaatggcatttgacacgcagcgacaacggcgcctatttaacatgccaaacttggaacaaagcactgcgagagggcgaagtgatcaatgcggagacgaacagacttaacgtgagaaagggcgagagaagagagcgagagagtgaaagggaaacaaaatagtgtaaccaggaagagagaagacaatgaaacaaacgaaatacagaaacagacgaaataagaaaagagtgacagaacacaaaaggatcgaacagaaagtacggcatttgttgaacaggttttgtacgcgccacgggtgaaggttgtcccaacagtgcccgaattgaacatcgaggagggcgagctggccgagctaaagtgcaccgctgatgcgaatccacccgcaacaaatttcgcctggacgcatttgccgtcgggcgaaacgcacgccgaccgcgagtggcgcgtacacgtgcgacgcgcacacgcgggcgaattccgttgcactgccgtcaattcgttagactcggcttctgatcgcatccgtctcaatgttctttacgggccaaccgtacgcattcgaacagtcgccgggggcgcatcgggcggttcggtggtgagcccggcggagggcgatcggctggtggtcgactgcgaggcggacgccaacccaaaggcggacactatcgcatggagcggacctgggggcttccaacgtaacgggtcgcggttggtgatcgaagcggtcaatcggttggtctttttttgattggtattttctcattttgtttttccatcccattccagcgcacattccggcaatttcacctgcaccgcatggaatacgcttgccttgtcctccgtctccgcttctctgtccaaatcgccatcatcgtccgtcgcttcccccaattcggccgttgtcatccgtaccggttccgcccgagtgctcgtcgatgtccgtcgtcggcctggatcggcaacaatcagtgccaaacagacaacgcttaacgtgggcgagacgatcacgctcagctgcggcactgacggcgacgcgggcagtccgtcggcgcatttccgctgggcggggccgccaacgaaaggggcgtacgaacggaaagccaccgaatggaacaaagcgcagctgagactgccggacgcgcagttggcacacaacggcatcttccgatgtgtggcacacaacgaactcggccaaggcgaagaagcgaccgttcggattacggtaatggaaaaacgaaaacaaaacggtcggaaaattaaattgaaaaggttgtcgaacccgcgcggatttcgcgaatgccaatgccaagcaaaatactgaacaatggggccaacgatgtgaccatcgaatgtgaagcgcgaggctttcctcggccgtccattcgttggctgcgggacggagtgcaattgcccatcgaattgtttgtccattggacagtgacggaacgcatgggggacgcatccccggagtaattaatattcactattatacccaattaattcattagtcattcattgcttatttcctttaattaacattgtttgttccctcatttagtcattgtcttcttcttaattgtcccttttagttaccgcttccctttctcttttcccttaattagtgtcattaactcacttgattagtcgttgcctttccctttttcagttgtccttccgatgagagttgcgtccgttccattctgtccattctccgatttgcgcattcgatcagttgggctgacaagggcaattactcgtgcttggcccacaattcggccacttctccgcccgtcagcagtcaatcgctgctcagtgtcatccatcagccgattgcattgaatgaacgatttgtggacggattggcactgacagcggcagagattggcgcatcggtaggaaaattcgaacataatttgcatatggcaataaattaattcgaattaaggctcaaattgtgtgtcggatttcggcacggcctgaaccaaaagttacgtggagccgagacggaacagaaatcggcacggaatttggagggggcgattacaaacggcacatttcgcgggtcaaaggtcagtgacgcgggaggggggaggggggctgtccttcacttttccctctccgttagatgccgtagacgagtttgaggcggttttggagctgagagaggtctccgaacagcactttggcgtgttcacttgtgaggcgaggaacggagtcggggcgaaggcggcggtggacattcgattgcaggcaccaagtaaagtgccaaaattgacaaacggaagggcctttgatcaatccatgccattatttgttttcccctttttcggtcgtcctcaaacgccgcttcaggccaggcttattcagtccggcaccacttggcttatggtcggatggcgccccgccttcgacggcggtgatcggcaacagttcgagttggaatatcggctcgtggacccgtacaaaggaaaggccggcggagacggacaaacggacacttt

SEQ ID NO: 65107 - DNA, 6144 bp, Heterodera glycines; identical to SEQ ID NO: 7521
  Genomic contig location: Contig_ID=SeqID_7521; Location=1..6144; Strand=+
  SCN-specific regions: Sequence locations=1-44,66-88,125-1406,1429 -1466,1493-2675,2697-3300,3322-3529,3551-3608,3630-3795,3817 -4422,4445-4538,4560-4709,4740-4896,4918-4918,4944-5087,5112 -5298,5320-5615,5644-6144
  Gene Ontology: Mol. function=microtubule motor activity; Cellular component=spindle microtubule; Biological process=anterograde axon cargo transport

SEQ ID NO: 65108 - DNA, 239 bp, Heterodera glycines
  Genomic contig location: Contig_ID=SeqID_35573; Location=5..243; Strand=-
  SCN-specific regions: Sequence locations=1-138,160-239
aatgttcaacccgacccccactcgcagtgcggcccatacaaaccgaattggagggaagcggacggagccgactttttgtcaccaacaaaacaactcgataattcaattggattcggttttgtatggcataacagcatgaaattaaaaaaataatatttagataaagaggaagaagcatttggtggctcaaagaaccagtggagagaattggcattgttttggtcgattctgagggaaat

SEQ ID NO: 65109 - DNA, 75 bp, Heterodera glycines
  Genomic contig location: Contig_ID=SeqID_35576; Location=755..829; Strand=+
  SCN-specific regions: Sequence locations=1-75
tccaagtggggaattgaactcaggcgaaaaattatgaaaggtagaaagtttaaccactacaccacatgtgcaagt

SEQ ID NO: 65110 - DNA, 796 bp, Heterodera glycines
  Genomic contig location: Contig_ID=SeqID_35577; Location=177..972; Strand=-
  SCN-specific regions: Sequence locations=1-796
ggactcaattctcctgcatttcaatcactgggactcaaccctccagcatttcaatcactgggactcaattctcctgcatttcaatcactgggactcaaccctccagcatttcaatcactgggactcaacacaccagcatttcaatcaccgggactcaattctccaagacttcaatcactgggactctattctcctgcgtttcaatcacccggactcagtttttatgcattccaatcaccgggactcattctcctgcatttcaatcactgggactcaaccctccagcatttcaatcactgggactcaattctcttgcatttcaatcactgggactcaaccctccagcatttcaatcactgggactcaattctcttgcattccaatcactgggacctaacctcacctggtccttcggcattccaatcactgggactcaattctcctgcatttcaatcactgggactcaacacaccagcatttcaatcaccgggactcaattctccaggacttcaatcactgggactcagtttttatgcatttcaatcacagggactcaattctcctgcatttcaatcactgggactcaaccctccagcatttcaatcactgggactcaattctcctgcatttcaatcactgggactcaaccctccagcatttcaatcactgggactcaattctcttgcatttcaatcactgggactcaacacaccagcatttcaatcaccgggactcaattctccaagacttcaatcactgggactctattctcctgcgtttcaatcaccaggactca

SEQ ID NO: 65111 - DNA, 1357 bp, Heterodera glycines; identical to SEQ ID NO: 35578
  Genomic contig location: Contig_ID=SeqID_35578; Location=1..1357; Strand=+
  SCN-specific regions: Sequence locations=1-875,897-1060,1084 -1154,1177-1335
  Gene Ontology: Mol. function=cleavage/polyadenylation specificity factor activity; Cellular component=mRNA cleavage factor complex; Biological process=mRNA polyadenylation

SEQ ID NO: 65112 - DNA, 1327 bp, Heterodera glycines
  Genomic contig location: Contig_ID=SeqID_7522; Location=143..1469; Strand=+
  SCN-specific regions: Sequence locations=1-62,85-817,874-915,949 -990,1012-1129,1167-1327
atggcagaccgtaatttttcaactaaaaaaaccagcataagggaattatatttggaatgtaaaaaaattttatcctgaaaaaaaggttttttttataggcatttttggtattttactttttgcgagttttcgccggaattaaaataataaagatatttttgtacggttgtgacgattagcgccgctgggaaattttgaatttttacgatctaatagatttgtattaatgaattgttgagaaaatttaaaatgagaaaaaaaacgaggatttcgaggtcaaaaaattgaacgaaacattccgaacaaaaaatttcaggtaaatcacacaatatcataagtttagactttcattattaaaatgcttaaatttgcaggcagttttcgacggacaacagttgcgcaactgcaagcaaatcaacaacacgaagatggacaacaaattgcagctgtttctgccaatagccacctgatgctggcgcccgaatttgccgcagtgaaatcggcactaattgtccaaaaggcattccatcgatttgcactaattgtccaaggcaaaccgacgaagtgatttataattaaccaattattgttaaggtttcattgccggactgacttttggccatgcattgttcgcttttttcgtcgccgatttggttttggaccatttttaaatttagtaatttttgggttaaaatatttacaatcatttgtagcattttctgcaaagcaatgtgtggatgactgctcctgtccatggctttttccacttttgtcttgcgattggagttgtcgatgcgctggacaggtgacaaaattgttaataatattttatttttaaaaattgtttaattttattaaaaattcaaataataagcaaattaatttcaaaaattgtaattctctttttgccaccactttaaatctttttattattaatttttttttaatccaatttcatattgttttaggtttaagtttgtgacagttttccaaattttttgctctcttccgtccgttggcattttggcctgcttttttgcttttttggcatccatttcgtctgcacaaattgagcaactgttggcccaacaaacagagaacgaagacccaattctttggtacaataaccaaattaatatatttttttacattttataattaattttcacccctaaagggatgttcaaattttgttcaccgtttggcaactgttaagcgccgtccgttccgtcagcgctctgttcggatggcttacaatggcatttcgcccaacggcaaatgccacgcgcgaaactctctccaaaatgctgccgtcaaattcaatgaa

SEQ ID NO: 65113 - DNA, 848 bp, Heterodera glycines
  Genomic contig location: Contig_ID=SeqID_7523; Location=466..1313; Strand=+
  SCN-specific regions: Sequence locations=1-2,24-156,315-345,409 -580,635-651,714-791,814-848
atgaataaattatattttcccttattatttgttgccacaattttcatttatgccgtcgcattacctcgccttaatctgccgattaataagcacaaaaacaatactgaacatttaacaaaaacaggtattttgatctaaaaacataaaattttatgcttttttaaaattaatttagttcttattttttactttataaaatttatattttaatttggtaaatttaaaattatttattaaaatgttatatttataaactatttaaaaataatgtgttttataaataaattatatgatttttttttaatttaaatattcaaaaatggtaaaacatttcccatttagaatatcatcattctcagcatcaacaatcgtcaacacgttcatcatcaccaatcatcatcatcatcaaatttcccatttttggcacaaggcccaacgccagattatgtgcaggaagccagcgaaaaggcacgcattgaatactggaaaattttcactgatgacaaagggcaaatgccgaagggcgaattgaaagcgatacgattaaaatgggcggaatgccacggcatgagggtaagagaaataaaatgaaaaatttaattattaaacaaaatataatgtttaatgaaaatttggtggggggggggcgggtattaaaaaaactaataaattattgaaataatgacaataatttattttaaaatattttatttggtcggcttaaatttttttgcagaagcagaccgataatactttttttttgatagataggtaccaaataaaaaatttaagaatttgccgaaaatttttatttttagatcttgaagcataactttaaaaaaaactaa

SEQ ID NO: 65114 - DNA, 615 bp, Heterodera glycines
  misc_feature (605)..(605): n is a, c, g, or t
  Genomic contig location: Contig_ID=SeqID_7524; Location=30..644; Strand=-
  SCN-specific regions: Sequence locations=1-148,210-224,246-310,332 -377,399-426,448-615
atgggtgaaaaaggttatccagagttggctgatgccaatggcgacgcccgaattgtattcaagggtcgagaaaggcatttcacatgtgcctggcaagccgagaaggcatggaatgcacccgggagtgtctggaatgaaaggcgacaagttaataaatttaaaaaataatctgatttttaatttatatgaaaataattttttttttttttgaaaatcttgaaggattttttaaaagaacaaaaacacaatatgataaaaatgcatttgtttgcacatattttggcattttcgaaaactatttaacgaacaaatttctttcttccatcatcataggtttcatctaatttctttgcaattattttcttgctaaactgtttgtttcatcaactttgaaaatgcttcatctttcttaatttttatttttagattatttccacaatttaaattcgcttactttggaatatttttgcaccaattcctttctatttttttccaatccgtaagcgctctttctcctattttcaatttcatagcgtttattttatattaatttttggatttcgttcttttattccaaatatttatttcctatttttaaatttatntctcattaaa

SEQ ID NO: 65115 - DNA, 112 bp, Heterodera glycines
  Genomic contig location: Contig_ID=SeqID_7524; Location=1058..1169; Strand=+
  SCN-specific regions: Sequence locations=1-4,35-112
atggaaaatatttttttcaattttattttatttaccatttttatcgtttttatgaaagaaaattgttttgcatgcggtaccgatgagtgtccaattgactgcgaagacaaat

SEQ ID NO: 65116 - DNA, 2118 bp, Heterodera glycines
  Genomic contig location: Contig_ID=SeqID_7525; Location=1350..3467; Strand=+
  SCN-specific regions: Sequence locations=1-5,38-717,741-775,812 -850,872-961,984-1378,1400-1648,1670-2097
gtatttcttttgcattttcaaaatattaatgagtctttcggagcttttcctaaaggaactgataatggttcagaaaatacatcgtgatctgatcagtggtccaaatccggtgaatttggcacaactttacaacaattttgtagcgacaaattgtgctccattgaccagaacgaatggcaccgaaattggacaaattggacatgaacaacagagacaatcgccaattggcacaaatttggccagctcttcacgacaaactcaaacttggccaaatggtctgcatcggcagcaattccgtactgatgaaaaacgaatgcccaactcatcacaagtaggggaacctgacgaaaaatcccatttggccaaaatgccgtgccaaattaaatttcataaaaaagattggcttagggtcagtcacaaagtagggcgtgtaattatatgaaaatccatattttttttcctaaattgtggaaggccggaaacgcatgaaaacatgtttttatcttggtttgaagcttctaggatagagttctatactaaaattttccatatttcgcgatttatgtccatatttgtatattttgacattatgtccatattttcgcattttttataaaaaattctcattcgaattcttcctttattaaagcggccctttgtcccttaaagccggaaaaattttcaaaaaaaaatttaggattttttgagaatattaataaaaaatatctacaaaattggagatttatgcaaaatagtctaaaatggaatatttacgatttttaattaataaatttaagctttattattatttgattctaaaatgatttttaacactatatatagccattttttaaagttttactttacatttagcgaatttgaagaaatattgagaaatttattgctcaatctagaaaaaaattatgtccatattttatgatatatccataaataccagccctactgataagaaagatttgaaaaatttacacaatttttgaagaaaaaaagattttttgttcttttctctaacattaaatttcaatatttttgtgttttccattattaattttttttaatcatttacaaaaatatgttgtcaacaaatttggttgaataaaaatgttaaatgtttttcaggcttctcatgtgactgcttccggtgttttggcgccaataaattcattaagccatcatcataaaaatccaagtgtacaaacaaatttgcccgcaaataaaaaagatcaaaatgcagaagtgaaggaacaatttgaacaacaaagtacatcaaatgccactcaaatgccttttgaattggcacaaattgtggcaaaaagtgatcagcaggagaaaaatgggacaattttaaacagaaaaacatcaaattcaatgccacaaattgaggcgaagaaagtggaaaatttgaaccaaggcgcgggaaatgatcaggaaatagatgaaatcgatctgttcatcgatattgaaacgattgacccctttgatcagcctgaaccgtcaaaaagattatttgttgatcgaattcaaccaaattggaatgatcgacgtcagtgtttaaatgtgattaattcagaaagtgtcggaacatcatcaagttttgagcggtcaatttacgaaagtgctgacaatgagtcggcatcatcatcatcatttgatcattgtggtcagaatgcgaatggagaaacagaagaatcggcaataatggacaaaatatcaaccaaaattgatcatttggacaatgattgggaggattttgctaattggaagaaaagcgctgggataaaagttgaaatggtcgaaaacaagcaaatagaaaacaaaagttgtaaagaacaaatttggatcaaagaagaagtttcggagtttgatcaaatggtggaaaatgatcagaatgccaaggaaaatgaaaaaataaaaagtgccaacgatgaaaatgaaaacggtgccaaagaaaacaaaaaatttaacagaaacaaaaaaattgttgtacaaaatattataagaaagtgtgaatgggctgaatgtgaattgaaatttgaaaatgacaacaaattgtatgatcacctcaaaacagtttagttttttaaaaaggaaatttaa

SEQ ID NO: 65117 - DNA, 819 bp, Heterodera glycines
  Genomic contig location: Contig_ID=SeqID_35584; Location=145..963; Strand=-
  SCN-specific regions: Sequence locations=1-206,228-370,392-506,528 -659,686-768,811-819
gaaacaaaaaaatcgatttttcaagtgtccgttggggtactcaaacaattatggggagcaaaaatccaacgcagaattaaagtacagggtatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 65118 - DNA, 504 bp, Heterodera glycines
  Genomic contig location: Contig_ID=SeqID_35586; Location=136..639; Strand=-
  SCN-specific regions: Sequence locations=1-1,23-31,53-125,147-162,184- 257,286-426,448-504
caaaagttttttacaaccacttattgccaatataatttcttgcagattgaaagccatccattgcctgccggtctcggcacagcaaagcactaatagtgtgtttgactcacttcaaaaaataattcattacccaaaagttttttacaaccacatatttccaatctaatttcttgcagattgaaagccatccattgcctgccggttctcggcacagaaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgattc

SEQ ID NO: 65119 - DNA, 680 bp, Heterodera glycines
  Genomic contig location: Contig_ID=SeqID_35587; Location=482..1161; Strand=-
  SCN-specific regions: Sequence locations=1-244,267-324,370-475,498 -510,566-680
atgataagctttcgaataataccaaggttgtcgaatttcaaaaaaaatagtccaaaaacttaggctggcgccgaaacgatgcagacccattaatttattgattttatttttacatattttggtttgggttcgggaattttttttacatgttttatggtacacataatttgcttttttatacaaaaaaaaacatttaattctaagcctatttagatttttatggcatttcgtgttttttgacacttaacgcatttttattcatattttaggtataacatttataaaatttttagaatttgtctccctaaaaaggatatgtgtgcgattattatttaaaatgcaattaataaaattacaaaaatttttatagaataactgagaaaccaactggactagagcaaactgtgggcaaaaaagagttgctgtttttttatgtgtgccttcttcgacggatgaacatttttttggatatgccaaataaagaaaaaatattttttgaatttcatgaggtattaaatatatttatataaaaatattttaaatatttaaaaataaattttttttaggaaactgtcgaattgatacaatttatcggccagtttataacgaaattcatgtttgaattaacccaaattcataaaatggaccaagtcggggtaagctcaaacggagctgtctaa

SEQ ID NO: 65120 - DNA, 3078 bp, Heterodera glycines
  Genomic contig location: Contig_ID=SeqID_7526; Location=457..3534; Strand=-
  SCN-specific regions: Sequence locations=1-34,56-325,348-485,507 -555,583-1086,1110-1242,1280-1308,1718-2025,2047-2181,2203-2364,2387 -2944,2975-3078
  Gene Ontology: Biological process=N-linked glycosylation
atggatgagtcgaaacgggaaaatttttcccctcaaaatgatgatgacgtcatcacaattggagacaacaacaacactcaaacactgcttgacctgcaaccggggccctcaaaaaggggacgcaagcctcgcttggacaaaatccatgaggaaattgcttccgcaatgaagaaagcaaaagccatggaagctgaaggtttggctttttctgcaaatttctttaaattagccaaattttagtggatgaatcgcccaaaaaacaaccgaccaatgtgtttgagtacccgaccatattttggaaattggcccgcccaaaggttttggctaatatttaatttgaaaaaataggaaaatttcttaagtatggagtgttcacgttcatgtgcaaagagtgtcgtgatgacaatttccggcaggggaacagccgattcaaactcatcaatcagaatggcgagcagcaacgccttgagttcacccaatcgttttgccaagactgtgcaaagctgaactttgactgcaccgatctgatcatgaagcacctaaagaaggatgaaccggcaacgacgacgacgacgacgacgatggcaaagagtttccgctggatcaaagatgggggaaagtgaaccgagatggcacaccacgatataaggacgatctcattttgaagaatttatacttgttgatcaaatgacaaactctttctttgtaattttgccgagcaatacgccaggctttgttggaaataaaacaaacaaattcaaagtgcacttgccaaagaagttggtgtttgatggggccgggtggatggttggactgtctggcataatttacccaaacaggtgggcgaaaatcatggctattgggtccgatttttggcttaagttgggcaaagctgggtacatcagaccgacaatatgtgattgttcacctgcacgacggccgaaaataccgtttccgtgtgccaaagggaagttttctctcgccacagcagcttgagaggggcattcatcatggcatgattgccgaagtggaacggctgttgacacgaaaaaggtccgcaccggtgcatgcaagttttgggaacattgacgacgacgatgaggaggagggcgagattcttgacgtctcgtttgttgaggaggaagaagacaatacgggcgaagcgcccttaaacccactttcatatttgaccaagcaatcagcggctcaacaagaaacgttgcggcatgaaaaatgagcacaagaagagagaaagcgaagggaagaggagcagagaaagcagcgagaaaatgaacgtagacggcgagaagaagaggagaggcgtcgtaagacagaagaagatagaaggaagactgcagagaaagcagccaaggaaaagaaggcaaaggaagagaaagaggcaagtgaaaagaaggcaagggaggaaaaactggcacgggaaaagaaggaagagcagagaatagcaaaggaaaagaaaggcgagaaagagaccaaggataaaaaggctgaggaggagagagtagcaaaggaaagaaaggcagaggatgagagagtggcaaaagaaagaaaggcagaggaagagagagtggcaaaagcggaagcggagagagtggcaatggtaacaaaggcagaagaggaaagagcggcaaaggcggaagcggagagagcggaaaacgagaccaagaaaaagcaagaggaggaaaagcagttggaagagcttaaacgacagcaacaggccataagaaagcaaaaagagttggagctgctcaaagagttcagaccgtggcgaggcgggtacatgaggctggtgcacggcaaagacccaaccccagacgtacactatctgcacgaaacggatgattaccactttgtgaatgctgtacacaagtaccgtgtccggcactcagagctcccctgggaggcgcccgagtttaacccatccgcgcacatccaacagaatattggggagttccgtgagctgtttgagcaagaggtgtacgatgaaaactatgcggtgaaaacgcgagaggaaaaggaggagctgatcgagctggtcaaagggttccgcttttacttcaccgagcaaattggcagatttgagctcaaagttttcaacgggaaaatttcgcacattacgctgactgatcagctggcctacgtgttgggctatgaacaagagcagcagatcagaaatgaagagcttgcaaaatatgcggttgatttgggtggtggtgtgagccacctgtgcatttacctgaacagtggcgtcattgagagcatgattgtcggcaacacctttgccaatctgctccaagtgattgccgttgagggaaagtcgggtagtgtggtagagaaggacttccaggcgccgttgtttcacaaaatcatagcaagggaggtggatgtgcttgacgttgagattcgcactctgaccgggaggttaggctcttcagcagggcaattatttctaatcacttatttaagggaggtgccatttgagtttggccaagttgttttgactcttcagtttaaaaaggtgttaacgttctgagagagatggttcgcgtgatttttgacggctcaaatttacggctcgagaaaatttatccgcaaagtggaggcggtggaccgatcagcgtctttgagggggcaccaacgtttcagcggggatacggttatttcttgggtgtcccccgacagaagggagcaggagttggctctgtgctgcgcaacctgtggcgctaccttcgtccaatggtcacagcggcacgaccctatgcagcaaacattgctgccgagattggcaaagagggcctcgagacgggtgcacgattcctcaacgaggtgtcaaagggtggcaacatcaaagacgcgctggtgtcggaaggaaaagagggagcgaaaaaattgctggacaaggcctcttcatcactacaaaagggacgcggaagaaggaagagaagaggaggcgggaaaaaagctgaaatcattttgaaaccctcagacgttgttggacaaactgtttcccaaaaagctctgttaaagaaaaaaagatttgactcactcggttattattag

SEQ ID NO: 65121 - DNA, 547 bp, Heterodera glycines
  Genomic contig location: Contig_ID=SeqID_7526; Location=3883..4429; Strand=+
  SCN-specific regions: Sequence locations=1-547
atggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattcagtttcggtctaacacacatgcgttcagaggttaaagtccaccagtatttctacataaagcaccggatccgcctactgtaccctcagctgaagtgcattgttgagtaccacaacaagggccactgcaaatactatcccttgggtataaaattttgtcaggaaaaaaatcaataatcattttcagagttgttggccgttgaggagggcggtgagagtgaacccgtcgaaagacctgccgctgaaaccgactacctggactacttgaactttcgcagtgggtggcaatcaacactctactga

SEQ ID NO: 65122 - DNA, 982 bp, Heterodera glycines
  Genomic contig location: Contig_ID=SeqID_35592; Location=215..1196; Strand=-
  SCN-specific regions: Sequence locations=1-374,410-543,565-693,715-982
atggcatttttggacagtcgttgggtcagaattgaaagacccaaacaacaaaaaattatgtcattaaacgataaatgtgaaaaccttgttcggttctcgagtcaaactccgagtgcgtcgtgttttgctcatgttcaccgccaatgcgatcatttttcatcccatttgccgctttgtccgcagcggttgtgccgatgtcgtcgtcggcattgttgccgttaattccgtcacatttgcgctttttgttgttgctggcaccggcacagtccgtctttttgccggcatcggtcccgtcgccagtgcccggggcggctgcgattggttgacgccgacaaaatgtgtccaaattggtgcgaaatgtgccgagttctgggtaaaatatttatttttaaattaataataaatataagtgggaagtggaatatggaaagagacaaattggcaacagtttcctggtttttgagtataactcatttcatattagtgcgaattgaaccaatctattatcatttggtaactctaaattatctctattaggaatgcaaaaatttccaaaaaatttcgttgtataacaaaaaaaaaaaattatgaccaaaaaacttaaaaaaaaacaacaacaactgggttttcgagtattttgacaataaccaatcattatcatttatagccctaggctttcgtctattgcctgtaaaatttgtaaaaaatttgttagtcctcagaaaagttaacaaaatgttcagaaaggcaagaggacgaaccatgtaacaaatttactaaattaagaattttaggaaaaaaaattaaaaatccgacggtgccagatatatgcattcgtggaaattaattaacattttacaggaaatgaaaacctttttcagtgctgaaacagatgacaaacgcattgagtgaacacagtgtgccattgttgggctcggcaggcggcgtcgaattccgtcgacggaatgcgattgatttctaa

SEQ ID NO: 65123 - DNA, 588 bp, Heterodera glycines
  Genomic contig location: Contig_ID=SeqID_35594; Location=92..679; Strand=+
  SCN-specific regions: Sequence locations=1-68,105-142,213-325,349 -353,442-467,492-588
atggaaatcaatgaattttcattcagcaacaagtggaagagcaaagtgaaaatagagggcagagcaggtaaaaaatttgaaaaaaattaattaaaattaaaaaagcgaatttagacacaaagcacagggactgaatcgaactgagagaacagagagagagcaagagtaagagagagagtgagagagaatgggaaaacgagagagagagagaggagaatagaaaaaaggatttcaaattgaaatagcctaatccaacactttttttgttaaaatttttcaatgggtcataaaaagagtgatattccgctagatctaagttaattttccagggtgtcatcaaattttttacaatttaaaatgacacaataaatgaaaattttataaaattaaatgaaatgaaaaaaaagaataatcaattaaaaaaataaattaataaaataattaatttaaagcaaatgacgatttggattttttaaaaataaaattaataaggctggatatttatttatgtgtttaaaatcaacgcaaataggtacctaaaaatgctaaaaaatatagaataggtgtttaaatcccgaaaagcccaaa

SEQ ID NO: 65124 - DNA, 451 bp, Heterodera glycines
  Genomic contig location: Contig_ID=SeqID_35601; Location=178..628; Strand=+
  SCN-specific regions: Sequence locations=1-36,58-451
atgcttggctcggcattgttcaaaattcgcttcccgctcttatcaaaagaagatttttcgggaaaaattggtaaaaaataatatttcttttagttacaaatctttttctaactattcaccagtcgtttccatatttacagttccatccggcattttaacaacaaacgaagtggtcggcgttgaagaatatcataccattcagaatttgcaatttccgagtcaccagcgaattaaggcatttggaacattattaatggacattgaaaaagtgtccgaatttgcgggagaggaagttgggagcaggcgacacatcgaaaatgtgtacataagtggactttcatggataatattggcacaaattagaatgaaatggagaagcactgacaatgagaaatgtttgggaatttatcttttgtgcaccgagccaaaagaaggtgcaattaactcttaa

SEQ ID NO: 65125 - DNA, 1403 bp, Heterodera glycines
  misc_feature (14)..(14): n is a, c, g, or t
  misc_feature (34)..(34): n is a, c, g, or t
  Genomic contig location: Contig_ID=SeqID_7527; Location=964..2366; Strand=-
  SCN-specific regions: Sequence locations=1-218,263-387,409-571,621 -621,690-720,754-859,892-1403
aatctcgacattcncatagcaattctgcagtcgnaagcgcttaagccgcgcgcctcttcactgttcttttggtttgctttgctcgcctttgcgatggtttcgattgcgtcggccgccgctggcacagtgttcgcaagcggtcgcattcgcagccgacaacggcgatacgcaaaaacgtggaagccggaattcccagcacaagagtcgaaaagtgatccataattttgaattacaaaatttaatttcttatatattttaaaatggaattttcccatttttagtcgccaaaaattcgctggcaactttgtgcggtggggtcggccctggccactatcagccgccgctgattgacggcaacacacaacagcatctgttcaacgcgtacacgcaacacaaccaccaccagcaaaatgcctaccaattccatcagccgcagcagcaacagcaatatttgatgttcaatgccggcagcatcagcacggacagttgcgcgtcgtctaccgccgcgtcggccattccgctgattcgccacgcggacagtctgaacagtttgacgagcaatgtgcacgcaaacaatgccatcaacaacaacaacaaccagcaacagcaggagcatgggtgaaaaaataaaataatttaaattaattacatttatttttggtattatttattttaattaattatttaaactctcaattatttgagaactttcctcttgggataaaataaagaatatataattttaaaaattttcagtcaatttcatcagctaactgaccggaagcagcagcattttgggcccgcccaatatcattcattagtctctcataacaaacagcagacaattcactcaaattcgtaataataatttttattattttttaatttataccctttttcaagtgtccacccccatcatgctcctcctgctgctgctgctgctggtacgtattgctcacgctcgtcctcctcgggcattggcggatcatcgacggaacattctccgatcggtaaaatctttttgaaaacgatttaattttgattattagctatcatgcataacattcatttgttgtcagattcgcacggtcgaatggtcgaagacatggaaagacgaaagttgttggcccaccttcgtgaaaaggccctcttttctccgattggactgttagggcttgaagaacggctggagcctcaactcgtaagttaaaatggaaactttgtttattataaatcaaaatgctaaacaggtgaatgcacctgatgagcgtggtcgaactctgctccatttgctgttccaaaacccgaacttcaaggcggacgacgagcagtgcctggtgaacaacattcagttgctgttcaccaagggagccaaaatcaacgcgttggacacgggcgagtga

SEQ ID NO: 65126 - DNA, 623 bp, Heterodera glycines
  Genomic contig location: Contig_ID=SeqID_7528; Location=970..1592; Strand=-
  SCN-specific regions: Sequence locations=1-68,97-201,318-437,459 -480,502-623
atgccaattgaaagacattgcgaaaacggatgccgaaatggtggaaaatgcgggaagacgaagggttggcaattaaaatccaaaatttatttaaactttaaaatcatcatcagatggctcgtggggatgcaaatgtttgaccggctttgagggagaacagtgcgaaattgagcgaaatccgtgctcaaaaagtacacatagaaaaataattttattaattttgaataacatttcgataccaataaattaaaacaaaaataaaattgcattaattaaaaattaatctgaaaataataaaaatattatttattaaattacaggcccatctccgtgcaaacacaagggcaaatgtgtgaacattggtaacgatcggtaccgatgcgattgtgccccgggttggattggcctgaattgtgaagagaatcgcaacgactgtgaaaaaatgtggcaaaaataataataacatttatatgcatgccctttttaattttatttttttaagtgtctgtgccaacggcggaaaatgccacgacaaagtcaaccatttccaatgcgaatgttcgcgcgggttcactgggcgccattgtgaagtgattttctgggcaacatatttatgaaataaa

SEQ ID NO: 65127 - DNA, 449 bp, Heterodera glycines
  Genomic contig location: Contig_ID=SeqID_35602; Location=255..703; Strand=+
  SCN-specific regions: Sequence locations=1-449
agggatctgttagctgtcaaagtcactgttcgcttcaaattgccttcctgcgtcggactcggctcttccggtcagtgccgtttttgcccatccgacaaaattggggtgaaggcactttgaccaaaattcaattcccggcctcgaacttagtcttggtgcctgattttctctctcaatagattcgggcaaatattttagccaaaaatatccgtccaaatttgtgttccacccaaaatgccaatcccttccctcctcaggagcttattgcgtttgcattgcgcccgccctccttcagacggccggcctaatccccccgccttcggtgtccgccgaatcggacgaactcacttgggacgactcagtgctggacatcatccgcaagtggtcttccgcagccgagtcgctgatccacggccgcgcctctggcctggacgcggccatttgcactt

SEQ ID NO: 65128 - DNA, 751 bp, Heterodera glycines
  Genomic contig location: Contig_ID=SeqID_35608; Location=12..762; Strand=+
  SCN-specific regions: Sequence locations=1-160,184-230,266-306,329 -475,503-751
atgcgaattgtgctggccaatggcactgaggcatcttttggcccggagagtgccgaactgcgtgccgtcgcgtgcggattgggcgcctttggcgtcatcaccgaagtcgagctgaatttggtggccaccttcgacacgatcagctacaatttcgtcaggtatcatacacatatttcaaaagttgctataccgaacctaaaaaagtcgaaaatgggggggggggtaaaaagtttaataataataaatattcatgaaataatatattgtctctgaaatatttaattctttatatattcatagtcgtccaaataattgtctaaatttccttaaatttcaattcaaattaatttttgaattctttgaatatctgtaatttttttttttgaaattaaataccctattaatgaaacatttatttgatagagctatcgaatggcatatcaagaaaatgaatgtctatttggttactttgatcattttattatttattatttttaaaatagtttgtcacaatattaatttaatatttactttcatttctttctttttttttatctttgccccgttgaaacttttttcggtcggttaacatattttgaaaccaaattttcagtgctttttcttcattttttcaattgttcagtttgccaaccgaaagtctttacgcgcattttgacgaaattcagaaaatgggcaataatgttttgcttatgacatcactggcgaacgaaactttgtgggacaaagtgac

SEQ ID NO: 65129 - DNA, 601 bp, Heterodera glycines
  Genomic contig location: Contig_ID=SeqID_35609; Location=32..632; Strand=-
  SCN-specific regions: Sequence locations=1-209,234-314,341-601
atgcgcaaaagagcaatttctacccttggtatgtcctttgtagcgtttctgactttttttaaacttttccctttttgccactctcccttcatttgagtttttcttacttttccacttttcttgaggtcatcttgccgatgtcgttggtgacgaacaattcgaccgaatcgtggagaaagtccttggcacttgtgcagattctgaaactgagctcagttccctgaagacatttatcatttctgttattacaatttgtcgcacttcgggcgctcgctttgccaaatttttgccacaggtttaaatcaacaataaactatttaatatttttattataaattatcagattgtgccaattttgatacaaaagtgtgaatcggtggaggacgatgaattgcgcgagatttgcttacaggtaaatgcaattgaaatcagtaattgacatattgagagtgtttttaggcgtttgagatattcgcgtttcgttgtacgactgaattgtcgccatttgtgccgagcattgtgaagataagcgtcgaaatggtttcttatgacccgaactacaattacggggctgaagaagaaggcgaggagagaggaatgg

SEQ ID NO: 65130 - DNA, 532 bp, Heterodera glycines
  Genomic contig location: Contig_ID=SeqID_35611; Location=260..791; Strand=+
  SCN-specific regions: Sequence locations=1-126,149-507,529-532
atgcgcaacataatcattttcccgtgccacagacattgctccttgcgcgacgattaccgcggtgacactgatctccgagtacaactcgcccacggccaaaccatctacgggatcgattatctgagcttgttttggtgtgtatgtgttttccaagtggttttgttttttacttggctatttgtccttgattccaaggacggtttccttgaaaatcggcctttaattggcaggaaaactcgccgaacaaatttgctctctcccctccatttttgagttaaaaaaataaataaattcccaaacaaatgggaaaatatgttttacagcggaatccttgcatccatttcttcgaattccgaacccgagttcgatcgctgttcccgctgaaaaaagcgctatgattttttcgaatcttatattaaaaaaatttcgaggcggataaagtgcaccctcatattatctaccgccaatggagccccgaaatttgcggggctcccggtaaattggacattattggatataaaataaattaaaa

SEQ ID NO: 65131 - DNA, 2155 bp, Heterodera glycines
  Genomic contig location: Contig_ID=SeqID_7530; Location=71..2225; Strand=-
  SCN-specific regions: Sequence locations=1-4,26-127,150-1390,1427 -1878,1900-2155
atgaatggagacagtggagcccaagcaacagtcatcagcttcaaaacgtggatcaaattgggtcaacccaaactctctccaacggacatcgaaacccgcaactgcaatgacaccgcattttcaaccgaaggaaaattccattgcaccgtcagttgcttcgatcggccatccaaaacactgatcgcttacgtcagcagtgacttaaagcatgatttgtttggccttccgtggattgaggaattcgagctcatcccaagagaaattttgtatccaaagagcatcaaaggaaagccaaacgcgtcaatcaacgccaatgtcgtaaaggcaccaaacccggcgattggcatcacggacgaatcctcgctcaccgctgtgttgcaaaacgattttgaggaagtttttaagagcggacttggccactgcgcaatcaaagcgcacctgattctaaaaccggacgcccgacccatcttctgtaaagcacgaccagtcccccatggtgcaatcgaagctgtcgacaccgaactggaccgcctcttgcagattggcgcaatcaaaccggtagaattcagccattgggccgccccgattttggccgtcaaaaagaaaaatggaaagacccgggtgtgcatcgacttttcgaccggattgaacgattcgatcgaactgaatcgccatcctcttccgagacccgacgtcatatatgcagctttaaatggagccgcatttttctcaaacctcgacctgagagacgcctacctccaaatggaattggatgaaaaatcgaaacatctttgcacaataaacacccaccgcggcttatttcagtgccaacgtctcccatttggcgttaaatcggcaccatccattttccagcacttgatggaccaaatctgcgcaggaattccaggggtcttctcttatttggatgattgcctaatcgcctcaaagaccctggaagaccacgtcaatgcgcttcacacgcttttccaacgcatcaaggactttggcctacgaattcaactcgaaaaatgcaaattcctccaaaaagaattactttttctcggccacatcgtatcttcaaatggcatacgccccgacccagcgcgctcagaggcaattcagaaaatgccagcgccgcacgacaaaacgaccctccgttcatttttgggagcgctcaattattacggacgttttgttaaaccaatgcgagaaatcagggcgccattggaccaactcctcagaaaggatgaatcctggagttggggagatgaccaacagtccgcgttcgagaaagcgaaggcaattatggtttcagaacttctgctgacccactacgaccccacacttccgatcgtcgtagcggcagacgcgtcaaaagatggcatcggcgccacaatcagccacatttttccagacaaaaaggaaaaagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggccatcttcggctccaagaaaggcatccccatttatgccgccagccgactccaaagatgggccctaatcatggccaattacgattttgagatacggtacatcaacaccgcatcatttggccaggctgacgttctctcacgcctcatcgcaaattatccccgaccagaggaggatattttgatcgccaatatctgcaccgaaaccgagtgctatatcagcacactcctgcaaaccaagacggatcaacttcccgtcactgcagacgaaatcgcagaggcgacaccgaaagatgagattttaaagaaaattttggcattcatcaaatcgaattggccaaagaaaagcagcgacccggacatcgcaccgtattttccgaaaagggaaaacattttggaaatcgagggctgtttgctctaccaaaatcgcgttgttgttccccaatcgctccgcaaccgaatgctgaagtccctgcacatggcacaccccggaattgtgcgcatgaaggcactcgcccgccaacacgtctattggccgggcatggactcggaaattgaacggattgtccgtcaat

SEQ ID NO: 65132 - DNA, 2199 bp, Heterodera glycines
  Genomic contig location: Contig_ID=SeqID_7531; Location=88..2286; Strand=-
  SCN-specific regions: Sequence locations=1-1051,1073-1132,1154 -1390,1412-1590,1612-1835,1859-2199
atgagcgcggaccaaattaagcaactccttgaggccatgcgagtgcaatcggatgccatccaacagctaatgggccaagcaccgcaaaacgccgcgtcagcgagtctgaaccatgcaaatttgtcaagttccatcgacggccaaatttcaaaattcaattacgacgccgaaaccggaaacactttcgaacagtggttcaaacggtttggagttttgattgaggaagatggtaaggacctccccgagtcgacaaaagtcagactactactcggcaaactcggcgacgaggagtacggcaaataccgcgacagcatcagtccgacccagcccgacaaagtcacttgggtggactcgatcaccaagctgaaaggattatatcccgaaacgcgttcactatttgtccggcgctacgaatgtttcaaaattcgtcagcaaccgagccaggacatatcatcgctggtcgctcatatcaatgcgtcctgcgaaaacgccaatttgagtccgaccaaagaacagctaaagtgcataatcctggtcattgcactcaacgacgagcaccacgacctgaggcaaaagtgtctcaaaatgctggaggacgcagaaaagacaggcacggacatcactctccaaaaagtggaagaggagttgaaggcgattcaaatcgttaaagaaagtgccctttctctgcttactcaaccggtctcaaccagcgccatccaattgcgacctcagcaatggcgagagaccagcaaaggcaaacataaggcaaaaccgggacccaaatggccacaacatgaatcggcacccaaatcgccacatcatgcgccttcgcctaagcaaaaatcggacgacaaagcaaacagaggccgtccaccgcacccatgtgcatcatgcggtagcaccgatcattggcgatcggactgcaaatttgccaacgcattttgcaacaaatgcaaccggcaaggccacattgcgattgtctgccgtcagcgctcgtccaacacagcacccaaatttcaaaatcgatctttccacacggtcgtggccaagtcacattgcatggtgattggcacaacccaaggccgatggtggaagatcccggtaatgatcaatggcataaatttgaagatgaatggagacagtggagcccaagcaacagtcatcagcttcaaaacgtggatcaaattgggccaacccgaactctctccaacggacatcgagacccgcaactgcaatgacaccgcattttcaaccgaaggaaaatttcattgcaccgtcagttgcttcgatcggccatccaagacactgatcgcttatgtcagcagtgacttaaagcatgatttgttcggccttccgtggattgaggaatttgagctcatccaaaaagaaattttgtatccacagagcaccaaaggaaagaccaacgcgtcaatcaacgccaatgtcgtaaaggcaccaaacccggcgattggcatcacggacgaatcctcgctcaccgctgtgttgcaaaacgattttgaggaagtttttaagagcggacttggccactgcgcaatcaaggcgcatctgattctgaaaccggacgcccgacccattttctgtaaagctcgaccagtcccccatggtgctatcgaagcagtcgacaccgaactggaccgcctcttgcagatcggcgccatcaaaccggtagaattcagccattgggccgccccgattttggccgtcaaaaagaaaaatggaaagacccgggtgtgcatcgacttttcgaccggattaaacgattcgatcgaattgaatcgccatcctcttccgaggcccgacgtcatttatgcagctttgaatggagcagcatttttctcgaatctcgacctgagagatgcgtacctccaaatggaattggacgaaaaatcgaaaccgctctgcacaatcaacacccaccgcggcctatttcagtgccaacgtctcccatttggcgttaaatcggcaccgtccatttttcagcacctgatggaccaaatctgcgcaggaattccaggggtcttctcttatttggatgattgcataatcgcctcaaagaccctggaagaccacgtcaatgcgattcacacgcttttccaacgcatcaaggactttggcctacgaattcaactcgaaaaatgcaaattcctccaaaaagaattactttttctcggccacatc

SEQ ID NO: 65133 - DNA, 686 bp, Heterodera glycines
  Genomic contig location: Contig_ID=SeqID_35615; Location=52..737; Strand=-
  SCN-specific regions: Sequence locations=1-494,516-686
atgttttctcgccaaatgctaaagggatattatgcaaagcgtggatataactttgatattagaacactttttggtttgttacgcttttggactagggttgcaacttcaacgtcggggttgggaaatatcgggggtcgaggtcggagacaaatttcgaaaatcgccaaaaaaaattttggagacggtttgcaaccctattttaggaattattgcaacaaattacacttttatctttttattattttaagatggtattgataagcgaattgatgcgtgtgccaagggattcaacgaagatccggtggtgctttatggtaaaaaaaacaaacaatttttttaactgatttattaaaaaaacaaaaataattgttgtttttttgggctttcgaattttgccactccatcaggcggacagagactttcttgtacaaacaatgggcacagttatcaatgaattatgtccaaatgtaattctacaaaaaaaaatttaccggaaatttttttttttaatttttcgatagataattgcatttggactgctcatcgcccaccgtcaactcgtcacattagtacgcatgaaaaaactgaacttggacgcgccagatttcaacacaattgtggtaaataataaaaaaaattctaattttcaacaaaaaaaacaactaaaaatttcagaatctaattga

SEQ ID NO: 65134 - DNA, 49 bp, Heterodera glycines; identical to SEQ ID NO: 51181
  Genomic contig location: Contig_ID=SeqID_35616; Location=726..774; Strand=-
  SCN-specific regions: Sequence locations=1-49

SEQ ID NO: 65135 - DNA, 209 bp, Heterodera glycines
  Genomic contig location: Contig_ID=SeqID_35616; Location=658..866; Strand=+
  SCN-specific regions: Sequence locations=1-209
tgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccgataaatgtttgagtaccccgaacggacacttgaaaaaatcgattttttt

SEQ ID NO: 65136 - DNA, 184 bp, Heterodera glycines
  Genomic contig location: Contig_ID=SeqID_35621; Location=255..438; Strand=-
  SCN-specific regions: Sequence locations=1-184
atgcttttattcgaattcgccaaattcacattgttatccatcatatttatgcatttgttatgccaaagcgatcaaacggcggaattggcgcatggatcaaacggagttggaggtaaaggaagtgttaaccaatttcaagaaaaaataaatgaaatttttgaaaaaattttcagcgattttttga

SEQ ID NO: 65137 - DNA, 121 bp, Heterodera glycines
  Genomic contig location: Contig_ID=SeqID_966; Location=1466..1586; Strand=+
  SCN-specific regions: Sequence locations=1-121
ttattccgtctgtccatctcagagcggttcatttccaacatggttaatgggccattccgaaaaggccctttcatgattagcatgaccatttgtcatcatcgatggacggcagacccgtata

SEQ ID NO: 65138 - DNA, 3467 bp, Heterodera glycines
  Genomic contig location: Contig_ID=SeqID_966; Location=214..3680; Strand=-
  SCN-specific regions: Sequence locations=1-781,803-809,831-1226,1248 -2036,2060-2291,2313-2338,2360-2464,2487-2585,2607-2645,2667 -3099,3121-3239,3261-3413,3454-3467
  Gene Ontology: Cellular component=Golgi transport complex
ggcgaaatcagtattaattttcggaaataaactcaaataatttttttcttgtttttaggttctgagaaagaccgggtcgttggtcggattcagcatttgcagaatgaattgagtgatttggcctttcacaactaccgcacttatgtggacgtcggacgaacggccgaacattgtaaagaaatggtcagttatccgtggtaactttattcttatgtttgttctatttttaagtttgctgaaatgaatagctttttggtaaagctgaaagcggaattcccagacctaattgggtgtattaatctggccaattcggactcagaaaagttcaccgaggagtacaaattgctgcatgaagtcgagtcggtcagcaatatcatttggaaggtgttgcgtcttccaaaggtttttttatttgatgtcatttggacaaatattttggtcattagttaatggacaaatacattcgcacgggtcgttatgagcaagcgtattctctaacaaattttgcaatttctttaaagcaaagcaaactcacccaaaagaatgctatgcttgcggtaagaagttgtttaggcggaaaaatacggcactaaccatttattttcgcattaagaaagttgtcgatgtgttaatcgaagcacgccataatctccttaatgaattgtttagcaaatttgcgggtccgattgacttatctcggagcattcaggtttaaattgaaattctttggaatattaatcttcaaactgaattgtgatgtttacatgacggtttcgcatttgaatttttgattcttttgtgcccttttaatatttactctttcctaattgactcagattgtcaataacatcagaaagatccccttcatctcaaatatccaactcagagagtccattctccagtacagagacatttacatggacaaaaatattcagcgtgtcatggtaaatacgtcaaccttcggcttttacgaaaacagtccttttcagtccgaacccgacttctttttgcgtgcgattgatgtttacagggaatgtatgtacgacacaatcgtcctttacttggctgtttttcccgactgtgacgtgcaacataaaaaattcgttcgtccatggaaatttgaattgtttggataagaattatcacagttaaggcagcttctagtgaggacccgcgttgggagagatggactggcagttctcagaatttcctccttcattcgtgggcccagagaaacattgagagactctccagtcttttgcgtggatcggagaacaagaattatttggacatggaagtgatgcatacgaaggtatagggaaagggaatcgttactttgccaaaatatgcaacggaatggagttgtatcttcttcagctcatgagtttcgccttttcatttgggcggatggggttggacttcaggccgctggttgtcaacgaatttgctcaaatggttctggaaatatgcaggagaagggtcgaaacagcgaccaattggtacgaaaatatttataaaacttaacgacttggttgttatagtttaacagagttaaaaagacttgaccttattgatggggacatttttgaaaatactcgccaagactttgaggacagtggtcacccgtccattgatttgagcgttctttcggcaccgcttgaactttgcatttgggatgatatttgcgtgtttggcaatttgctcatcgacattttgaatgatttgcgtcattcattttcgattattcttgtatttacttaatgatttctcttctttattctgatgtttcttcttttaggtacgtcaagtttttggcatttttcttttttgcctgcaaaacgttttcaaatgggtcgattcttttctttcggtttctgctgaaattgtttctgccaagagggccatttctcttctgctcaaatatttcgttccgttcttcaaccgatgcttcttccattgttttccccatgagaaatgcgttcactttttccgatcttcacattgtcctgtggaggattatgtgagtgtcttttttgagtttcttctattttatccatcatcgagtccgtatccaaagggtgggggaatgaaaaatatacgggtctgccgtccatcgatgatgacaaatggtcatgctaatcatgaaagggccttttcggaatggcccattaaccatgttggaaatgaaccgctctgagatggacagacggaataacaaacatacaggaaaaggggaggtgctttcgcaattggaatttttgggtcaggtagtgtcggtagacgcgccgccgatttataaaataaaattgagtgcaatttactttttgggaggaaacgttgtgacccccatcatttttcatttatgataactaataacttacacatcatttccttttcagcgcaatgcattcaaattccgaagcaaaaccctttttgtattgtgtaaacatgaaagtgtcttcaatgaaatattgagtgatgtgcaaacgaacgaaagcgatgaccaacagaaatggcaaaatgaggagggcgaggggagggaaaagggaggaggaggatgggaacgaattgaacagaatgaaagtgaagcagaaacaacaaagacattggaaacggtggagcaatttgctgaagcaatcgacgaaggaggaaaaaatgaagaagcgcaatgagaaaggggaggacaaccaaccatagccaaaggggtttcggagttataaaactaaacttttattttatttgctatattaaagactatcataaattaatggtaaaatcttttggcaaattgacatttttttggttaactcgcctaatatttgtttcattttatttttgttaattttacggtttttcatcacacttttacacagtaatccaatgtctctcactacaaaattgcgaagattgcggaagaaacccccggagggatgggacttaattgaaccgacattggaggagttcgaggcgaaaatgcgagaggccgagactgaaccgcatgaggtgggctggcaatgagtgggtcgatcaaccattgttaaattggacaaaattcaggggaaacggaggactgagaccgtttggccgttgttccgggtgatttttcttctattaaatggcctttcatttcttttagatccatcaccagcgttcccgatacatttacgaccttttctataaggaagagaaaatttctcgcgaattataccaattttgcatcgatgcgagactaatcgacgcccaattggtggccaaatggaagaagccgggttttgaaaatttgtgttgtttgcgttgtattcagacgagggacacaaactttggaactaattgcatttgtcgtgtgcccaagtcgaaactcgaggcggtgggtaaaacattagtcggcattttccttttctggcgacacctttcattaccaccagccccaccaaaatttattttctttaaaaagtactgcaaaaagt

SEQ ID NO: 65139 - DNA, 1295 bp, Heterodera glycines
  Genomic contig location: Contig_ID=SeqID_968; Location=713..2007; Strand=-
  SCN-specific regions: Sequence locations=1-916,938-1035,1062 -1133,1160-1295
atgcatatatccaagcaaatttgtccaatttgggattctccagagtatggtttttcaactttattgaataaaaatttgccttttagaataaactgcaatataatgcagaggaggatattgctaaggcagaggcagaagttaacaagactccaaacatcgaattactcgaccatgagtacaagcggctaatcgaaattaaatgtgtcgaatttgaggatcttatggaaggaaaggcaagaactaaactcaaattttatagaagacttggttgaccacaataacaaattgaatctctcttttaagaaaaagcgaagaatactgacaactccgattttcttgttgaatggtatatcatttgattcctcttggtctgttgctaacgaatccgaaagaatttttacccgggactgaattggcaaaatgacttagggactgaaccgtccaacgtctaatctccaagaaaatatataacaatcggttcctctcgggaacatagtgtaaaaagttatgggctcggggatcaaaagaatagaaattggtgagtgtattttggccaaaacaccgcacactcgaatacggcggccaataggtggggcgagactacgggctagggaagaagtccgcgcgtgatccacaggcggttgactgattggcgggggcccccgcagtcaaccacctgtggcgctcgtcagactgcttcctccaccctccgtcttcgcatgctcaccaaggcgggcgctgcttagtcacgggcccataactcggcccaaagtggtttccgccaaaaaattctttcggattcgtgcattacagaccgagaaacgtcgaattaaatatcactcgtcgaattcggcgaggtacacatattctttaattttaccaccaattgtaccaaaagcaaacaattaggtatgaccatttagcacatcatttaataattagccaaaatctcccaatctactaaagcgtaattcaatttatttgcgtgcaaatacaaaacaggaaaagaatgtcattcgcgtccatttgagtgattgtggccctaaagagggccgtttgggatattttgtttttccgtccgatcaccaccgctttcatcatctcctgctcattttgacgaggtgtacttcgtcaccgccttggtcccctcggacacggcatttttggccaactcgccgggtagaatcagtcggacagccgtctgaatttcgcgcgatgagatcgtggaccgcttgttgtaatgggccaatcgcgaggctttcgtcgcgttgacaaaccttaaaatgaaaaataaa

SEQ ID NO: 65140 - DNA, 973 bp, Heterodera glycines
  Genomic contig location: Contig_ID=SeqID_968; Location=3414..4386; Strand=+
  SCN-specific regions: Sequence locations=1-254,276-813,836-862,884-973
atggctgcgaacttcgaccaattagtgagattgatgacgcagcaacagcaacaatttgaggaccaacaaaaattggtgcagcagcagtcgcaacaaattgcgcagttgctagcaaaccaaaatgctgcaaacatcgcagctggtcaacaaaatccgccaaatgcagttgccattccttcgctgccggacatttcgctgttcgaagtgtgtgatgagaagagtcgtgtgagcgaatggctcgaccgattcaaattcgccctcgactgcgccgcgccaacagcaagtgatcaaattaaggtgaaatcgctgatgaacaagctgagcgagatggctttcagcgagtatagccgatctgttctgccagcttcagtcacagatttcgatttttcgacgacagtgcagaaactggagaagcttttcgccaaaccccagtcaatcttcatcgataggtatgaatgccttaaagcggtgaggggagagggcgaggagtttcggcacttcataaatcggcacaaaaagctgatcaacgacttcaagttcgacgatttgaagaaagagcaattttatgcattaatgctcttaacggcacttaaatcgccgagcgacgcagcactgaggcagcgaatattggctaaattggcaacggatggacaaaacgtgtcgtatgatggaattgtggaagacctcatcaacttccaatcaacgattgcggaggctcgagcgatcgaaacgccgatcagctctcgaaatgttaatgctgtccaccaaaagggcaagaaaaacttcctgccgaagaacaaattccccaaaagtggacaaaccacaacggcgaacaaaagttgttggcgatgcggagaatgtgaccatcagccaatcaactgccgattcaaagtgacaaagtgtcacaaatgtggtgccatgggtcacttgggaaagaaatgtgaaagtgttcaggcatggaagaaacaacaaa

SEQ ID NO: 65141 - DNA, 3973 bp, Heterodera glycines
  Genomic contig location: Contig_ID=SeqID_969; Location=223..4195; Strand=+
  SCN-specific regions: Sequence locations=1-240,263-289,311-404,426 -1394,1416-2383,2405-3307,3329-3753,3782-3973
atgctcttaacggcacttaaatcgccgagcgacgcagcactgaggcagcgaatattggctaaattggcaacggatggacaaaacgtgacgtatgatggaatagtggaagatttaatcaacttccaatcaacaattgcggaggctcgagcgatcgaaacgccgatcagctctcggaatgtaaatgctgtccatcaaaagggcaagcagagtttcctgccgaagaacaaattccccaaaagtggacaaaccacaacggcgaacaaaagttgttggcgatgcggagaatgtgaccatcagccaatcaactgccgattcaaagtgacaaagtgtcacaaatgtggtgccatgggtcacttgggaaagaaatgtgaaagtgttcaggcatggaagaaacaacaaagtgcaaagatgatgggaaacaagaaaatcggacatttgaggatcggaatgacctcctgttcgatcaatgcactttcgttgatgcagatcaaaattctgctgaaccaacaaaaagtccaattcttcctcgacaccggatcggacatcgacgtgattgatgagtttacttatgccgacattggcaagccaccgatcgaagcgtgcgacgaaattgggaagacctttgatggaaaagaagttccattcattggaaaaggtattggcatattcaaattcggcgagattgaagtgaaacgaccattttacgtggcaaagaaaggctcacttaatctgctgagttgccaaaccatggacaaatttggtttgttggacgaaatgaagctgaagatcagcaacgtggcagtaaacttgtgcaacgccggccgcccaaagggagagaaaattatccccagtggcacaaaacaaatggccggcacagaagccaaaattgaggcattgaaaagggcctttcccgaagtcgttaaagacgggttaggactctgcacaaaggagaaggcacggctgtcgttaaagaagacgccgcaccaatttttcgaaaggcacgtcctgtgccatacaactctttggaagttgtcgaaaaagaattgggccgattggaaaagatggacgtcatcagcaaagtcgatcatttgaactgggcagcgccgattctaattgtgaaaaaggccgacggctcagcacgactttgcatcgactattcgacaggtctaaatgatgctcttctcgactgccagcacccgctcccagttccagaggatatttttgccaccctgaatggaggtaaaattttttcccaaatcgatctgagggacgcgtatttgcaaatcgaattggacgaagaatccaaagatttgtgcggattggccacacataaagggaattaccgaatggaacggttgcccttcggtgtaaagtcggcaccaagcatattccaatcaattatggataaaatgctggccggactaaattttgccaccgcttaccttgacgacatcattgttgtcagcgggacaaccgaacaacacgttcgacatttggaagaagtattttcccgaatccaagcctacggattccgagtaaaattggaaaagtcatccttcttccgagaccaaatcaaatatttgggtcaaataatcgatcggaacggacgccgaccggacccagcaaaaactcatgcaatcgctcaaatgccggctccaaaggacatttcgtcactccgatcattcctcggcatggtaaaccattaccaacagtttgtcaagaacatgcgcttcactcggaagcctttggacgacatgctgaaggatgacgttgaatggaagtggacggaagaacgacaaaaagcattccaaaaattgaaggaagtgcttacatcggaactgctcctcacccattatgatcctaaattggacataattgtggcagccgatgcgtcggaactcggaattggggccgtcatttcccacaaattctcgaacggacaaatgaaagcaattgcacatgcctcaaggtcgctcactccagcagagaaaaactactctcaaattgaaaaagagggcctggcattgatttttgcagtgcaaaagttccacaaaatgatctacggcagacacttcacattacaaactgatcacaaaccgctgatcagtattttcggaagcaaaaaaggcataaggcagtgcagcgcaaatcggctgcttcgctggtcacttactttgctggcctacgacttcgacattgaatatgtcaacaccaaagattttggtcaagccgacgcgctttctcgcctgattgccaaagaatttgagtgtgatgatgaacgagtgatcgccgcgtgtaacatcgacgaagatcttggaatgattttggatatggcaaaacaaattctgccaatcaaatttgaaaatttggtctcagagtccaaaaaggacaaaacaatgcaaattgttatgaaattcgtcagagacggttggcctgatgaacgcaaattggcgccacaatcagaagaaattgagcttttcggcagaagaaaagccgatctgacaattctgaaagactgtctgatgtatggcgaacgaattgtgatccctgaaattttccggaccaaaatcttgacactgctacacaagggccatcctggaattaaaaggatgaaacaactcgcccggcagtatgtcttctggccaaaattggatcaacaaattgaggaattcgtcaagaattgtgcaccgtgtcaattggccgctaaggcaccgacgaaaacggatttgcactcatggccaaaatcaacgcggccatggcaacgaattcatgccgattatgcgggccctttcttcggaaaagaatttctgattgttgtggactcatattcgaagtacccggaggtattcgaaatggccactaaatcagcggccgcaacaatcgaacgactgcgttatctcttcacacgtcacggtataccggaaacattggtaaccgacaacggaacgcagttcgccgctagtgaattcgcaaaattcacagaagcaaatgtaattgcacatctcttttccgctccgtacaacccaatgtccaatggacaagcggaacggttcgtggacacatttaaaagggcttttcgaaaaataaaaggggagggagtgccaaataaggaaatcatcaacactttcctggtcacttaccgcacgacaccgaacgattcgctgccggatgcaaaaacccctgccgaaatgctccttggccgaaaaccgcgcacaacgattgatctcctaatgccgcctcttccacagccaacggagagagacacaaaaatggagcacatttcaatcgccggtttggcgcccgaccacagaaatttgtgtcaaataagccagtttgggctcgacaccgactctcgcagaattggagagctgggacaatttgtgattgctccggagtcatctacacggtcaaattccccgacggttcgacaaatcgctttcatgcgaatcaattgagaaaccgggaaaacaccgaaaatggccatgaaccattggcaattttaaatgaggcattccatctgccgatcaccgcaccgaacgttggaattgtagggcaggaccttgagccaaggcctgacccgatcaacgatgagcaccaggacgagatcgaaccggagcaggcccgtcgaagcccgacaccgcagcaacaacaagtgccgcgccggagtggacgaaaccgccgagcccctgatcggtactcgcccggatgagcccaatcaaaaggggaggtgttcgggtgatgaccccgagagagacatttaatttattttatttatgtaattccctctctctgtctcccgcactatttctctcatttaattgtgtctgcactccctttgtaaaggtcagacacatcatccctcccccatattgtgacccccgctcatttccaatattcattctgttttcttgttgtattcccacatttttcctccgattgtcctccgccccaaatatttatttatttgtttcca

SEQ ID NO: 65142 - DNA, 4250 bp, Heterodera glycines
  Genomic contig location: Contig_ID=SeqID_7532; Location=164..4413; Strand=+
  SCN-specific regions: Sequence locations=1-52,74-233,256-421,443 -701,723-739,761-809,890-1078,1137-1265,1307-1389,1473-1539,1572 -1727,1760-1782,1804-1840,1864-1939,1990-2178,2237-2285,2309 -2370,2414-2542,2564-2598,...
  SCN-specific regions: Sequence locations=...2622-2827,2849-3236,3259 -3303,3409-3584,3606-3629,3655-3765,3787-3809,3832-4228
caaattcatttggtactcaaacagaagcataatgccagattgaaggatgtcaaaatgaaattttggcacaaattcaatcaaattggcgtcgcttttggaaaacacggcacgcaacttacaaatatatgccaaatgatttgtatgaacattgggcagcagtgcaaggtcaatggtaagatttgacatttttggcgcgccaattagtccaacaattagtgaccgataaagataatgttgctaaatattttcaacacataaagcaattgttgccagagcggaatctgttttatcagttggctgaggagcatgccaaaaacataaccaggtgaagggagaacctttgatcactgatcagatatcacttatctcaaatggaagtttttggccactactgtagtttgctgtatccctcttaaaacgaaaagggagacctttttgttttgaaaattttttttttatgacaacttgttattaacccgaacccgaacaaaaggataaaatgatttgcatgggaaggaattatataaaagatcaatttgatatacctatttgcaattatttttcaagaaatttggacgctaggcttaagaatttttttttatttctaggattttctcgggagcctatctcaataacccgcaaccgatttcaccatttcataaaaattataacaaactttccgcttttgtaggctaaaactggggtcacagtggtcccgtccacacatgtgtatggagtagctctattatgtcttgaatttcatagtaaattgcgaaaattcttattgaaaatacaggaaacaaacttagttttttattaaatttattaattctttttaaatgatatgtatttgaaataaataaaatgcaaataataataataaaaaaaagaaactttaagattggcagagacaaaaaatgcatttagtgaaagtcttaaaaattcactgctggaaggaaaagggaccaaatttcggctccaaaaatttttctcgcttagtctgggcgatattgcattatatgagcaaatggttagcaaatttcctcaattaaaaaatttgtctagatcaggtaggtgcatttaaaattttttttataaaataaatttaaatatttaattgattttattatataatagaattaacgaacgacgaaataacggaattacaaattcgaacttatatcaaatttcttgacaataaaaatgatgagcaaatttgtagacgcgcaaaatatttgctcgatattttagcattttatcaatggtattttaaaataatttttaataaaaaaaaaaaactttttaaggttaaaaaataaggacgacattttaatggacaaacaggccgaagtgttaaaacacttggagttgtacgaacttttgatggtcattaaaatttatattttttagttgcaaatttctttgttttttttcaatttgaaattaataaataattaaatatttttattttaggattcggtgccaaatttatctcaaaatgagatcaataatgatatgattatacagctgttgtacgaacagagaaaagaattatttccaaatttaaatattgtaaaattttcaaattttgacagcccccaaggcggtgaaacggatgctaaatcggcacaacaatttttgcacggcaaaatcctccaaaaattggttttaaacagcgaatttttgacgcagttaaaaggtctctgaaaaattctttaaaaattagcaaaataaaaaataaatattaatttaaattttagattagatacaatatttgtaaatttcggataaggaatttaaatttagataattataaataccgtatttcctaaaatagagtccccgggggttttattttcaacccccctcaaaagggaggctttatttcaggggcggttctaatttaggggggggggctgtattttaggaaataaggttgttttatttaaaaaattatttttatttttaaatttttgaaaataaaaaattggaattttttagaaatctgtgccgacattgaccggttgcatgagttatgcaacgaaccagtggttgaacaaattatcacgcaaaattgttgcaataaattggaaatgccaaaaacggatgccaaaaattcacatttggatgaaattgcttcatcatcatctccttctatgttcatgaaattgagtaagcaaaattaattaataaatttaaacaaaataattataaaattttttttaattcaaaaaatctctcaacaggcgattaataaaccttaataacactttaatgaatttgggttaattataatataaaataaaatgcactaatgaattaataatggatcgggggtcagttttcggtgccgaccgtttgggcgtcgccaaatttgaaatgctaaaactttttcctttatcagttaacatttagcaaaaatgccatcaattgaaaataaaaccatgaatccttttctaaacaatttgattaattttttttaaattgaaaaaaacttggaaaaattagcaaaaataattttaaagttttttcaggagaaaatatagttttatttgaaaaaaattctatgttaaaaaaaagttatggcatgcagcgacgaaaagccagaaaaagcccgaattaccgaattatacaaaagcatttaatttgggttgctatttagaagagttattaaggagcattaccaacggtgctgaaccggccggcgccgaactggctggcggcgtgctaaataatgcttttcgggtcgggtgaattgttcaatttaatgacaatgtacaaaaatgtgatgtttaaaggacgaaaaaataatgatgattcagatggtgtaattttggaaaagtcagaagaagacctcaattttgaggcaatttattttcaccacaaaacggtattaaaagaattggtcaaattgctttgggtctttcaacgatatttcagacatattaggtaattaatgtgaatatcatttaaaaaccaataaataatttcactaaaattcatcagcaattaatagagcccggaaatttcaaatttgcggatcccgctgcggggttggaactcaaaatttttttgggatacgggatcccgtgggattaatcccgaaaatcccgcaatttaaaaaaaaaattcgggattgcggattgggattccacaaaatcctgcacgggatcccgtctcgtaccgggcactagtaattaatccattcataattcgataattaatacaatttggaggtttgaaattttccataatttattctctataactaaatttcacaaattaaactgttctcaccttggctttattttaatgattttttttagaaaattatgaattagatttattgaaaattttgtttcatttaatttaaaattattaaaaaaaatttttttttaaagaattaatgatgaaaaagtgaagagactaatcattaaattgaatgtggacattgcaatggctgaccttttcgtggaagtgaatgatccggcaaaaaaacgtgccaatctttgcctaatggacagtttgttgactcatctggtggcaaatggcacattgtacacagaagtccaagaatggcaaacccacatgctttatgaacattttattaatcatgtaaaattacaaagataatttatttattttttaaattaaggttctttggttaatgtttaatcatgaaacttgttcccgaggggtttttgacgacctctgatcatgaaaatgacatctattttggccaatttctaactaacccgaactcggacaaaagtttaaaattccaattgtccatttatgattttttgttcaaatttaagccatttttaaagtagcgcaacaaattccattgatttaaagatgaatttaaaatctttaaataattccaaaaaaaaacaaatgcaatttctttttttgctaagaatttcatacagtccatgattagaatcaatcaatatagccgcattgattgatcagcttcaatcaataatgattgttggttgaccaaaaccaatcaatcctcattattcagaacgaaattccgcgtccatcggatgccgatttgcgctgggccaaaccggagtgccataaggcggaggtggcccaagcggcagtgagcaaattattgggccaaatgtatttggtggtacaatcgcacagttttgtgctgggccaagttgcaaaggattgtgccgaatttgttcaatttgtcaaccaaaatgggaaaggaattttgaaaaatttatattgcg

SEQ ID NO: 65143 - DNA, 289 bp, Heterodera glycines
  Genomic contig location: Contig_ID=SeqID_7533; Location=275..563; Strand=+
  SCN-specific regions: Sequence locations=1-238
atgcctaaaataacatcatgcattttagtcatattttgggatataattttgattgatgcacccaaatttcaggtgtggatgtgccgttttgaacatctgttgagcctccaattgcccgcagttaggcaggaaatagagaaaatttggctgttcttccggtgttactatgacatcatcagcgattttgagccgccgattagcacggaaattgattggcctttagcggctgccacaaacgaattaattttgggtaattaattagtgaatttattactttataaattaatca

SEQ ID NO: 65144 - DNA, 593 bp, Heterodera glycines
  Genomic contig location: Contig_ID=SeqID_35623; Location=119..711; Strand=+
  SCN-specific regions: Sequence locations=1-100,122-426,448-593
  Gene Ontology: Mol. function=ATP dependent DNA helicase activity; Cellular component=nucleus; Biological process=chromosome organization and biogenesis (sensu Eukarya)
atggacacaacggggaaaacagtgctctccaaaaatgccatcaatcatatcccattcgacaaaaccgagctgactgctattctgaaatttggtgctgcagaacttttccgggaggagggtgaagaatcgcaggatcttgagcttgacattgatgaaatattgaacagagcagagacgagagaatgcgagaacatggagtgagttaaattgtggtgtacacagcacaggcaatctaaagcattaaaacaaatgtaaacacaaattaagatcagcgaatgatttgctcaactcattcaaatatgccaattttaccattgacgaggagaaggatttggcagaaatttcgcagttggacgactcaggcatgggcgagaatagtccaaaattgaccgacaattcgcttgacaacagcgtgaaaagggacttggagaagcaatgggatgaaataatccctcggcaagaaattgagcgattgaaagaaatagaacagagcaaatcgggcgaaggcgacattttgttgccgaggaacagaccgagtgtttcaaatgtgaattacggagggttcactgatgaatcatcggacgatttggaca

SEQ ID NO: 65145 - DNA, 1076 bp, Heterodera glycines
  Genomic contig location: Contig_ID=SeqID_35624; Location=227..1302; Strand=+
  SCN-specific regions: Sequence locations=1-80,113-348,371-530,553 -567,589-684,710-782,804-896,919-980,1006-1022,1044-1076
  Gene Ontology: Mol. function=protein phosphatase type 1 intrinsic catalyst activity; Cellular component=cytoplasm; Biological process =adult locomotory behavior
gcaaacggaggttttctatcaagttgtggaagacattcaccgattgtttcaattgtctaccaattgctgctttaatcgacgagaaaatcttctgttgtcatggaggattgtctcccgatttacaaaatatggaacaaatccgcagaattatgcgaccgacggacgtcccggacaccggtaccacgcctaacacaagatagttgtttttagtgtgttgttcaggacttttgtgtgatcttctctggtctgacccggacaaagatgtgcagggatggggcgaaaatgaccgtggcgtttcattcacttttggcccggacgtggtagcaaagttcttgaaccgacacgacttggacttgatctgccgtgcacatcaggtcactcaattttatacacaaactcgcaggggcgtatctagaaacatttttcggggggggcccgacctgaagaccttttttttgggtaacaactgcactttttcactaaaaagacccaattttggccattttaaggcaaaaaacttgtaaaatagtggaaaatggaggtccggcggtgccgataggcgccgccgggaaaaatttttggaaatttgagtgttatttgttaccaaaattgcctattaaattttttaattttcgtttgggggggggaattcgaaaaaattttccatttttagttttaatagacatttaaaaatttaaaattattttttccttattcataataaatgtatacagaaaatgatttgccacctcaattcaaaaaacgaattccttatttacttacagtctaattttattgtaactaactaataacgaactcatttaccatggctttgattgtttttttatttttctattttttatatagtccagcaaactaagtttatgtaattgtcgtataaaaataataaacatggaatacatgaaatgtaaaaaattaaggtggtggaagacggctacgaattcttcgcaaaaagacaattggtcactctgttttctgcgccaaattactgcggcgaatttgacaacgcgggtggaatgatgtcggtggatgagactttgatgtgctccttccag

SEQ ID NO: 65146 - DNA, 260 bp, Heterodera glycines
  Genomic contig location: Contig_ID=SeqID_35626; Location=748..1007; Strand=-
  SCN-specific regions: Sequence locations=1-142,221-260
atgtatcttcatgttatattaccaacaaatatacataaacaaatcataaattccgagcagatatggatcataattataaggaagcggacaagttatgtgaaatgaataattaaagaataaagcaattatttagttggaaaacaaatatttatcaataaaatacaaaatatctattcaaataaaatgaataacaatgaaacaaataatttatttatttttagcaaatgattgttaattatcgttagattaaaagcaataaa

SEQ ID NO: 65147 - DNA, 804 bp, Heterodera glycines
  Genomic contig location: Contig_ID=SeqID_35627; Location=20..823; Strand=+
  SCN-specific regions: Sequence locations=1-804
atgtgccgccaaatcgggcttctagaaaccggagagcacttctggattcctccgcagttcctcgttaagagcaaggaagagctgatagattatgtctatcctaacttccaacaactccttggcaatgacaaggagctgctcaatcgtttgattctcgctccgcacattgacacgtgtgatgaagtcaacgagatcatgatggcgaatgtgccaggtcaagtgcgggaatacttgtccacggataagccccttgacgaccggccactggacatcgatgagattgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaaacctgcattcgctatgaccattcaaaaaggtcagggccaaacaatccgcactgtcggcattgatctggaaagggaagtattttcccacggtcaattgtatacggccttctctcgggcaacggacggaaacaatgtccgtgttcatgctcccaaccgggaaattgatgcccaaggccgagccaaagtgctgaatattgtagctactaatatgctcaagttacaataa

SEQ ID NO: 65148 - DNA, 462 bp, Heterodera glycines
  Genomic contig location: Contig_ID=SeqID_35628; Location=164..625; Strand=+
  SCN-specific regions: Sequence locations=1-422,445-462
cgttacattgacatcggtgggagtgaaattgtgcctctctcgggcgtgctcagaatgcatcgggaacacagccgaattgtgccgctttgcatgcagctgaccctggagagtataaagccaccgaacagagccagcgaatggctgcccaaagagtgcacttttttccgcagtttaatccgaacggacagagcgatgagctgtcgaattcgacattcgaaccaaaggtgggcctgccctttgaaaagggacggatgtccactgaatcctttctttggtagcgccaattatcagccgagcagttacaattcgtcgccgcaaagatggtcaggagtgtttggcgtcacttctttgctcaatgggaactttcgagtggaagaacaaatggtcgggggagttgagaacggagaagggaatcgcgaagtgatggccgcgtgggccaacctcgagaatgggttccactga

SEQ ID NO: 65149 - DNA, 120 bp, Heterodera glycines
  Genomic contig location: Contig_ID=SeqID_35629; Location=142..261; Strand=-
  SCN-specific regions: Sequence locations=1-120
atggttgtgccatcgaactgtccagaagatttgccccgaacaatgcaagtggacccatttgttgagcaaacggcacgccaaaaggcgaccgatgttgcacagcgaatgattgatgaaaaa

SEQ ID NO: 65150 - DNA, 1657 bp, Heterodera glycines
  Genomic contig location: Contig_ID=SeqID_7536; Location=80..1736; Strand=-
  SCN-specific regions: Sequence locations=1-202,226-317,369-492,514 -687,709-733,776-1061,1083-1085,1107-1527,1550-1657
atggaccttaacaatggtttttacgacagggaagaagacaaagtgaaattgattattgatctcacaactgttgatgaaccaaaagtggacaaattcaatttggatcaaagcaaatcaaacgggacaatttcgatggaaattgaaaaagtgtcggaatttgcgcgagaagtcttttggagtgaacgtaaaagtgaaactgttcacatcaaaggattgccatggaaaatatgggcacaaataaatccgaaaattggaagcactgacaatgagaaatggttggccattttcctttggtgcgatgctccaaaaggaggtgcaaaattactaataattaatatatatattaacaacaattaattaattatattgagcagaaacttggagttgcaaatgttcggcaaactttcgaattgtctctctaaagagcggagtgtcggattttaaattagaattaaatgacgatgtttttgacaataaatggaacaacaggggatactttaattttatttcaattgctgtaagtgacaattaaacattcccttaattgaccaattatggggtaattaagcaactgatggacccaagcaaaggcttttacgaccaaagcgaggacaaagtgacattggccattgatgtcacagtgaaagaagcaaaacggaggacgaaacataaatgcccaatatgatttggggaaaaatgcccattgaatatcctccatcctatgatgaacctgtttttttatttattaatttttcttgattatactttcaaaactgctgatatatgaattaattaattgtcggagctgttttagtagactctcattttttttggacttggatttattgcattaattttgttaggatttacgtaaacatttttttaaactttttttttaaaattgaaaccattcctaattgactgatcattttttccttttatttaagcagaattttttgggaccagaaatttgggaaccgggaagtttgggcttattaaattaaaaattgaaaaactattactaattacgctatgatttcattctttaataatccaagctgcgcttaaaaatttatatttactacaaaattaaaatatggaaaagtgacaattttattatttagtcaattcttacagctgtttaaacgtggtgttgagtgtcaattgtacataattccttaattggcataattattattaattaagaaattgatataagtcagttgacggaaagcactgacaatattgagaaatgtttgggcatttatcttttgtgtgccgctccacaagaaggtgcaaattaaatgctaattgataagaattaacaacgatattaatttgcgttatttgtacattttgtggcatggatttgatatttttaaaggcatcaaaaggagcgcagaattgcaaaaacatttgttggccacggccaatttgaagaaagctcaaattgtgttacttatacccagaaaataattttcgcgcttagtctgtgaaattctttgcgtctcaaatccttgctaaaaatggaaaagtaaattttgttttgcacagaaaattggagctgcaaatgttcggcaatcattcgaattgtctcacaaaagtgcgatgtggcggatttcagaagagaattaaatgcgatgtttttgacaataaa

SEQ ID NO: 65151 - DNA, 1405 bp, Heterodera glycines
  Genomic contig location: Contig_ID=SeqID_7536; Location=1810..3214; Strand=-
  SCN-specific regions: Sequence locations=1-125,150-254,290-433,506 -718,751-1353,1376-1405
  Gene Ontology: Mol. function=protein binding
atgtataataaattaaggattttaagaccaattaattgctgctgtctgattgtgagatcgaaaaacccttgactttagactttttttttgtaaaatatgttcctcaaaaaatgaatgtttttttaagtttgtcaaaagccaaacaatcattagagggcttaaagaaatctcggtctcctaaactcgaaaacctctaccagaaaaactcgattcttttctcgctttggcactctcagagaaagactacattttaaagattatttttcctttaaattttagaattttgccaattgttgtttggcttacattggcaaaaatgcggacactttgcttaaaacggatgcttttttgcaaattgaccaaaaattgttgtgcgaaattttggagtgtgacgaattgcaaatccgtggagaaatttcaatttggaatgcggtaattttaacaattaaatttaaaaactgtaaattttattagtcatttaattatttccattaaattttttaaaggcactccgttgggccgatgaaaaatgccgtgaaaatggcattgattgttcagcagagaatcgccgtcaaatgcttggcccggcactgttcaaaattcgctttccgcttttgtcaaacgtggaatttacgaagaaaattggtaaaaaaataagtcaaaatttcaaactcattttctgatgagatgccgtaaaaaattcatagtttttgtggcgatttttaaaaatgttttttaaaatttatttttcaataagttaatacatatttacagttcccttcggtgttttgtcaaaagatgaagtgatcgccgtttatcagttcaaatcccttccaaattgtcatgggatttccgacggaattttcccaatgccattttcgactaatggacggatttctgatcgaaaaagggcacagttttgatggacattgaaaaagtgtcggaatttgcacgagaggaggttgagagcagtcgattgagtgaaaaaatatacataaatggacttccatggaaaattgaagcagaactaaatgaactcgttgacagtgagaaatggttgagcatttatctattgtgtgatgctactgaaaaaggtgcaaattaactgttattaaatgctaattaacaacgatgagtaataatcattaagattcgaattggcgctgctgcgttcgttcggcaacttttcgaattatatcgcaaaaaaatgtgacggagaattccattgggacattttgtgattatgtttttgacaaaaaatcaaataatttgggattccctaatttcgtttcgtttgcggtaagtgccaactcaaacaaatattttaatttgacattcgtggaccagccaatattgaagttcatttatttatttgcctggtgtaaagaaatcataacaaaataaa

SEQ ID NO: 65152 - DNA, 566 bp, Heterodera glycines
  Genomic contig location: Contig_ID=SeqID_7536; Location=3578..4143; Strand=-
  SCN-specific regions: Sequence locations=1-124,157-177,199-285,307-566
atgatggaattgcttatcatgtcccaatcagtgcttgatcggatgaagcatttgttgagcacgggtgaggacgcggatgtttattttttggtgggcgacggagacgcaaaagaggcgagtcttcaaattaaaaatttaatttattaattataaattggaaatttagtgaatggtaaattttgttgtgttttttaaaatttaatcctcttaagcttgtgccagcccataagctcattttgaagttggcttccgacgtttttgaggcgatgttccgttttgatgccaaaaaggaaaaagcggaattcggtaaaaacattacttaatgacatttacaatttagtctctgcaaattaccctaattaattttcaatagtcctccgctaattacactaataattttcaattagcctctgctgattgtcccgtggaggtccccgacgttgaagcagcagcattcaaagtgatgttgagcttcatctatacagatgatttgagcgaactgaacgtagaaaatgcaatggctgtgctttacgccggtggatttaattttatgtgacaaaaataaa

SEQ ID NO: 65153 - DNA, 274 bp, Heterodera glycines
  Genomic contig location: Contig_ID=SeqID_35633; Location=1..274; Strand=-
  SCN-specific regions: Sequence locations=1-193,216-274
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataagggaaaattttttaaaaaattttttctccatcttcctttttgatactaaagcatcagagtgctaaaattaagttgtaaataaaa

SEQ ID NO: 65154 - DNA, 689 bp, Heterodera glycines
  Genomic contig location: Contig_ID=SeqID_35634; Location=560..1248; Strand=+
  SCN-specific regions: Sequence locations=24-86,156-292,314-353,375 -389,411-689
atgcatgaatgtggtgaaagaatttccatagccaaatatgatcaacaaggatttcggcgaaatcaaattagacgaaactcgaaaggtaatttaaaaaataaaaagatctttaattaagatttttagtatttaaaaataacaaaacatttttaattcactttaagacaattttcaaattttaaaaagtctgaatgaatataaattttctgtgtatgaatcaacaaaaatgttgaagaaaatttacgaacaaatgaaagaaatctcttatggtaattacaattcttttcatggcaacaatcaaactgaagaaaaaatgccaaaaataattggagaattaattgagcaaattcataaagatttcagaatattgcatgaagtaaaaaaattcgaattttacttattaaaaattataacggattattttgaagaatgtgaatattttcgactacaaaaatatattttggtaaatttggagagaatgcttaaagaaaacggaattgcaaatgaaaaaaacgaatatcatgcgaatgttgacaaatttattcaggaaaaatttgaaaaagaatgcaaaatgtaagatttaaaagtgaattgaaatggattaaacttgctacaccttggaaaattttagctgtgcttatttgcaacaaagtacttgtaaaaaaaaacattttgcccaagaatgtaaa

SEQ ID NO: 65155 - DNA, 60 bp, Heterodera glycines
  Genomic contig location: Contig_ID=SeqID_35636; Location=229..288; Strand=-
  SCN-specific regions: Sequence locations=1-60
atgtgtttcagcgtgccttgggtagcggccaatggcgcaaattcggcaaaacaattcaaa

SEQ ID NO: 65156 - DNA, 1462 bp, Heterodera glycines
  Genomic contig location: Contig_ID=SeqID_7537; Location=88..1549; Strand=-
  SCN-specific regions: Sequence locations=1-33,77-84,109-720,743 -768,790-995,1019-1021,1057-1278,1302-1375,1409-1462
atacattccaattccaacaacaacaactggaagcgcaacaacagcagcagcaggaggaggaagaagagagggaaagcagcatgaccaaggaggaggagggcaagaagcggcagcacatcgatgtcaagcggggcccggtggaaaagaagggcagacgcggtgcggttccgtgccggagtgtcggaaaggatggcaccaccaaaggtagacaaagctgtttaggcattggcttttacccacccgtcccacaagaaaaaacccattgaaccgtcccctcggaaaagactgaaaaaggacgataataggaagtgttttttagggtcgaaatatttcatacccgaagatgtttggcgtgactatttgggcactgaatgggtggacatggacaacctccaattggaggaagtggaccagccccaatatgaaccgatgatggtagaaaaattaaattgaaatttaacaaaaaatgaaagtatttataatgccatgttccgcattttcacacaaacttactccatttttagccactcaacccggacaagccgggcgaggtcgactgttgggtcaaggaactgcaggacgttgaggacaacgggctcgccaggggatgggaggttggctgattttttggaccttttgtagtttgtcgaacaaattataacacccaaaaagttgttttggcgccctttgacccccaccgggtaacaaacgcatgacacattcaaattcaaaaatttaatcaattccctccctcccccttcccaggtggagagtgtcattggggtcagtgcaaaggctgcggatgggacgcgtcagtgttttgtcaaatttgtcggcttcaaattgccacagcaaattccgctggctgttgtccaggaaatggcacccgaggtaaaatgaaagcttttttctccaattcgaccaaattgttcgttattatccaataaaattatgagtttactttttttaatccaattttgagttttggtcccatgaatttgtttctctttctcttttcgtcattttatttattttttaaattaacatattatttttgttccaggccttcatccagtggtgcacttggcagaacggcatggacaatttggacaaatgtggcgcctattgggaggaacagttgcggcagccgccctcctggatgtgccgtcggtcgttggacgcctttgctgcatggaaggcgtccaagttgaagcagtgcaacaataatgctaacaacggaagcaacggctccaccattgcaaacagcaacgtcttttgcgatgatgacgacgacgacaatggtgcagctgctgatgatcatcgacaaggacaaagccaagtggagctgccaccgaaatggaaatgggcaccaccagaagaggaggaggaggaggcggaggaggaagagcgggaagatgacattgaggaggcggaggacatcgatgatggagatgacgtttag

SEQ ID NO: 65157 - DNA, 1866 bp, Heterodera glycines
  Genomic contig location: Contig_ID=SeqID_7538; Location=1373..3238; Strand=-
  SCN-specific regions: Sequence locations=1-503,526-707,730-803,825 -839,865-921,943-1219,1250-1309,1341-1432,1459-1459,1490-1719,1743 -1802,1824-1866
atgggaaggatagcacaccttctccaatcggatggattcttccgcacgcacagccaacgtcgcttttcaagttcatcagatgtaaaagacgaatcactgccgctggttcgaatttggaatcgccatcaatggcgagaatatatgtgttgtcagcctaagcatcggtgcgaacattgaattattgcacagattccacgagggcaaaatttaggctcaaaagacctgcaattgtttgtcttatacgctcaaatgtgagtccataattcgatgcccgagcaaaaagtacatgtacatcacttgcgaccaacgctttttgtgtcggatcaaacgtttgtctttgagatgcacaaaaagaagtgagccctacattcaagcgccagcacaagtcgacctccgtacggagtgttcagaagaatacggctgtgcatgtgcggttcgagggggggtgggcggcttgaccactcccatacgcaaatatgtctgctagagggatcgactgagttactgtttcagcgtcatttccttctcacctgtgaacatccacctttagttggcatgatgacataaatgcgtcgtgagggcagggggaacggatgggtggtgggtgatagtaatggtaatgtttttcccacgttaggtccagtgaagcaaaaagttttttgttatcctccctttctcggtcggtgtgattcatcgcaccgcatagaaaacatatttttcattggcaaatggcaaacttactactgtcccggggtttactgtatacattgaggcacacaatttgtgcgcgtttttccactcacaactaaattttgccattttaagtgccatggaaacgaagaaggaacatcaacaacaacaacgacttgcgcatggtcaccgtcagctgacaccggaaacggttcaaatgcacggagttggggagcaggaggaagaggagcaacaacaaccgccggaagatccctctacttctggtgatgatggtgttgctaccgttgctgttccgggtgccgcttcttctcccgttgcatctgcagccgatggccagcaaacgccgccgccattgagtgctgatcgtcgcgcagcagtggagcgtgtcaaaagttcggagagtgtgtcgccgcttgcttttgatgagcgcgacttggacgaactggtcaccaccggcggttgtgacgagccgcgcacatcgccgccgcacatggacaatgcggacgaagcggtggaggaggaagaggaggtggaaatgggcgaccaacaacagcaaccgatggtggacatggacaacggtggtggcgatggtggttcggatgatgttgttgctgctgctgaagctgttgtcgatgttcaacagcaggtggtagtgcagcaggatgctgatgaggatgacggtaggtgtctttgcattttcttatgtcaactgaaaaggggaataatttttgtttgtttgtttggacaatcccccttctatccattttaccaaattaaggggctttgtgttggggggggggggagttttgtgtattggaaactgaatgagtgagggtggcacttaagtgtttttgcttcggtttgttccggccggtttggtgctttgagttatcccaccaagcttttgagactcatttttgccaatctaaagcaattctatgacatccaattgttcatggcgtacaatttatatacggataatccgaaattaacaatgtcacagaggacaatttaatttttattattgataaagcgagaggtggtggaaaagttggaggcgttggaatcattggcttgctccgaatggaaggaaccccaccacaccacatcacattcgtattaacgattgattggttgtttgtcactaatgtcacg

SEQ ID NO: 65158 - DNA, 978 bp, Heterodera glycines
  Genomic contig location: Contig_ID=SeqID_7539; Location=1..978; Strand=+
  SCN-specific regions: Sequence locations=1-31,54-240,263-978
  Gene Ontology: Biological process=reproduction
tggtcaattaaatgtttgcttgtactttaccttcatcgctcaggctgttgccattcgtcggctggacacttttgaacggcgtgccattgttactgacccatgcaaacgatccctttggatggactgtgaataccttcagtgttgcgatcgtgggaagttgagacttggggaagagactttttgggacgaattgatcgacaaatatttgaaggtgggcttttgggtcaaatgcaaattgtttcttttttgttcaatggcttttctttagccagtcgagaccaccacccgagaacaggcgcaagtcgcgaatggactcgtcgcattgcgaaaccgaattgcattttccatcattttgctcaattgtttgcttgtgctggcaattttccttctccaacgacacaaagatgttctgtccgtcaaattcactccttatggtgggcattgttagctctttttcacttcctttattttaaagatggatttaaatggacgaaaatgaatgaaacgaccgggaaatttgaagacacgactgaggccctgaaagttgacccgttgggtatcggaataatcttttttctgatgggaattctcattgtgagacctttttcaattgaattcactaattaattggaaaaggttcaaaccattggcatgctcatccatcgtctaaacactctcgtggaagcactgcacgaactgagtgagatgaaagacgtacaatacaacaccttcacatttactgaccacatcaaagtgctcaatgaaggtggcttttcatcatgtgccatttgcatttgtgtctacttttctaattgagctcgtcaaatgattgacaccgttaattacgaccgcgcccacggggctgatgggtacactcgccacggacttggggaccaaaaagtgcaaaagaatgtgctttacaaactccaaaagtgacaaaacaatcttttatatttaagtattttgccttgtttttca

SEQ ID NO: 65159 - DNA, 78 bp, Heterodera glycines
  misc_feature (45)..(45): n is a, c, g, or t
  Genomic contig location: Contig_ID=SeqID_35643; Location=42..119; Strand=-
  SCN-specific regions: Sequence locations=1-20,45-78
atgcccgtggcctttcccgctgctctctttctctcttcttcattntcttcttgtgacagcaccgccgctatggcggag

SEQ ID NO: 65160 - DNA, 866 bp, Heterodera glycines
  Genomic contig location: Contig_ID=SeqID_35643; Location=267..1132; Strand=+
  SCN-specific regions: Sequence locations=1-175,197-255,335-351,532 -553,602-839,861-866
  Gene Ontology: Mol. function=DNA binding; Cellular component=nucleus; Biological process=N-linked glycosylation
atgaagcgtcgttggcaaagtgccgacgaaaaaagggaatgcacaacggccgaagacaaccgcagcaacggcatttgcggaaatggcaagggaattgggggagaggcggcaaaggcactggcggacacggcctcaacttctgctgctgaactgagcccaccgcaagtgaaacgcgcgaaaccgcagcaaaagcgacagaaattcagctcaatcgaacatttgcttagggaggaaaagcgacgagacgaagaaaatggaggaagaggagaagaaaggataagacggaagaggagcatagagaaggaagaggaggaggaaggaggacgagagggagtgggaccaaagagtagaaaagagggagagagagaaggacatactaatgagagatacgcaagggagagagaagaagaaagagggaagataatgatggaagaaggagggagcggaaaagatagggaagaggaggaacagagaggggaagaagggcggcagagaatgggaccaaagaggaagagaaagggcgaggaggaggaaggcattgaaagggaagaccaggagggggaggaggaagaggaggaggaggaagagttgaagaggaagaattggctaagggcaatcagtgtgccggacaatggaagtgcgttggacggactgaactgcgagttggagaacgccgagacgtggtcaatgggcgggggggggggccttggggagaatttgactttgctatggggggaattggacatgatttaattgtcctaaaacttcgggagttctgctgagccaacggagtttaatcgagaaaccgaaggggaggcaaaagtctcgaaaaattcaaccaaaaatgcttttcagggtaaagttca

SEQ ID NO: 65161 - DNA, 1392 bp, Heterodera glycines
  misc_feature (1333)..(1333): n is a, c, g, or t
  Genomic contig location: Contig_ID=SeqID_35644; Location=16..1407; Strand=-
  SCN-specific regions: Sequence locations=1-21,44-118,158-261,303 -405,427-573,615-753,788-830,852-1037,1060-1150,1197-1392
  Gene Ontology: Mol. function=transcription factor activity; Biological process=skeletal development
atggaacgcgaatttgtggctaacaaatatttgagtgcttctcaacgtgaaaaattggccaaggaaattggccttactgaaacggaagtgaaagtgagttttatagcaattttaatcgtttttttaaaattattattaatatttgtttttattaattgcttaggtttggtttcataatcggcgcgaccaatggaaatggcaaggatcataagaagaaacacctgctgggtaactaactaattagtgttaaacagcacccacaaaaaattactaaattttatattttcaattaaaataattaagcgatctgcaacacgaaaaggaaaaaatgccacaaaatggggaccaaactgagctaattggacacaaagctagacaaatggtgttataagccattcatttaaatataaataattccattttattaagaccaaactgcaaaacttttcgtccgaccaattggacattttgaaatgcgcatttgatgagagaaaatacccggacattttcatgctcgaggaattggcacgggagacggggattacggtggaccaaattcaggtaattagagggaatttaaatttctaatttattaaaatatttaaatttaattaggcgtggttccaaaagcgacgagcccagcacagacagcataaagaatgtaaagcaaacgacaatcaacaaaaaaatgtttgtgaaaatgatcaaaactatgcaataagaataattatgccgcaggttcagtctcagccgaatgccaatggcattggcattgattctttcttctgcccttcggtttgtgccatttttggccgtgccaaatgccgtcgtttaaattataaaatattaaaggatggacaacaaaagcttttggctacgccattcaaaccattggatttggcccctcaatttaaaccattggaaggcttatttaagaagacaaaatatccgaatcgtactgaatgtacttttttggcaatgctcagcaatcaatcgataaaccaagtcaaagtgagaattaaaatctcgaatttgggattttttatataattaaattttggttaattaattaggaatggttcaaaaatcgacgcgatgagttggaacgccagggaaacgaagaagcattttggtaactaatgaattaccgtaaaaaataactaattaatcaaatatttgtaaatatttaaaaattagtgatgtaagcgaacaaaacccaccacgaaatgttggcaaaactgaagctgttcaacaaaaagacaccatggaaagcaaacacaaaattcacaacaaaataatattgtgagttaatcgtgtaacttaatcttatttntgaatttatttctctttttaaattagggtgaatattaattataaaggctaatcaataaa

SEQ ID NO: 65162 - DNA, 1207 bp, Heterodera glycines
  misc_feature (1138)..(1138): n is a, c, g, or t
  Genomic contig location: Contig_ID=SeqID_35651; Location=1..1207; Strand=-
  SCN-specific regions: Sequence locations=1-252,275-831,854-1207
tactctttcagctgatggttatagaccaaccatgagcagaatagagctcataaaagatatgtcaattcctggcaatgtcaaagaagttaaaagcttcctgggaaaagcaagtttttgccgtagacatatcaagaattttgctacaatagctgagccttttttgagcctttcgaggcaatctgtcaagtttgaatggaaggaggaacaacaaaaagccttagaaatgcttaagaaattcatttccgaatctccaaacctaatttttcccaattatttcaagccttttcacatctttacagacgcttcaggatctggacttggcggagtgttgatgcaaaaaaatgaagaaataggtaccttctcggcaatctcttactgcagccgaacattatcggcatctgaaaggcgatggccgacggtacaaattgaaatgtgtgcaattatttacgcactgagggaatttagaccatttatttttatgagtgacattgaactgcatactgatcataagcccttagcctatttactcaaaaaagcggaaacccatccccatttagctcgatggctcgttgaacttcaaaattatcagattaaaattgtccatgtggcaggtcggcaaaacacactggcagatgccctgtcacgtgctgctgaggaagtgccaactaaggaggttgatggtttgccagaaatggaagacatagtccaatttccaatatgtttttcggttcagtcaagatctcatatagtttttgcaccgtttgttaatacgataaccctgaggcatgaggatgggaatagctatcagatagatttggccgaagaacagaggaatgaccctgaaattttggcatacattgactttctgaaaaatggatcatttccggctgatttctcggaaagcgaaaaggaccaactttcaattttggcatgtaatttattgctaaattccggagttttatactttaaaattggaagtaatgtcccacgaatttttgtccctgtgtcattacggtcacttatttttgaatccttccacagctccccattaggaggagggcacatgaatattaaaaaaacattaaaaaagtgtaaaaagtatttttggccgaggatgcattcagatattgttctctgngtgcaacatgtatacatgccactccgactgacccactcagctatcgtgcgaaatgcaagtggtccctgt

SEQ ID NO: 65163 - DNA, 2756 bp, Heterodera glycines
  Genomic contig location: Contig_ID=SeqID_7540; Location=18..2773; Strand=-
  SCN-specific regions: Sequence locations=1-478,500-721,745-1106,1130 -1404,1426-1621,1643-1811,1836-1862,1885-2329,2351-2546,2575 -2670,2692-2735
atgaaagacgatgttaaactgctaattgaggcgtgtgaaaagtgccaagtgaggaaaattcagccagggcaggccaaatcggctccgagtgtcccaatcgaaccatcaaatggcccatttcaaagaattcattgcgatttaatgggtcctttaaagaaaactgaaagaggaaacttgtatattttcttggcgattgatagtttttcaaaatgggttatggccaaagcaatcccggatcagaaagcgaatactgtatcagaaaattttgttgaaatggtggtccatcaacattcaactcctgagattgttgtgactgatcagggaagacagttcacttcgggaatttttaatgatttggcaaaaatatacggttttgagcatgtcactacaacaccatatcatcagcagtctaatggaatggctgaaggggctatgcgaatcatggctaatattatttctcaaatggtcaatgaaaaagggaataattgggatgaaattctgccgcacgctattttttcatacaatgtttcaatacattcagctacaaaattttcgccattttttatcattaatttacgacagccaaaattgccaactgatcggttacttaaactcccatcccccgatgagcttgtgtccgatatttcggtctatacaagaattcagactgaaaaagcagctaaagcgtgggaaattgtgcgaaatgaaattttaaaagcgcaggaaaggaacaaagaagagaatgatcgcataaggaaagcgaatgaaagagaatttgaaatcggtgatttagtgttgtttaaaaaagaagttttaagccataaatttgatcagcgttggctgggaccaatgcgttgtgtaggcgttgaaaaagaaaagaaaaatgtcattttacagtcaattgatggaagagccaaattaagaaaagtacaccaagaaaaagtgaaacattttaatggaccggcaattcttcctctaaggcagtcagatgaaccattaaattgggaaaagtacgtagatgatccgaatttagaacaggaagaaattgaaggtgaaagttgcgaaagtgactgtgaggaaacgcaagacaatgaaaatgcgcagtcaaaaaacaaaatgggattaaaagtttcaaaatatggctttgagagttctgacgatgagaatgattggaatattgttgcgtttgtaagagaaaaccaaaattctgaggatgatgaaggcccggaagttataatggacagaaaccccgaaatcgaaataatgccaattttcacaatactcgaagtccttattgagggttcatttactgaagtatacaccggatggagagaccccgtaacaatctcattaatctcaagcatacctgaaaacctagtaagggaaaattgggaaatttatgttaatggaaatggctcaagatttgttatggcatggatttttggcgaaagtttcgaaattttcattgtcaacgaatttgatcaaataatgttgggaattgatgcgcaaatgttgttgggtgaaagatggcgaataaaaactgaaaatgaaattgagacatattgggaaatctacttcgatgaaaatgggcacgaatttgaaattcccagaattcctgaaatccttttttcagaaaaggaaaatttggaaattgggtatgggccaaactttgtaactctcgagattcagaaggaatgataagtgatcaggatgatttagaggaagtaaatgatttttcaagaacagacattaatgtgataaattatgtaaaaccgtttaaaagtttattggatttttcaaacgaaattgatgaagatgaaggaaatgaagaattagtggaaaatgccggagaaagggagagaaatatgaataattctctagaaattttagggagaatggaaaacgaacagttgaatgagaaagggcggctaaataaatcgaataaaacacaaaataaaaaatatgcgagccattcgtttttcaaggaattggaccgaatgacatcaccggctccattacacttcgaatccttgactgatgacgaagaggaatcgctgagacgattggaaagacgtctgcaggaacagctgaacaaagtgaggcaaacattggcccaagaacaaccggaggagtgccatgtgaaggcaagagaagaaaaatgcattgagcaactgaagcaacagacggtaaaggatacggtagaccaaaaaggaacggcggaaaaagaagaaaaaagtggagaattatgtgaaaaaaaagaacctgaggcaaaaaaagccgaaccggaagcaaaagaccgaaaaactgatgaggatggcattgtgcaaacaaaaatggagaaagagaaaagtacggtggaagatgtgttgtccttaggagatgaagaagaagactctccttatgaagcagcgaaggtatttgagacggggacgtctttttttgaaagcgcgggggtgcgagcgaattcacgccgggaacttgaggaattgacaaagtcccgaaatgaagcaaagataaaggccaaaaatgagttagagccgccggcactgttggacatgccaaaggaaagacaaaatggtcgtaaacgattgagagagggatcgccaaacaaaggcgaattgttcacgaacaatcgttgggatgagaagatgcgcgagattgaagaagtgaacaaaaattcgaaagaagtgcgcaatgccttgaatggacttttgacgatgcgtcaaaaaatctttgaaatacaggatgaagcccaa

SEQ ID NO: 65164 - DNA, 1464 bp, Heterodera glycines
  Genomic contig location: Contig_ID=SeqID_7540; Location=3221..4684; Strand=-
  SCN-specific regions: Sequence locations=1-53,76-185,208-716,738 -804,826-850,872-1339,1374-1419,1441-1464
cgattacgaatgacccgaggagactcccatccattagtgtccgtcttaatgatttgttaacagcagccttggttgattcatgtgctagtgtatcctactgtagagaaagaacagcaagaaaagcaggacttaaaattttggagcaaaatgacggaaaaggaaatttgactgcggcaaacgattcgagcatagaaattttggggaaaactatggcaaaacttcgaattgaggataatgtgactggaaatgtcggagaatgggaagttgtattgcttgtctcagtggacgaacattgtcccggccctttgcttattggattaccacttcttatggaattaaaaggtgtaatttccctgggagagaaaagagttagacttggtgatgagtggacaaacattgtgtcagtaattgggtctgaaaagccaaaaccaccgtctgtgatacttgaaaatacggaagttttagagccaaggtcggaaaatatactttcggcaaaagtaaacgaatgttttccaatggaacaaaattttttggtgaaaggaattaagcttaaatatcccggaataattgttggacgaactttggtttcaccaggaaatagtaagaatgtaacaatacaaattttaaatgcgggaaattcagcggttaaattatatggaaagtcacatttggcagatttggaatcggttcaaattaatgcatcaccaggagatgaaatcccagcaaaagattacattcctcccgagacacgatggagcgaaaatttaccaaaattaccggaaaacggactaaataggccaccatcaaaaagaatcaatcttgagggtacaaaattaagtgaaaatgcgaaaaatgatttaaagaaaattgtggatgagtgttcagaagcttttgtaggggatgatggaaaaattggcaaatataacggaccaattgtgcataaaattgacctaattcctggttcgttaccatttcattgtcggccatatcggtacccaccggagactcagaaagaaatcgaaaggcaaatcaaaatgatgctggaccagaatataataagggaatcggaatctgagtttgctagccctatagtgatggtccctaaggctgataaaaagtcgtggcgttttgcgattgactacagaacactgaataaaatgacaaaaaagagagtatttcacttgccaaacattcaagagttgttagatctgatgggggcaaagaaattttacacgtgcatggatttacagcaaggatttaggcccagagcaggaacatgcttttcaaactctaaaacaaatgctcacaacagtaccagtgctacagtccccaagattcgggaggacattcacaattgagtgtgatgcttcaaaaaaggccattggagcagttctcctccaggagaatgggcccgttgcttacatttcaagagcattaaatcggcacgaaacaaattacccttaa

SEQ ID NO: 65165 - DNA, 51 bp, Heterodera glycines
  Genomic contig location: Contig_ID=SeqID_35652; Location=262..312; Strand=-
  SCN-specific regions: Sequence locations=1-51
atgcttttactgcacctatactttagtacgactccagaccgtaactacatg

SEQ ID NO: 65166 - DNA, 483 bp, Heterodera glycines
  Genomic contig location: Contig_ID=SeqID_35661; Location=279..761; Strand=-
  SCN-specific regions: Sequence locations=1-117,139-227,258-296,333-483
ccatttgtggagcagcagcgcgagaatcagcaagtgatgcgctccctccgtgccaacgtggtcactggtgcgcactgctgcatcggacttgtcgacttgttcacttggtttgccccgctcctttggtttgttctccaaccgcccgtcaaagcatcggtcggtgcgaaacgaaactcatttttgggctgaatgttaacaaatgatgaaaatagcgacctcagattgtgaatatttatttataattattaatattttaacccagtatatctttttttatgcctaggttcagcagctttcatcactctcagccaaataaaattatttttcctaaattcccctctttcagttgtggtccgatggcggcggtgacgggcacgaacagcgtcagatggtccaacgagtggtggagctgatgcgctcgtttggcatcagtttggtcaggactaccggggccgatggaatggcgcgattcgcatttgaacc

SEQ ID NO: 65167 - DNA, 742 bp, Heterodera glycines
  Genomic contig location: Contig_ID=SeqID_7544; Location=556..1297; Strand=+
  SCN-specific regions: Sequence locations=1-28,50-160,182-587,647-742
atgaatcctccgaatttacttttgttcgttttgttcattttttctttccaaattcattttgcccattcggatgacaatgtaatttgcggaattgcaagtaatcaagtgttaacatttaaataccaatcgaggaaagaaccaaaggaaatggaaatcaaaatttcattatatgcaaagaaatctggtgtaattttttctaaaacttaacttagaaaccaactaatttcaggaagggtcgggtcaattaagtaattggcagatgcatttaagtgattgatccttttcaattaaattacatttaattgaggaaaacaactcacaaatagtggaaaattctgcgaaatttatctttcaatttcttaagtaatcttttagaattaattatgcttttttaagactgtgatttttgatggttttatcaccgaaagtgataatttgagcaagaaacaatgtgttgtcatcaaaatgtatcgcaaatcagatgaaaagttttataaaaatagcgtaaatttgtggaaaaaattgaaaaaagttgatcagaaaaatgaatactttgtcaacataattgactagtaaattagaattagtttaaatcttaaaaaatattttaagaaaaaaaattataaatatatatatttaattttttgttgaaaaatgtaatggccaactttttttagtggcgaatttgacgaatcaagcaagcactaatgtgactttttttaaaaacatcatgcggtaaaaa

SEQ ID NO: 65168 - DNA, 610 bp, Heterodera glycines
  Genomic contig location: Contig_ID=SeqID_35667; Location=163..772; Strand=+
  SCN-specific regions: Sequence locations=1-337,365-575,597-610
atgctgaagcagcacgttgaggacgtcatgaaggccgagcagtacgcggcttggcacgtcaacaagtaaatgcagcgtagagaaattggcacaataggacacactttcagggtaaagctcgagctgaagcgcaaaatggcattgaaggaggaaatccagaagatggttggcatgcttcatcaggtgaagcacagcgtaagaatgggaagcattggcaccgtttgctttcagaattcactcgaccgcgacattgagaaggccgaaaagacattcggcaacttttactccgacttggccaatgcgccgtggctgccggagaagcgcgagattcagagggagttcaagaagtacgacgacgagttggcgaagttccgtgaacagatcgccgagtacatcaacgccatttcaaagatcaaatcggaaggtgcgcaatggcattttgttgtttaacggactccaaaattcagcggaattgcatgccaagttgccgttcagaacattcgtttatgctctcgccaattattcaaggcaatcgggaaaagtttgtcagctgacgaaaagggaacagaagaaggcaaaacaggtgaaagtcatggatttaaagcagtaa

SEQ ID NO: 65169 - DNA, 754 bp, Heterodera glycines
  Genomic contig location: Contig_ID=SeqID_35669; Location=158..911; Strand=+
  SCN-specific regions: Sequence locations=1-410,432-754
atgccttcaaattcattttacgttatccttccttccaacacaagtgttgatggaaaccgaacaaactccttccgggtgcgtctgcctctcaaaatccaattcaattccgagtgggaagtgggtttggcggtcattgtttatccacattcatggccctccattgggacggtggaagaacaatttgtgcaggttgattggcagaccggaagcacagtgcacattgccgtccccactacaaatattaaaaatcctgatgatctgagtaaaagtttgtacaggctgttgggcgagggaagcgaaccgttggcaaaaaaagcgcgtaccgctcagttggcattcaacaattccgcctcggttgctcgccaatgggccaaggatgagtacattcgacgaaaaacacgagagaagcgagccatccgggatgaacaaatgctcctggacgcactccaaactggcggcactgacagcactgttgatttgatggacgcagcagcccaaggcattgtgtcgagggagaaacgtgcagagtcaagccaaattccgttgagagaaaagatgtatgacaaggacacataccaaaacaagctggacaattatttttccaccctcaagggggaggatttggaactgcttgatgaacttggccgaaacaaattgaacgatgagattgcaaacatgtttgacgaagatcgcacaatccttgacgccaccaaagaactgggccttgaggcgtggatacaggcatacaaaaagg

SEQ ID NO: 65170 - DNA, 56 bp, Heterodera glycines
  Genomic contig location: Contig_ID=SeqID_35671; Location=891..946; Strand=+
  SCN-specific regions: Sequence locations=1-56
tgaccgtttggggtactcaaacatatatggagagcaagaatccatcgcacaattaa

SEQ ID NO: 65171 - DNA, 1155 bp, Heterodera glycines
  Genomic contig location: Contig_ID=SeqID_7545; Location=1016..2170; Strand=+
  SCN-specific regions: Sequence locations=1-269,521-672,710-879,902 -915,945-959,981-1155
atggcgcttcaatcagtgccatcaacaaatattgcattggcgacaatttgccgcacagggcaccgtatgaaatcagcacaaccgcagccgtataatcagcatttatcatactgtaaattgagtgtttttcaattaaaagcaattcaattatttggatgggaaataatattaattacttctgcaaattgacgtaaaatttgccattggtggcaaattcgtcggtgaggaagccgcggacaaggagctgtaaaaaggttttaattctagagaatttattaatttaaacttttttaaaattataaaatacacttattaaaatttttgatttgaaacaagttgtataataatctattttaattttaaatattttagtgaatgtgtttaataataaatattataataaattttaattaaaatgttttaattaaattttttagtttatatgtaaaaatcaaatttttaattaaaatattgtttttcttttaaaacaaaataataatttttttaatgtttatttattctaccgataattccaatgtgaacgaagtcagcatcattgagatggtgaacgatgcgaagccgtagcggcgcaaaaaagcgaccaaaaacccaaatccgatgatcaaagtgccgtgcacatcttggaaatctgaaaaactacgctttcaactctattttttaatttaaatattatttatttattatttttgcctgtgtattttcgctgtgcctccgctgcggccacattgccaaggggaattgcggacggcatggcattgggctcatgttgggagaacagcccgaacaagaccaggaagaacagttgagcaatgcccaacagcacacagaattggttgtgtggcaatttaacggttgcctgaaaaagttataaaaataaaatttccgtcgaaatagtttttttttcaataatattttttatttttcagggtaccataaggagaaggaccagcaaaaagatggccggagagacgagaatcaaagcctctgtcaaatattgtgaaaatgtagcattcattttctctttttttttgctaaaattagtttaaggaagaaaattgaatttttttttttttgaaaatccgatttttctaaaaaatgtttcatatacagtaataatggcactatttatgctaa

SEQ ID NO: 65172 - DNA, 396 bp, Heterodera glycines
  Genomic contig location: Contig_ID=SeqID_35677; Location=54..449; Strand=+
  SCN-specific regions: Sequence locations=1-36,66-110,141-178,200-396
gcaccggcatcgtcaactgcaaatgatggcacaattgaggatgaagaggaagaggaggaaagcgccggaggggcgacgaatgccaaaaaccgtaaaaataggaaaagccgacaaacccaacaacaacaacaaaagcagggaccaaagaccaagtcgaacaaagaattgttcaacggagtggtggaacgtaagtgattggtcattttattagccaattttgacacgagttttgatcccgatcaaatatttaaaaactaaatcacagcagtatgaagttaatttgaagtccgattctggcatggaattgagagaattggaactgattgaatgcaaaaatcataaatgtgtattttaaatgatttaagtccaagtgtttggcaaagattttggctaaaa

SEQ ID NO: 65173 - DNA, 370 bp, Heterodera glycines
  Genomic contig location: Contig_ID=SeqID_35681; Location=333..702; Strand=-
  SCN-specific regions: Sequence locations=1-9,84-111,133-163,227 -248,270-370
  Gene Ontology: Mol. function=protein binding; Cellular component =axoneme; Biological process=eye photoreceptor cell development
atggaaatggaaaaagaagaggaagacagacaaagagagaaaacgaaaagagaagaggaagagaaagaagaggaaaaggaggaggtcagagaaaaagtggaaattttattgcctaaggcaatttaaaaacaatcttaaggaaattgaaaaaagacaagataaagaagaagaaaaggaagaagaggatgaaaaggatgaggaggaggaggaggaggaagaagaggagcaacagatttgggaaaggagtcggcacggaaagaaggaaaagcgagtgccgtcatggcgtggcacacaactccaagcagccaaggtggcacaattactatagccacggaacatggcattaattaacatggatccataaattaaa

SEQ ID NO: 65174 - DNA, 1561 bp, Heterodera glycines
  Genomic contig location: Contig_ID=SeqID_7548; Location=168..1728; Strand=-
  SCN-specific regions: Sequence locations=1-167,189-225,247-552,574 -586,608-754,776-840,864-1045,1069-1163,1188-1561
  Gene Ontology: Mol. function=atypical protein kinase C activity; Cellular component=integral to plasma membrane; Biological process =signal transduction
atggccattctgcaggcggtggaccaccagggcatcatcaagttggactccatgttcgagaccgacgacaagacatttgtggtcatggagaagatggacggcaacatgttggagatgatccttggccaggtaaagcaaaacaaaaaaaaaagcatccgaaattgggcattaaaatatatttttaatttgatttttgctccgattcatttaaaaataataatttagtttatacatttctacaaatatctttattttgtggcatattttacctattccaaattcattcttaggccatgggacggctgaacgaacggagcaccaaatttttgattatgcaaattctgagcgcccttcactatttgcactatcgcggaatcgcccactgcgatttgaaaccgggtaaaattcggataaaattctgaggacaattggacgacagagtgagcggaatagagacgaattgtttctttcgattgattaatttgatattaggtttaattagggtttctatcccaaaaattgggttttaatgcgaattaatatttttttgaaaattgcaaatttttattaaaaagtcgaaaacataatgcctttaacttgaacagaaaatgtgctcctttccgacttccattccaactttccccagacgaaactgtgcgattttggctacgcccgtttcattggcgagacgcaattccgaaagacaattgtcggcactcccgcctatttggccccggaagtgctcaagaaaaagggtgagacaaaacacaatgccattgtctgatcactgatcagagcgaaaagatgatttgaaattacctaaattcagggtataacaaatcgttggacatgtggtcagtgggtgtgatcatttatgtgacactttccggcacatttcctttcaatgagtgagttgtgccatttggcccaacgatgtgccaagttgaaaaaaaacattccgtcaaaggaacgaagaaattgctgaacaaattcaaaatgccgagttcatgttcccagcggcgccttggcaaaatgtacaaaacataaaaaacaattttctcattttttggtttcagatcagtgccgatgctgtggatttgatccaacgactgctcagagtccaagtcggttaatcagtgaagccccgggtttatcaaaaagccaatccttttcaaaattattaaattttcaattgtccttcgatcagatcgaagaacggctgaccatcgacgaatgcattggccaccgatggttgaaggacgcacagacatattgggatttgatctgtctggagaaacggcttggccatcgctatttgacatcggaggccgaagatctgatttgggcaccccaactgagtgccatgggactcattcagacggcgacgacgactacggcacagcaaaatgccaacggatgcgaagcaatcgaaacgacgggaaaatgccaacggacggaacagcaaccgatagaacagcagaggagtaccattagcatggagacggacccgcaacaacagcagggagccacagcgaacattgtggatctgctgggcggttaa

SEQ ID NO: 65175 - DNA, 2236 bp, Heterodera glycines
  misc_feature (2194)..(2194): n is a, c, g, or t
  Genomic contig location: Contig_ID=SeqID_7549; Location=1..2236; Strand=-
  SCN-specific regions: Sequence locations=1-840,866-1203,1225 -1830,1852-2019,2046-2098,2120-2236
  Gene Ontology: Mol. function=atypical protein kinase C activity; Cellular component=integral to plasma membrane; Biological process =intracellular signaling cascade
tgttcaggtcgaacgaacgagactaattggggtaattaaacaaaatcacttttcagacagaaagcgcgacaaatggtcgaaaaacagttgcaacttgagtcgtctatttcgtctaacggaggccatccgacgggcacttccgcgcaggtcacagccagcgaggtgcagctgtttctgcacgactacaaaagcttcaacatgctgacctgcctaacatcgttggcacaattggtcggtaaatagccgagaacggcacaattatgaccaatttgagaaatttaattgtttaggacaatggaagtgtggtggaaatcattcggattgatcggagcgaaaagccgaccaaaccgcacttgctgcaggtgaacactttcgtgacaccgaccttttgcgactattgcggcgagatgctgatcgggctggtcaagcagggagtgcaatgtcgactgtgcaagtgcgtcggggttaacagtgccgatctctttcaactgatcgtatttatctcctgatcagttttagcattttcagcaaaaatttaatcgcgtaataaaggttacaataatattcaatcgcgcttgagattttcaccacttttgaccagctgctgaattttcacaggtgcaacttccacaaaaagtgcgccttagccccgcgcaacaattgtgccaagtcagagactgtgccgaccacctttttggccggtgccggacagtttcccgtgccgagcattgtgggaagtaagcgaaaaacgactcactgaacattaagaaatgcaatttatttaaacaaatcatcggaatcccttttaaggtacgactgagtcacaacagctccattcccatcagcagcagaagcagcagccgtacttccaactgccgcactctctgtggccacacaattacagaacgccaacggtgtgcaaagtgtgcgacaaactgttgatgggcgtgttcaagcaaggcttacgctgcaaggattgccgagtatgtgcttaaaattttgtggattataatgaaatcagataagaaaagttttggatttgcaatgaaaatccgaggctttcggcttgatttaatttgaaaaaaacccttctcaatttcaatcaaagaatgtcacaattttccatattatcaattaacaggtgaatgtgcacaaaaagtgtgtccatttgttgccgccaaactgtcaaatgaatgccgaaaatccattgacattttccactgatcagccgaatttgccaatgggcggcactgatcagagtgcgtcatttggcgtcttccagcaggacaatggcggggcaacggaacacaaaagacacagccaacagcaggcaatggaagtggctaacccgtcgttggacgcgatgatcccattggccaggttgccaggtgagaaaggggcaacaataagcagcaaaaggaaggatggcatttactgggttttgtggaaattacggtaccaatgcaatgcctaccgtacctccctccccctttcagggtccgcgtcttcacgttcggtgcggcacgccgctgctggccaaccgttgtgcgaaggatggctgatccattttctgctgcaagaaaaggagcgacggcgtctccggcactattgggtgttggccaacggagtgatcagtttgtacaacgaatacaacgacggtgggtgtttcacaaaactctgatcgcagttttgaccgacccgcctgggagaattgtcgacgaatcaattgttaccaaatattgatttatcctttttctaattgggcggcaccgaacaaaaaaattgactgatcagtcggtgactgctgatcactcactgatcgacgcgtgtccccctttttcaggtgttaacacttcccgcgtgttccgtcacattcatttggctgaaatcgtcgctttgattccctatgaaggacttccgattgatccgaagtaggtcaaacattacatcaatcacaacgacaaactgtgctggtcagcatagcatttcttccatttaaatatattccttttttattccataattttaaataataaaaatattttcgatttttaatgccaattttttggtaatgccattttcgctttttctatccgaattttgccattattggtaaatcccttttcccatcgcatagatttgctcctcatgcatttgaaattcgcacctcctcgggcctgactttttgtgttgnagaaaatttgggagctttggttggctctctcggcacaaatac

SEQ ID NO: 65176 - DNA, 283 bp, Heterodera glycines
  Genomic contig location: Contig_ID=SeqID_35682; Location=51..333; Strand=-
  SCN-specific regions: Sequence locations=1-119,141-283
atggatcagggaaatggtttttacaacaaaggcgaggacaaaatgacattggccattgatttaatagtgaaaaatgcaaaagtggcaaaattcactcatgatccaagcaaatccgacgcaacaatttcgatggaaattgaaaaattttccgatttttcacgagaaatcatttggagtgaacgtaaaagtgaatctgtcactttcataaagggattgccatggaaaatattggcacaaataaatcaattgatggaaaataaatgtttgggcatttaccttcagt

SEQ ID NO: 65177 - DNA, 303 bp, Heterodera glycines
  Genomic contig location: Contig_ID=SeqID_35684; Location=250..552; Strand=+
  SCN-specific regions: Sequence locations=1-303
aaaattccctcaaaaataaaaggtctattgcgcaccgccctccctatcatgctcgagagcatttgtatgtgtataaaatttttcaaaaaaagagatagccatttttctgggataacctctaaatataaaaatcctctgtgaaataaaatggcgattgtgcacagccctccgtctcatacgcaagcgcttttatgtgtataaaatttatcaaaaaaagagatagccatttttctgggatagagtataaatttaaaaattccctcaaaaataaaaggtctattgcgcaccgccctccctatcatg

SEQ ID NO: 65178 - DNA, 102 bp, Heterodera glycines
  Genomic contig location: Contig_ID=SeqID_35684; Location=879..980; Strand=+
  SCN-specific regions: Sequence locations=1-102
aaaattccctcaaaaataaaaggtctattgcgcaccgccctccctatcatgctcgagagcatttgtatgtgtataaaatttatcaaaaaaagagatagccat

SEQ ID NO: 65179 - DNA, 441 bp, Heterodera glycines
  Genomic contig location: Contig_ID=SeqID_35686; Location=345..785; Strand=+
  SCN-specific regions: Sequence locations=1-203,239-296,415-441
atggtggcggaattgaaacgccggctcagatcatcgcagatgcagctcagaccgagccagcggcggcacccatgccaccgcctccgcctcaggacgtacaggcaggctcaagaggcctatttttgtttcaaatatttaatttgttatttcatttccaatttaataattatttttcttattcttgccaatatttgttcagtaggataaaatttaatgagatatttaatattaaatatttccaatgagttaatttttatgctttctaagaaatcagtagaattgcgatttttgtcatgtataaaaaacatattaatattaaaattatatttttgaaaaatagatacaatttattttgagaattttctaacaaaatgaaattattactattgttttattcaattttaattttaattaccctaattaatccaattgaatcaacaa

SEQ ID NO: 65180 - DNA, 165 bp, Heterodera glycines
  Genomic contig location: Contig_ID=SeqID_35687; Location=87..251; Strand=-
  SCN-specific regions: Sequence locations=1-165
atgcctctgttggctgcaacaccgggcaacccggttgagcatatcgccgggctgatcccggtgggcgatactctgttcagtggttttaacattttcatcactgtggcgttgattgtggtgatgccatttatcacccgcatgatgatgccaaaaccgtctgacgtg

SEQ ID NO: 65181 - DNA, 400 bp, Heterodera glycines
  Genomic contig location: Contig_ID=SeqID_35689; Location=78..477; Strand=+
  SCN-specific regions: Sequence locations=1-138,160-400
atggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaagggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcaca

SEQ ID NO: 65182 - DNA, 368 bp, Heterodera glycines
  Genomic contig location: Contig_ID=SeqID_35690; Location=316..683; Strand=-
  SCN-specific regions: Sequence locations=1-368
atgcaccatttgggtgccattgcgacttccttctgcaaatacaaatacaaattccgctgttccacgccggtcaaagtgcgtttggccagttcagtctcgcgtcattccattcatttcccccatttttaattcagtttgacctgctccacaaagtgctttccgactgtgagccgttgttcgacgccaaactgatgcaggacagtcaacgattggaggactttttcgcgctgttctgtcccaagttgaaattaatttatccgccaacaaaaaaagattcgattggcaaggcgagaaatccgggggaaaagaacacagaaaagagtccatctctcatttcagtttcaactctattacaactcgacgaatga

SEQ ID NO: 65183 - DNA, 660 bp, Heterodera glycines
  Genomic contig location: Contig_ID=SeqID_35691; Location=174..833; Strand=+
  SCN-specific regions: Sequence locations=1-121,143-598,620-660
gttctcggggcagtccacctgaaccgatgcgcccagatttatggggagatcgtatctttcgggaatagcttccctatagtctgtactttaattgtgcgttggatttttgctccccatatatgttagagtaccccaagcggactcttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgt

SEQ ID NO: 65184 - DNA, 852 bp, Heterodera glycines
  Genomic contig location: Contig_ID=SeqID_7551; Location=1383..2234; Strand=+
  SCN-specific regions: Sequence locations=1-43,82-237,317-452,503 -527,554-659,702-852
atgcaggtgagtattttgcagcaaattttgaaggatcaacatcaattaattaaatttttattttattttcaaataaattttcagtaatttaaatggtaattaataacgggaaattcaggaacagctttttcagcggcaagagcaaatgttggccaaaattgacgagttacaaaagtccgtttttgcattaaaagaaggacagagctcaattggtgggttaattaaattaaacagatcataattaaattaatttttggaattattttaaataattaaattcatcattttcaatttatcttaacttttttaaaaaaatcattgacacaataaagaaaagtttaaacgagaatttggtcttaagggaaaaaaacaacatttttgaggattttacatatctagggatgattttaaaaaataaggacgatattagtgccccgtcatcatggcttatgaaattttgaaaaatgtttttttaacaaaatatttaaaaattcaaaattatgccaaacatttgtgtggaatttatgccaaattaaaatgtttttactttagtttctgtttttgaaaagcaattttcttcgctgggaacaaaattggacgataaaattaatgagttgatgaactcaaaaacaggatcgattggcgtacaaatggtgaagtttaaaatttaatttacaatagaattctttttttaattatttctttttcattgctttgttttatagtggacttggaaatttcagttttttgacgccgaaattcgcattccgataatttatcggcggatttagaatctaaattattgtaataattaacttaaaaaaatttctcaaaccctaaaaatcccacgaa

SEQ ID NO: 65185 - DNA, 476 bp, Heterodera glycines
  Genomic contig location: Contig_ID=SeqID_35692; Location=113..588; Strand=-
  SCN-specific regions: Sequence locations=1-476
atgctatcgaatgagcagcagatgacaccatcatcgtcaggaacaagttcagtcactgacgaaactgttggccaacaagggcaaatgccatggcatcaaatgccagaggcacaatttggacaaactccaactgaaaattggcaccaaatttatgcggaacaaacgctttacaatacttatccaactgatcaaaattgggaacaatcattgtctttggatttgtggtggcaaaaatatgcccagcaatttgtagcaggagaacaaatttattgtccatccgatccgccgaattggcaacaatcgcatgagcttcaccaatttgcacagcagggaatgggcggattcgatcagtttaatcaaaatgattttcaaatgcaaatggacaaagcgatgcaacgtcaaacagagccagagcaaccgattgatgcatttgcgccgcaatttgcagaaatttcgctggaggagttgcaacaaat

SEQ ID NO: 65186 - DNA, 1427 bp, Heterodera glycines
  misc_feature (23)..(23): n is a, c, g, or t
  Genomic contig location: Contig_ID=SeqID_35696; Location=177..1603; Strand=+
  SCN-specific regions: Sequence locations=1-23,51-181,239-272,296 -333,380-496,519-533,570-714,736-743,765-780,802-933,955-1117,1302 -1427
  Gene Ontology: Mol. function=peptide YY receptor activity; Cellular component=integral to membrane; Biological process=G-protein coupled receptor protein signaling pathway
ttatttacattttccgtcccctntctttcctttccttttccccccgggggtcattcattcccttcgcttgtaaaagtgccaatttcccttttctcctctcgtccttttttggtcaattacccattcgtgtgcccatttggccttactttgcttctcatttgaatgcgtccaatcgctgtaattccttttcctccttttctcttctcttttcttccctttttttccttttttcctttccctccgccggttttcctctgatgatttattgcaatttgttattattattattattatttcttgttatttttctgatgggtttttttcaaggaaatcaaaaaatttaaaaataatttccctttttataaaataaaaaataattcctttttttttgcccttaaaatgtttaaattcgtccgtcgctcattcaaatgaatgaatggccaacttttccttctccatttattcgccgcccattgtcagttgcaccggcaaaaaggtcacttttttgtgtctgtcctccgaaagccccggccattaattaattaattaaataataattaattaattaaaatttttcctaggcactcaccgattcggccttcgcccgtccactctttctgatcgcttatttgtctctgttttttgtcggtttcgttggcaattttctcgtcgtttgggtggtcgccacttgcaaggtcccatcaaataacaaaatgtcattttattaaatttcaattcaaaaacagaatatgcagacggtgaccaacggtaagacgaacaaaaattgtggaaaatttcaaaggaaaaagggggggggggaagaaaaaccgaaaaacgaacggtggccatggaaaggacaccgccaacaatcaaaaatcgcttcttccgtccgtcagttttcatcgccaatttggccgtgtccgatctgttcgtctgctgcacttccatttggcttacgccttcttacactttcatcggtcattggatttggggtgcttggatgtgttacgcactgccattgttccaaggcgcttccattttcatttcttcactaactttgacagccatcgcattggacagacattgggtgggcggagaacggaggggaaacgattaaggaaggaacggggaatagggaaggggggggggcggaaaagggggaaagggaagcggaagacggtatatgggaggcggaagcggaagatatatgaaaggggaaagcggataaaggatatgagagaggggagtgggggagaagcggaagacggaacagcgggaggagcaaagggagggggaaggagtaatgagaaacggaagatggacctttgcaggtgatctgccgttctcagcctcgaactcacgcatcgacctccaatgaggtgtctgttgtctgttttcctttgtccgatgagtcggtcatttgtccg

SEQ ID NO: 65187 - DNA, 881 bp, Heterodera glycines
  Genomic contig location: Contig_ID=SeqID_35697; Location=1..881; Strand=-
  SCN-specific regions: Sequence locations=1-432,464-881
  Gene Ontology: Mol. function=zinc ion binding; Cellular component =nucleus; Biological process=regulation of transcription, DNA -dependent
tcccttctcaacggcgacagcgctcatccggcggcaattcgctgaaatgtctatactgcccgaagaaaattgtgggcggccaagccgaactgcaagcgcatttggaagactgcagaatggtcagaatgcacgagtgcacgcaatgcggaaagcggttcaaagcacgcggcggactgcagcagcacagcagtacgtgcagcggaggagggcagctaacccacgtttagcactcaattatccaagacatttaaaaattactcaaaattggcaagtcaagtgttaggccattcctacgtgatcagagtttgatcacattgcccattgggaacagatcaattatacaaattaatcagctttttcatttgtgctcgactcgtagtcaaatttgggtggggggggggggggggaaacggcatttggtattttgtattcaaattttattttattaattttttttaattttcggcggaattcattattgggtgttccttaattgctttgcacatttttcaaccgcaaaagtcgtattcttttaaaaattcacatcaatgatcgcccttaccattgtcgctattgccccaaacgatttacgcaaaaggtcaaaaaacgcaatccgtcccatttcattaattggtgttgcagagccatttggaccagcacgagcgaattcacaccggccttaagccgttcacgtgccaatattgcgggcgtcaatttgtgagtgccatttgacacgcattccttccgccaattaatcgcctttatcccacccaaatcccgataaaatgccattttagcggcaacggtctcagcaattggggcacgaggcaacgcatatgaacaggcaaaggaattccatgggcgggatggcgatgagtgcc

SEQ ID NO: 65188 - DNA, 781 bp, Heterodera glycines
  Genomic contig location: Contig_ID=SeqID_35699; Location=106..886; Strand=+
  SCN-specific regions: Sequence locations=1-449,473-484,506-609,643 -758,780-781
aggtgctttggatggtccatacttcagggcatttgcaaattacttcaaacggtaatccacttacataaattaattatgttatttgaaattttgttgagtttcttcgaggaataccaacgaagtgccaatgtcactttttggggccttacactgaccaacgaaccgttgcacggacaacggccgggcatgtcaatgaattcgtcagtccaacggtgggtcccgggaagggcagcaggggaagacgaataccgaaactcgagatcgagaaattaccctgaaaccgagaaataccccgagaaccatgactctcacaattaattcaatagtgccagcgaaattttggcattttcaaattcgagtttcgataattttgacaaattccgaacttaaaatgtgaagagaaattgccataaaaactttagttaaaattgctaattaagcgatttggtagttttttaaatattaatgaaaaatattccacagcgattgggccaacaaaatattggcaccgcttcttcaacaatcgccaatctccaaaaatgtgaccataatggcgcatgatgacaacagacatttgcttttcgatgcggcaaaagaaataagatttcgtaatttaaaatattttaattttattattttttagatttttggccaatggaatgagtccaaaaatgccatcgccggccttggcgtccattggtactcccctcccgaatatccgtacgacgtgctctcacgagtccacacgcttttccccgaaaaatttttattggccacagag

SEQ ID NO: 65189 - DNA, 259 bp, Heterodera glycines
  Genomic contig location: Contig_ID=SeqID_35700; Location=368..626; Strand=+
  SCN-specific regions: Sequence locations=1-126,148-158,184-259
atgacattttggaaatggaaaaaagaattaatgccaaattgtcataaatgtaagcaattattttaattttgagaatttttttattcagttaaatatgtttttagcaccaaataaatattccaatgaggaaaaattaagaaagataaagcaatatttcgaaaccaaagaaaagaatccaaaaatttgtgatgaaacaaaagctaagaaattgagaattgcgagtgacactctgagaatatggaaaagaaacttactttag

SEQ ID NO: 65190 - DNA, 549 bp, Heterodera glycines
  Genomic contig location: Contig_ID=SeqID_35701; Location=465..1013; Strand=+
  SCN-specific regions: Sequence locations=1-549
atgacaactctcaagaaaatcgacacggcgagtgaggacggtctcgaggggggcctttcacttttcgacatccctccgacgaatgttgcaattaataaatccagtattcgggaattgctgccactttcagcaataaatcaatctggaccgtatatctttagacttttttcagataatcagttttgtgatctcaataaaacttttctttatttgtcaacttcaattgagagaaaagacaaaagcaattggattccgattaccaaggacagtgaagctgaccaacatgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatggtgcaaaatgtgaaacaatg

SEQ ID NO: 65191 - DNA, 4209 bp, Heterodera glycines
  Genomic contig location: Contig_ID=SeqID_7553; Location=492..4700; Strand=-
  SCN-specific regions: Sequence locations=1-335,357-549,571-794,816 -985,1011-1123,1146-1502,1524-1618,1640-1732,1754-2073,2095-2263,2285- 2298,2321-2634,2656-2997,3019-3392,3415-3795,3817-3945,3973-4109,4131- 4209
gtctttccccccaaatgggcatgaatggtataactccctgaacccctccttctaaattgagttttctatatcttccgacagtgtgcctgatcgttcatatctctaaaatttatgagaagaggtctctgacattttcagcaaatctcaatatgatctaggggtccagcactgctggagcccatgaaattgtcacctcaacgcaggaacctattacctgtaagccacatagaacccctttcaaatatcgggatgagctcaaaaagcacatagaacaactccttaagtctggtgtcatggtccaatctgacactccgtgggtgtctaacatcgttcttgtccagaagaaagatggtggactccgtccatgcattgatttccggaagctcaatgaaataactatccctgaccattatccccttccccgtctcgaaacaattatggagaaaattggccactgccatttttactcttctcttgacctatcttccggttatttccaaatccccctcacaaaagaagcctcacgaaaatgtggactaatcatagaagaaggtgttttccaaatgacacatctcccttttggtcttagaaatgccacttctgcttttgccagaaccatggcccatgtcctctccggacttgatgggtttgttgttgcctacgtggatgacattcttgttttcaccaaacccccctcattttctgaccatctctccgcccttcaaactatttttgaaagatttcgacgattcaatctaaaactctctcccaaaaaatgtacttttgctgcctcttccatgaactttcttggtcacactgtctcatcaaaaggttactccccatctctctcacgcatcgaagtgatcaaaaatattcccactccccaaaatctaaaacaagtaaaacgaattgttggcatggccagcttttatcgtcgtcacattcccaatttttcaacaattgttgagcctttaacttctctcaccaaaaaagaaaagaaatttatttgggacaaggcacaagaagatgctttgaccagaattaaggaacttctctctcaaaatcccattctcacttttccggattattctcaaccttttcacattttcactgacgcatcagtcgttggtcaaggcgctgctctcatgcaaaagaaaaatgatctattttccgctgtagcatatgcctctcgcactctatcagcccccgaacgtcgttggccccctgtccaaatcgaactcggagccattgtctatgccctcagaaccttcaaaccatatatttatatgtctgaaattgagctccacactgaccaccgtcctttggcatacctccaagcaaaggcacaacagcatgcccacctggcccgttggctaatagaactccaaaattttaacattaaaattgttcatatttccggtaagaaaaacgcacttgctgatgctctttccagactttccgaatctgatcctcctcaaattccaagtgactctcaagagttacaagacatcattgaatttcctgtatgtctctctcttgtcccttttgatcgcattgtccataactttgacccaattctctcttcccttactattcgtaccaaggatggtattcctcataaagtagacctttttcaagaacaaagaaatgacccccaagttctttctcacattaaatttttagaagatggctctcatccagatctctctgaagctgaattacaaaaatttctttcagaatcagaacatttagttatctcttctgacatactatactttcatcctcccaacagttacccccgcgttttcatccctgtctcgctcagatccctgatttttgactcctttcacattccaatcatgggaggaggtcatatgagtctcaaaaagactctacaaaaatgttcaaaaaaatattattggcccaaattgcactcagatatttttcgctggatcaaacaatgtcttgtctgccagctccggcataatcccatccccatgttccgagctgaaatgaaatcggtcccttccaacactctctttgccaaaattggtttagatttagctggcccctccccatcacagaaatgggaaatcgttacatcctaaatttcgtttgttggttctccaaatatgtcatctcagtccctgtccctgacaccaaatctctcactactgcaaaggctctccttcgacatgtttacttaaaattcggtggttgcactgaattaataagtgacaatgccaccacattcacctcagacttctttaaatcattttgttcccttctctatattaataaatcattctccaccccttactggtcccagggcaatggtgcaacagaaaggacatttagaacttttcataatattctgtctaaatatatcaatcccaaagagcccaatttcgatgaatttctagacgcagctaccttctgttacaatacttccattcatgaatcaactggcgaaagccccttctttctcgtgtttggcagagacccaatctttagtattgatcaaattcttgatccctccgtccatctaccactccctcacaatgacttagctgagttcaaaaccctccttgtcctttccctaagaaaagcctggaattctgcagctgactcaattaaagaggctcagaataaatcaaaagtacaatatgataagaaatttaggaatcccgacatttccattggggaccgtgttctgttacggaattatactggaaaaccgggcacttcccaaaaatttcacaatccatggaagggcgttttcagagttattaacatagaagaactccatgtcaccatcgtaagttgttcctccccacaatccaacccatttaaagtccatattaatcaactgaagaaactttttgagatttccggtcctcccagcacctcccccgtcctctcttctgctgaaaaagctgctttagaagcagctgaagccaccgagataccaaacacgataggcttcaatcatacccctgatatttcaccaaaaaccctcccttctgatacccaaaaatccaatgtaccccaaattttacctacttctattgacaaagaacaagcggttttccctcagcgggatctcttgcataaaagtaaatacaatctccgctctcgcccaaggtctaacagttttaaacaataacaaatgcacttttctccttacccattttcatactcacaattaatttttaacttctcacaccacttttttacaacatctttcccctttttgttttcattccttcacaccgccttgcacccaaaatttttatgattaattcgcgtttccctcccttccccaacagaatgatccccttcctgtccaacatccccgaacacaaatacctctccaacttctaccccgcccccttcttctaccctccctcctcctgtcacttcctttcgtcagaacaatgttaccaatccacaaaagcaacattcttccaaagatacgacatagacaccgaaatcctgaaaaccacctccccagtcgtagcaaaacgactcggggcttgtgcccaaaatgaagctgaccccgcagcagtaaaagtgtggcacagcacgaagcagtcaaagatggaagagattctcttccacaagttcgaccagaaccccgccctggcagagtgcctcatttcaactggggagaaatttttggttgaagcgagtcacactgaccgattctggggcgctggtgccaccattgacgacattcgtcaatggaactttactgggcgaaacaccatgggccaactgctaatggaacttcgtgaaaaattaaaaggttttaggattcctcattccccagcgtcccttctcaaataaacatcataagtctcacacctttattccccccccccatcttcctctttcccttccaaaattatcgacccctcctgtgcactccaagttctccttaaatgctttgttttgtttgttttactaacaatgctttaccacgtttccacattgctgtgttgctttctaatctcgttttgtcctctcctcgaatatctcttcactgccacattaagtatgccgaaacgacaatcgaaaccctggattccaaagatgaaatgccccagactccttccgacaactcctcttgaagaatcgctccaagctctgacaactaatgctgattcgaccatcactccggcagcatattctactgaacctgctgac

SEQ ID NO: 65192 - DNA, 400 bp, Heterodera glycines
  Genomic contig location: Contig_ID=SeqID_35702; Location=371..770; Strand=+
  SCN-specific regions: Sequence locations=1-177,214-289,311-400
atgactgaaacatttgacgcaattgacaacgaaattgccaaaattgagaaacaacgccaatttgagacaaatttatgtgccgtttcgttggtcgaccactttttggatgcaattaacaacaatgaacagcgcaaaaagaatggcacaatgccattggcacaggacaaatattttcagtaaaattttaattgaaaatttattaaaaattaatttgtttttggttgtttttaattgctgagacggactgggcaaaaacaggataaatgaattttataaaaaagaattctaattttaaaatccctttttacaattgttatttttcaaggaataatttaacataaatgtttacagcatggaatccctccgatcagtgtgctttgacttttatattgctgctaat

SEQ ID NO: 65193 - DNA, 260 bp, Heterodera glycines
  Genomic contig location: Contig_ID=SeqID_35704; Location=154..413; Strand=-
  SCN-specific regions: Sequence locations=1-260
atgggcgacccattggaccgtaacacaaaatgggtactgtcatatgtgtcggacaaaggctcataccctgtacttggcaaggacgcggagggaaggttagtgatttaaaaatcgaaaattttgcaaaattacgggaaaattcgaaaaaaattttcagggaacgaatgaatgctctgattgttggacattttgatggccatacgtttgagaagttgtttgaacagcaaatggactttgttggcggctcatttgcttatcag

SEQ ID NO: 65194 - DNA, 1216 bp, Heterodera glycines
  Genomic contig location: Contig_ID=SeqID_35707; Location=215..1430; Strand=+
  SCN-specific regions: Sequence locations=1-781,812-878,923-1052,1083 -1095,1117-1166,1202-1216
gtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttgggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtag

SEQ ID NO: 65195 - DNA, 60 bp, Heterodera glycines
  Genomic contig location: Contig_ID=SeqID_35709; Location=533..592; Strand=-
  SCN-specific regions: Sequence locations=1-60
agagcccgtgaacagctgcatcggatgcaagtgccgccgttgctgtacgcctaacatttg

SEQ ID NO: 65196 - DNA, 1026 bp, Heterodera glycines
  Genomic contig location: Contig_ID=SeqID_7554; Location=507..1532; Strand=-
  SCN-specific regions: Sequence locations=1-287,311-428,450-524,548 -1026
  Gene Ontology: Mol. function=receptor guanylate cyclase activity; Cellular component=integral to plasma membrane; Biological process =receptor guanylyl cyclase signaling pathway
atgatgcgcatgatggaacagtacgccaacaatttggagaagctcgtgcaagagaggaccggccttttggaggacgcgaataaacgcgcggacaaattgctgaaccaacttctgccgaggtgccctcccaaacgaaggatgggatcaatcacttttgttaagctatgtggccaatgaactgaaattgggccggtcagtgccgccgaagacgttcaaaacggcctcggtcatgttcaggtttgccgttgacctttgcccctttttcactcggcacaaaccctttccatttcagtgacattgtcggcttcaccacactctgttcatcttccactcctcttgaagttgttacaatgcttaacactgtttacaccggattcgacgatttgatcaacaaacatgaagcttacaaagtggagacgatcggtgggaaaaaagggcggaggagggggagaatggggacgggggtggcaattggagggatggcattacgaaagggcatttttgtaactgtgaaggaggcttaaggcgatgcttacatggtggtgagcggcattccgcaggagatcggagtgcgccatttgatgcatctcagtgacatcgctttggaatttttacacgtaattttattttggcgtttcatttgcgtattttcaatgttaagtacctcaaaagctttgaaatcccgcatcgaaagccacaaaaaatcaaaatccgaattggactgcacaccggaccagtgagaatgccaagggaaggcaaaatcaaaaagaaacgcacttttgaaaggtcgccgccggcgttgtcggactgtccaccccgcggtactgtctgttcggagacactgtaagaccgtattctttttcggtgataaagcataaaaacaatggacttaaaggtgaatatggcctcgcggatggagtccactgggcttccggagaagattcagtgcagcgaatattacatggaggcgctgcacaagcattaccccgagttcagaacggtaccacgtgggaaaatcgatattaa

SEQ ID NO: 65197 - DNA, 907 bp, Heterodera glycines
  Genomic contig location: Contig_ID=SeqID_7555; Location=3029..3935; Strand=-
  SCN-specific regions: Sequence locations=1-510,532-907
atgggctgtggtgaaagtttcgaaggagtggcagtcggagcggacatgttccatcagcaaaatgtgaaggcattcatagggccatactgtaacgcggaaatggatgcggtaattagggatgagttatggtaactaaagaaaaacaaatgttaaggtgagcaaaatggcggctttttggtacgttcgtttttttgttttggaacttttttcaggggggggggggctaattgagtcccgactcttttgtctaaacgctttctctcgaaggaatgtgccaatcatcggctacatggctgccagcaacatcttctccgacaaaaacatttacaaaacacttgcccgcgtttctctccgcaccgtatgtccgcctaattgactttctgatcccttggccattaagacaaactctttggccattgcggtgtattatttagtccgccattacaattggaatcgagtaagttcatccttatcagtcaatcacccccctttttcgttatcagcgactcctaattattttttaaataaaatgccaaaatgattgcccttttcttaggttgccattgtgaccaacacgggtatgaaatgaaggcatcgtttggaagggaataagaaaacaatcgcaggtccaatggcatttgagcggacgcaggcatttgaagaagtcttccaccagagacacgtgaccgtcgtcaagaaaatactgttcgaagagaacgcagatgccaaaatgatacaagccagcggatatttggaggatctgaaaaattcagcgaggggtcagtggcagggaacagagggcattcattggccattccattggcaatttcccttggtaattgccattgttaattgccattgtccattaccattgttaattgccatttgccattatcagggccattaa

SEQ ID NO: 65198 - DNA, 1126 bp, Heterodera glycines
  Genomic contig location: Contig_ID=SeqID_7555; Location=4257..5382; Strand=-
  SCN-specific regions: Sequence locations=1-245,294-297,330-556,581 -869,899-1092,1114-1126
atggcactcggaaaggagggaaagcatggagatggaagaaaggccgaagacgaattaaagacggacaaacggaagaaagaacgaatgggaaaagtgagaaggaagaggaagaagatgaaagaaagaggagcaaaagtggaaaagggaatgccgacggattgactgacaaataagcaccaatcaatcagtgattgtcttggatctgatctgtgatttatgactaatctaatgtgatcaaaatgatcaaaatatttgaattaattttttaaaaaataaataagattaattaaaaagttttagtggaagagaaaagtcattacaatgaaaattgatacaattatataaaagaatattaaaaaaagaaagatagtaaaacttcataagaaggcataaaattcgaatgtattcgatttgattcggtttcattgcgatttttctgccgaatattcgttcggtcatttgcctaatgatataaaagtgtttgtcgaattttggcatagtttctttcacaatcttcccgcctggttgctgctaccttttatgataacacccgacgccctttttcaatttattttattttcccgttggatttggatcatcccttatcctttttttccttccctagggatttgttgccaccaattttcccgcctgccccgcgcgttggccaatacggtcggctttcctttgatcccccccccccattagttaattggtctgacggatttcccttatccgcgcttagtgttgttagtggcaattgctttgattggctttgccccgtcctttttggccggcttttcctttccgtggcacttccttccaaagtttcgcgtccatttgtccttccctttcccccaatgtcctcgctttttcccctcctccttttctcctcttttttgccatgtgttcgtctccagcaaaatgcttcttcttcctccaaattggtaacggcttcttctcggccctccaattcttcagcagtaaatcaactgaacaacgtacccaaaattatccgatttgttttttgctcgccaatccaacgaaattctttgttctttaggcatccgtcgaaacgaccaccgcccgttcattggagctgatgaacaaccccaagttcaagtga

SEQ ID NO: 65199 - DNA, 705 bp, Heterodera glycines
  Genomic contig location: Contig_ID=SeqID_35713; Location=208..912; Strand=+
  SCN-specific regions: Sequence locations=1-130,166-383,429-572,594 -595,621-705
atgggaattccatattttggaaggattgatatgattagagcatttattggcataatctctatcaaatggggtgagcatcgacggcgctttaactgcttatcgaacatctcgaatctctgctgatggatagattttataaataatattcttaaaattttttaaaatgattaatcttgtgatagctattttctttctatttatcggaatttttattcaaaatctctccataaagtatttataaagagtgtctttggtcggaatttacaagtgatcagcgtgtgttgtatcttcatgcttgcacaattcgaattagtgttttatgtttattttcaacaaactctcctattattgcgttttccatcatttgctgatcagctacgaagatattaaattattaattttcgatataaattcatattaattattttctatcaaccaacatcgtggtggtttctattcaattgtccttcttaaaaatcctaattaatgtcttactttgctcatttctttatctctccctcggaatcaaggagtgagtcccttcggtgcaggaaaattattaaggaagagagttcattatttatttgttttttgcataattaatttataaatatttttttcagaaacgggttctgaaacgcaccaaattttatttacatgttagtttaggcactctgatgctttttctatcaaattgggagatga

SEQ ID NO: 65200 - DNA, 245 bp, Heterodera glycines
  Genomic contig location: Contig_ID=SeqID_35716; Location=138..382; Strand=-
  SCN-specific regions: Sequence locations=1-91,114-245
atgaattttcttcaatccgattcattttcattcattcaaggaccattcaagtaagaagataaacacaatcaaagacaaaatgttagccattttttaaattctttagggagagaaatgacgagcgaaatacgacatttgatcacaatcaattatcgaaggaagcggaaggatttaaagagaatattcggagccaaatcagcacaagggtggggacggatgagaacacgtcactgatcaatgcttaa

SEQ ID NO: 65201 - DNA, 1127 bp, Heterodera glycines
  Genomic contig location: Contig_ID=SeqID_35717; Location=138..1264; Strand=-
  SCN-specific regions: Sequence locations=1-41,102-329,435-739,765-1127
atggttccggacaaaatggacgtaagttttttatttccgcctaaaaaaaaattttctatcaaattaatgaataaatttttaaaaatcaaaatttaaaatttcatttttccgaaaagcatagggctaggaattatatgtaaaaaaattgcaaaaacattaaacatgtaaaaaaactcgtaaatatttaccaaaatatacagataataaaactatctacaaaaaaatgtgaaattttggatttatttacgggcatttatgaaatattttcttaaaaattctcaaaaattgcaatattaattactatttaaacatgcttttggcgcgtgttgaaaaattaaatataaatttattatttttttaaattaaatatataatttttaattttgtaaaaataaaaaatatataaatttttacttttgttctcagaaagttcatctgagcatcaccgtatgggattacgataaaatgagcaaaaatgacttcattggtgaagtaaggcatttcagagacattaaaacttcagggtttggccaccccctctcctcgcatcctcaaaaaaatatgaaatttttacgatttctaggctcaagaaccgagatttcgaaaaatttcgatccattttggggtatataactgaaaatgggaaattatataaattgcgaggccgtcaatgtgaagaacgaattccaaaatttcgagattttttgtgtctaaaccgggagtctcgaacaacactaagaattaattttttttttttttaatttgtacaaatcgccacaaattcggaaccgacaaattttccgtccgccccgtttttcaggtgcttctttcctctgccaatctacaattggcttccgtcagtttagctgctcaagaacagtggaatgagatgatgctgaccaggaggccggtaagaatgtttttttgaaatttaatttgaaaatttcaagtttttttttaggttgtccgttggcacaccttgcagccgagagacaaaaaatgaagaagaaaaaaacagaatgccagatgataatataatttcgattctgtatttttaaaataatttttgtctttatttttcacaggccatcattgtttttgcatttttaaaaattttcaaaattaaa

SEQ ID NO: 65202 - DNA, 664 bp, Heterodera glycines
  Genomic contig location: Contig_ID=SeqID_35720; Location=76..739; Strand=-
  SCN-specific regions: Sequence locations=1-104,126-434,456-664
gttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttt

SEQ ID NO: 65203 - DNA, 706 bp, Heterodera glycines
  Genomic contig location: Contig_ID=SeqID_35721; Location=703..1408; Strand=-
  SCN-specific regions: Sequence locations=1-412,434-706
tttggtgcgtttcagaaccctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgctccgaaaacaaaaaaatcgattttttcaagtgtccgtttggggtactcaaacatttatggggagcaaaaatccaaaaatccaacgcagaattaaagtacaggctatagggaagctattccggaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccaat

SEQ ID NO: 65204 - DNA, 723 bp, Heterodera glycines
  Genomic contig location: Contig_ID=SeqID_972; Location=8432..9154; Strand=+
  SCN-specific regions: Sequence locations=1-76,98-723
atggctttgttggccctccatcgttaccatttgcggttggccgactcggggctgcccaatatgagtgttgaccagggtcagtcagtcagtcggtgcttcggttgtgaagtccctcccagggttggaccttctcgcggtgatggccgatgtggacacttttgtggccgattactgttacgatttgaacgaacaagtcggagtttgccgaaaaggccttttttagcgattcggatggcgcttttcctggacatcaattttagtttttcatcgaacgcaacgaacacggaaagacacagctgaacattttgcgggtccatcaggtgatcaattcggtgaaaacccacggactcggcattctccactctttggcatgttttgttttgtccattttcaaattggtcgttcattatcgtaaagatcaattcggcttacaaatttctgcgtgtgcaattccaacgcctttcgcgctgtctttttgacgaacgcatcaaaaagcttttgatgcaagagattctgttttatcgtgacgcaatggacgaattggaccaaatggtgctgggaatgtgcccattttgattgacttttcagggaatgccttttcagtacccaatgggccgagctgagaaattggccaatgctttacttcgttttgactgtgctgcgcttccaaatgctatggccacaagtgatgactgtctgaacaaacttcgggtaattcgttga

SEQ ID NO: 65205 - DNA, 746 bp, Heterodera glycines
  Genomic contig location: Contig_ID=SeqID_972; Location=10333..11078; Strand=-
  SCN-specific regions: Sequence locations=1-746
  Gene Ontology: Mol. function=chromatin binding; Cellular component =nucleus
atggcactttctttgcgaagcaaattttccgttttgaaaggagacatcaccaaaatgactacggattgcattgtgaacgcggccaacagctcactgcttgggggtttgtgtccaaacgaaacaaaacaatggcacaaaggcctttctttcaaaatgcaggcggcggtgtcgacggggccatccatcgggcggcgggtccacaattgttggaggaatgccgaacactgaaagggtgcgaagtcggcgaagcgaagatcacaaaagcgtataatttgatgccaaacatcaaaggcaggacaattcaacgacgatttgctcacaaatcgtccaaatgtttagctatcattcacaccgtcgggcctcaaattgggactgaagtgtcggacgaacagtgccgacagttgcgcgactgctacgccaactcgctaagcctggctcgcgacaacaaattgagatccatcgtaacttacaaggggttttccttctactcgtattttaggcttttccatgcatttcgaccggagtttacaacttcccaaaaaaggaagcctctgaaattgcgattaaaactgtgagagattggctgaccgaaggccaaaacaatgaaaaggtaggggacggagtaaatcattagttttagttttctgttaaattaacaatttaagctcgacactgtgattttctgcgtgttcggcgatgatgaccttggattttacgaaaaaaacattcctcaatttatcctatga

SEQ ID NO: 65206 - DNA, 526 bp, Heterodera glycines
  Genomic contig location: Contig_ID=SeqID_972; Location=11349..11874; Strand=+
  SCN-specific regions: Sequence locations=1-390,420-526
atgagcggattctctgaaaaacttatgcgcgatcgcctgcagaaactgtccaacacagcccattcagtaattcattcccatttcactgttttctcattgggctgggcgaaaaggaaagtctgagaaatgttaaaaatgattttatggggaagccgtcccttttctcttcggatttgtcaattgtccctcagattcaaacgctctccgcttggcttcttcaccatgcaaaaaaacacgcggattgcattttggactgttggcttaaggttcgttttttatgacttaatttgacaaattcttttattattcgttaaactaatcccttttttcccaggaagtgcgcaataattcggagaacgaacgactgatcagtctgattaatttggcaaacgatgtgatacaaaacagtcgaaagaaagtgccctcctttatggcagccttttttgaagtgttacagccggcatttgtccatgcctccgagtgtttggacgaatcgcaccggaaaatggtggcgcgaatcgttgcg

SEQ ID NO: 65207 - DNA, 868 bp, Heterodera glycines
  Genomic contig location: Contig_ID=SeqID_7558; Location=30..897; Strand=+
  SCN-specific regions: Sequence locations=1-283,312-501,523-676,720 -812,836-868
atgttcgacttcccagctttgcctagcagtgcttcgtttgcactcagttcgccagttgcccaattgtcccattcgaacgccgtcctcgtccaggacaatgaacgactgaacgacagagtcggggtaatacgataagacagggtgtatctgataggtgatggtattgtgccgctgttccaggagttggaactgatgttgcgtgaccatgtggcccacatcaactccatttaccactctctgcactctttgcacggtttccatgcgcttcaattgcccgacggtcaaaaaaaaaaagaaaaataatatttaaacccaaagatcaattcattttaatttcagggggaattggtccatctgtcccaattccacggctttcctttgcgtttcatttgcaccaaaacgaccgaaagtgaagcgattgtggccgatgaggagcagcaccgtattctcgaacaggcgacggacaaccggcatacggtgggccaagcacggcgctttatgctgcagcagcgacaaaggcatcgtcagcagcaggggagcgtgaatgaggtggtacggtactcccccatggtgtcactgtatgggaatgttaccgttacagtatgattgggtgggcattactgtttttccgcttttcgcccttcctccaattttactttcctattgtcagtcgttgtcctccggctcctcctcctccttcgcctcctcctcgtccaccttcgactcttcgtttgctgctgatccgactgacttttccctggcgatgatgcgacgtttgtgcattcgcccggtggcacgggacgacagtgaggaaatgcaggtgaagagaaggagattcgcagtgtccaaattcgaatggccaaattag

SEQ ID NO: 65208 - DNA, 394 bp, Heterodera glycines
  Genomic contig location: Contig_ID=SeqID_7558; Location=2177..2570; Strand=+
  SCN-specific regions: Sequence locations=1-85,116-261,283-286,308-394
atggtgcttctttgctgttcccaacataaaatggaccgctcattgcccaattgcctcagggggtgccgttgtggcattttggtcggcagaaaagggaagaaaaatgtgccgaaaagcagcggagaggagggaaaagcggagcaatcgcagcagaggaacgaacggaaacagaacaacgaaaattattattgttcagtggaagagatggcttacgatgcgatgtacgacgaaaaaatgccggcggatgaacggtgaaacagacaataattagttgctaattaggcaattaaattaattgttcttttgtagggacaaaacgggcacagtgcttcaacgagttgcgatggcacttcagggaaaggccggccccgaacaataccaacagttcaaatga

SEQ ID NO: 65209 - DNA, 423 bp, Heterodera glycines
  Genomic contig location: Contig_ID=SeqID_35722; Location=103..525; Strand=-
  SCN-specific regions: Sequence locations=1-2,30-32,155-206,236 -236,320-325,358-423
atgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaa

SEQ ID NO: 65210 - DNA, 666 bp, Heterodera glycines; identical to SEQ ID NO: 35722
  Genomic contig location: Contig_ID=SeqID_35722; Location=1..666; Strand=+
  SCN-specific regions: Sequence locations=1-168,201-206,290-290,320 -371,494-496,524-531,607-666

SEQ ID NO: 65211 - DNA, 710 bp, Heterodera glycines
  Genomic contig location: Contig_ID=SeqID_35727; Location=236..945; Strand=+
  SCN-specific regions: Sequence locations=1-389,411-710
atgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaataattttttttggctttttgaaataaattgtgaaaaatatacgaaaattattttcggttttaattatgctgtacaatgcttttaagccccgccgtgaggcggctccccttttgtgcactattttagtttttaaaattggttccggactttttggctttttgaaataaattgtgaaaaatatacgaaaattatttagcttttaattacgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggcttttgaa

SEQ ID NO: 65212 - DNA, 391 bp, Heterodera glycines
  Genomic contig location: Contig_ID=SeqID_35727; Location=174..564; Strand=-
  SCN-specific regions: Sequence locations=1-391
gcttaaaagcattgtacagcataattaaaaccgaaaataattttcgtatatttttcacaatttatttcaaaaagccaaaaaaaattattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagcgaaaataattttcgtatatttttcacaatttatttcaaaaagacaaaaaaaa

SEQ ID NO: 65213 - DNA, 618 bp, Heterodera glycines
  Genomic contig location: Contig_ID=SeqID_35728; Location=87..704; Strand=+
  SCN-specific regions: Sequence locations=1-154,176-272,310-435,475 -530,552-618
caaaagtcggctcttccgaagaaggaattcctgtttttgggagtgccaattgaaatggcatttatttttgcatcaaaagacaaattgcccacctcagctgacaatacgcggatcaatatgaacaattttggaatattcgcgaattattttgtcgaaaatattaaaaaactgataaattctgacaatttcgacgaaaaaatgaatcagggcgaaatgaaaattcaacaagaccttttagacaatccgagttgttttcgcagttagattaatcgattaaaaaataattaaaatattttataaattaaaattcagataaatttgaaatggataaaattttgaaagagaaaagacaattagaaataacaaaagaaaaagcacaagaaagaagaaaaatagtgggcgaacaagaagcaatgctaagggcactgtcaagtgaaatttataaataaatcgaaaaaaaataataataattttcagggaatttaatgaatgaaagaattttggaaattttatcgcccgtccaaaaattggacaaaaattacaataaaaaagtgtttaatgaaaatagcaacgaaaggctgcgcgttgtactcgcatatttggaattgtgggccaaaa

SEQ ID NO: 65214 - DNA, 65 bp, Heterodera glycines; identical to SEQ ID NO: 57115
  Genomic contig location: Contig_ID=SeqID_35731; Location=599..663; Strand=+
  SCN-specific regions: Sequence locations=1-20,56-65

SEQ ID NO: 65215 - DNA, 1454 bp, Heterodera glycines
  Genomic contig location: Contig_ID=SeqID_7559; Location=2193..3646; Strand=+
  SCN-specific regions: Sequence locations=1-31,54-90,112-788,810 -1034,1058-1454
atggcattgcaattgctaataattcttccactttttcgtttttatattttccaacaaacagttggccaacacacggacaagcgcgagttgcaccgtcagtaccgcctgccgctgggcgtcgacccgggcacggtgaaggcccatttgaccgcgaccggaagtcgtctgacggtcaccgcggccggcaacaaagcgacgggccaaccgccgcctcccccggcggtgttggccactcacggcaccacttttggacaaagcatcatcccggtcaaacacgtgcccgcttcgtcatgtgagttttggcacggccaataattggcttttctaaattcattttgattaatcatttggcttatttcactttgctttgtcagttccgatcactcaaaaaaagcaaaagttccaagtggaattggacgtgcaacaattcggaccgcaagagattgatgtaaggctctgcatgtttaattttataaaaaaacgcaggtgaaagtgagtgggttcgatgtgatcattcattgtctgcatgagaaaggtgaattgggacagaaagcgatggcaacacaatgccaaacattcaaaatgctttatttttgtggaccagaaaatggtctatattttttcgttttgtcattttatgctacaaaatccatttaagggggggggggagggaattgaaaggtgctgggtcgttacttaaaaaccatcataatgggcgttacttaaaaaaccatcattatgaaaatttttgtcgaaaaattatttataactttgctcgaaagcaaccaaatttttaattcttgatatcatttgatagccctaagtgttctctatcagtctgcaaaatttcaaaaaatttcgttaagtttcaaaaaagttatagctcgaggaactcaaaaaactttgattttcgaacatttttggccataactttttttaaacttaataacattttttgaaattttacaggctcataaagaacatttagatctatcgaatgatagcaaggattaaaaatttggtctttttagagcaaagttataagcaaaaatgttcattatggtggttttttaagtaacgcccattatgatggtttttaagtaatgacatagcaccattctctgtccatttccccgtgatcagtgctcagccgaagtgcgcagagttagttgtatgcaattaccaccaacaaatacataaatggaggagtagcaacacaaccagtagtcactcattcattcttcttctgtcagttgtcgtacgtccatttgaatttgaatcgccctaagtgggcagcattaaattaaattgaattgtactgcccccgaggtgcttctctttttactgacttttttgcttcgctaattaaattaggtatttgcttcattaatttttgttgaaaatcacatcaaaataacattgatcaatttttctgttcttaattcacttttcaa

SEQ ID NO: 65216 - DNA, 1385 bp, Heterodera glycines
  Genomic contig location: Contig_ID=SeqID_7560; Location=137..1521; Strand=+
  SCN-specific regions: Sequence locations=1-284,307-1385
gcagaatatggctttgtgatggccgacaaaattggcacttcactgttggaacaaaacagggaattgcaggaaaagtcagtcggtggcagttttttttaaattttttactttcaatcctcaaaattttaattttcaatcattttttctgatttttcccatggtttcaggaacgaatttctggaggcatcgttggccaccagccgtgacaatgtggcacagctgaagcgccagttggagcagcgctgtgacctgttcaagaagttgcaactccaactcgagggcatggaggaggaggagccgaacgggacagacaaataccatcagacggggtgagcagaaaactgaaaattcttaggacgaatttaacacagattttttgtaaaaatttcagccattcaaaattttttgagtttgtcaaaaaaaattttttccaaaaattgctgaaaattttttcttgaaattttcattggaattttgatagtcagacgctccgcttcgggcgggggtcgaattcaaaaattcgttaacgccattgaactcttacctcaaattttctatgtcaaaatgcaaaaataaacaacaaaaaaaaagggggtgggcgccacagcaccactttattcctccttcaagtggtttgtacgggtttctgcctgccctttctgggcatgggggggggatgacatggattggatgagaacaaaggacagacagaccgaacactgatggaggatggagatgcccttgaaaatcgcagcaacaaaaaaaaacccatgaaaattacccattgttttcgcgcatgagcaaaaaaaaaaatatcgtatattgtgtagtaactctacggtagcaaatcattgtgcaaaaacaaaaattaatgacagccaattttgcttcagaatgtgcagctcaacggcggcgcaattggagagcaaaattaaacgattggagggggaaaataaggaattgcgaacaaaggtggggggaaatgagggagggagagggggtgggggacaattcaattaattgagagagagattttgaaaattcccagatcggaatcaaagactcgaaaatgcatccggaccggaatttcgggactaaaattcagttttttccgggttcccttctccggttgcaaaaaagatataacctggttcgagtttctacccggattccggatcgggagcccgggaaatccgtaccggaccatcccaatccaccaatggtatcgaacaattaatgtgggggagaggagaggacggcggtctcatttttcatcattttatttgcagacaaaggactcggatgaattgagagtgattgcggagaagcgcgaggagcagcggatcaacgagtactgctcacgcttgaggggagcaaacctgaag

SEQ ID NO: 65217 - DNA, 372 bp, Heterodera glycines
  Genomic contig location: Contig_ID=SeqID_35732; Location=118..489; Strand=-
  SCN-specific regions: Sequence locations=1-178,200-372
atggttgaaggcgggttgccgttgaaccgtcaatacgcgtcgccttgtgaatttccacaaacttgggcggtgtccattgtaggagaatgtgtttgcaaggataaatgcaagtaagctaactacgaggagccatatgaaaaagttcaaattaagatatcagccttaaaagcttattttgctgccaaaaatgaattaaaataattaaaatcggtttttaccaatgtgatatcaattattctttttgcactagaaacgcgtaaaatgaacaaaaaaattcaggcaattcatcgaatctctggtcaaactggctaatgatcgtggtgtgaaaatgggaatgccaccaagggttgacatgactaaggcaattacatt

SEQ ID NO: 65218 - DNA, 212 bp, Heterodera glycines
  Genomic contig location: Contig_ID=SeqID_35734; Location=329..540; Strand=-
  SCN-specific regions: Sequence locations=1-90,197-212
atggaatttcataatattccgactttgatttttggcttttgctttcatttatctcatgtgtttgacattttaagtagagtgccacgggaccgggaccgggccgggaattcccggtcatccgaggtcccggttcccggtcccgggtttttaaaagctcaggtcccggtcccggtcccggtagggcaaccgggaaccgagaaaaacaagcactg

SEQ ID NO: 65219 - DNA, 67 bp, Heterodera glycines
  Genomic contig location: Contig_ID=SeqID_35735; Location=625..691; Strand=+
  SCN-specific regions: Sequence locations=1-67
tgtccgtttgggtactcaacaaatatggggagcaaaaatccaacgcagaataaagtacaggctatag

SEQ ID NO: 65220 - DNA, 767 bp, Heterodera glycines
  Genomic contig location: Contig_ID=SeqID_35737; Location=225..991; Strand=-
  SCN-specific regions: Sequence locations=1-90,113-180,216-631,656 -660,710-767
atggaagaggaaggtgccgaaattgacggccaacaacggcgcgacggaattgctagtcaaatgccgattatcagaatggtttacatggagcaacaacagcaaaacattggtaattttgaatttttttttggacaaaaatcatttaggggttaaaaaaatttttttgaagttttgaaacggaaattaatttttaaattgtttatttgatattttttgttaattcagaagcaataaactccgccaatgagcagcagtcattggaggaattggaacgtgaattggaagaggtgttttgaaaattttggcacatttttttttggcatttttccccttttttatttagttgggaattgaggaggcaaatttggccaaatccgaggcggaggaaggcgaacgaagcgcacagctcacagtcgaacttgaacagttggacaacgaagagcaggaacagcaaaaggcatacgaaacgcatggcactgagttggtcaaaaattgaaaaattttcttggtgataaaattcaaaaacatgggtcaaagctacattttttaggaagttggaactaactttttctcacgaatgactgggccagttgggtgccctaccccagaaaaaaaaatattttcgtttttaaaatttcttattgttagaagtttttctagtaaaaatctaaaaaaaaaattgttgaaagaaattaaaaaaaaaaattttgggaaggcgcgagggagagagggcggggtgaataagggggggataaataccgaataaa

SEQ ID NO: 65221 - DNA, 117 bp, Heterodera glycines
  Genomic contig location: Contig_ID=SeqID_35740; Location=809..925; Strand=+
  SCN-specific regions: Sequence locations=1-117
atgggctgcaacgaggccctgtctcctggtgacttttccgaacatgcgaattttgctcgactgtgccgttggcatggactcgatggcctcctttctgccatgtcccgtggtccgaag

SEQ ID NO: 65222 - DNA, 182 bp, Heterodera glycines
  Genomic contig location: Contig_ID=SeqID_35740; Location=199..380; Strand=+
  SCN-specific regions: Sequence locations=1-152,174-182
tgtcttctttgccaaaaatccttcgtcttcccaattcgattggcttcactgtttgcgggtttggcctttccattggtgcatttattgtcggtgctcttcttttggacggaccgatgtacgcgtacaccgaatgggttcagcaacggacagacaaaggaacagaaaaacaaaaagtggaatga

SEQ ID NO: 65223 - DNA, 895 bp, Heterodera glycines
  Genomic contig location: Contig_ID=SeqID_7561; Location=1948..2842; Strand=-
  SCN-specific regions: Sequence locations=1-497,520-895
atgacgtgcaaaagccaaaatattcaaagtgatcaacgagaattgaaacgaaaagcaaaggttgcgctcgatttgttggagatcggactagtggcatatgccttacaggacagtgagagctggaagaaagcaaagacagcaatgaacgtgctcggaaatgttcttttggccgagtctctagctaccgtcaaaaaagaaaacaaaaactctccggattcacctgttgctcaaaatattgcacagccaaaggccgcgcctcaaaaagaaaccaccaaaaaacgagaagctagcgaagaaaagaaagacccaacaaaaagccatctagactctgcttccacgcaaattgatgacgtcagcgtgcctaaggcggataaaaaaccaaaaagcaataatgaagaagaagacgtaggtgacattgataaaactcttgatgaattttttgctagcataaaagcagcgaccaccggtatgtaaaatgcatatttaaatcattcacgtcatcattacaacataaactaaaatgcttaatacaaaatcatttgttgataaagatatttgctttaaactgccttgtggaattattatttccggaacacagtttttattgaaatttattgacgagttactaattattccacagcctgtctctatactgtattgttttggggaaatgaatttgcagttccggcacttcaacgggctggtgttgcagtgtacttggcgtcccttctgaagaattgattaaacaacattgcaaacctctcctactcattctcgacgacctaatgctgtccatttacgaacgttatttgtcggagttatttaccaaaaaatcccactaccaccaatttgcggttgtgttcgtcactcaaaatttatttgaacgaaaaataaa

SEQ ID NO: 65224 - DNA, 694 bp, Heterodera glycines
  Genomic contig location: Contig_ID=SeqID_7561; Location=3072..3765; Strand=-
  SCN-specific regions: Sequence locations=1-356,388-488,534-694
atgggcggctattgtggcgtttccttcagcgcattgtccaaagggtaagtgaatgaattgatcaaaagtttgattggggatgaccattcggattggccatatcgtttttgccaaataaatcatttgtactttttttcctgtacaaattatttgctttatagaataaaaatgccctctccctctggactcccttggcttcccgtggagaattgccaatgtcctattttggacaatgagtgcattcgtccactcaattacacaaaacccgttatctgtgctcacaagagcatcaaaaacttgttggattttgttgcttccccaggggaagaacacccgggtactcacaatcatttacctatttattttttctaatttttaattaatttagtgttcgcgaatgcccatgccactgatggtggtggttcgtgtgccactcagtggtggctgatcgtggttctgcagctacttgttgtgctgctcattgtaagtttaaaatttaattttcaaacatttaattattttgtatttttaatctcaatgtttttcacgctatttaattatctattttcatgcttggtctgttttttcggcgatgtaaagcgggtaccgttgccgcaaatatgtgatgcgcggccggttgaaatgacagcgcttcgccggcagggttttacccgccgtcgtggtaaataataaa

SEQ ID NO: 65225 - DNA, 640 bp, Heterodera glycines
  Genomic contig location: Contig_ID=SeqID_35742; Location=1..640; Strand=+
  SCN-specific regions: Sequence locations=1-640
actcaacccaccagcatttcaatcactgggactcaacccaccagcatttcaatcactgggactcaattctcctgcatttcaatcactgggactcaattctcctgtatttcaatcactgggactcaacccaccaacattccaatcaacgggactcaacccaccagcatttcaatcactgggactcaacccaccagaatttcaatcactgggactcaacccaccagcatttcaatcactgggactcaatccaccaacatttcaatcactggtactcaacccaacagcattccaatcactgggactaaacccaccagcatttcaatcactggcactcaacccaccagcatttcaatcactgggactcaattctgcatttcaatcactggcactcaacccaccagcatttcaatcactgggactcaacccaccagcatttcaatcactgggactcaacccaccagcatttcaatcactgggactcaacccaccaacatttcaatcactggtactcaacccaacagcattccaatcactgggactcaattctcctgcatttcaatcactgcgactcactccaccaacatttcaatcactgggactcaacccaccagcatttcaatcactgggactcaccccacca

SEQ ID NO: 65226 - DNA, 403 bp, Heterodera glycines
  Genomic contig location: Contig_ID=SeqID_35744; Location=19..421; Strand=-
  SCN-specific regions: Sequence locations=1-403
atgcacgacaatgtgatgggcaacctcgcgacacttctcaaagtgtgttttttggtggcgatatgggcagacgaaagagcattgattcagaatcaaaaattttttcgctaaatatgatgatcacatctccctcttatgtagaaattgtcaataagcatggaaattttgttaatttttttgtccatgaatcagtactagtaggtgtcgccaaggaattaaactgactccgctatgaagcctaaatttcttcaatttaaggctttgtcagacaaaggaacattgctcgattcttgcatcgtcaaggggttcacccgtctttatgctgttcttgcggacctctacttagatttgccagccgcttttgctttggcacagctttggattaaaaagtcgctcaaagcgg

SEQ ID NO: 65227 - DNA, 141 bp, Heterodera glycines
  Genomic contig location: Contig_ID=SeqID_35744; Location=876..1016; Strand=-
  SCN-specific regions: Sequence locations=1-141
cggttgatgagctgagtaaggacgtgccgaaactgtgtgacacgttggctgtgttaattgctaagctggttgagcaaaacatcgtcacatcgaacgttatttcgtttttggcctataaaaattcggatggcaaggagtccg

SEQ ID NO: 65228 - DNA, 212 bp, Heterodera glycines
  Genomic contig location: Contig_ID=SeqID_35745; Location=1..212; Strand=+
  SCN-specific regions: Sequence locations=1-1,35-175,202-212
gataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcatctgatcagtctagaacgttgggtgataaatgaaaaaaataattaaaaaaaaataatacttgtgtggta

SEQ ID NO: 65229 - DNA, 658 bp, Heterodera glycines
  Genomic contig location: Contig_ID=SeqID_35745; Location=508..1165; Strand=-
  SCN-specific regions: Sequence locations=1-658
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtagaggtatatcgaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggtactgccccgaaatc

SEQ ID NO: 65230 - DNA, 56 bp, Heterodera glycines; identical to SEQ ID NO: 59278
  Genomic contig location: Contig_ID=SeqID_35746; Location=553..608; Strand=+
  SCN-specific regions: Sequence locations=1-56

SEQ ID NO: 65231 - DNA, 598 bp, Heterodera glycines
  Genomic contig location: Contig_ID=SeqID_35747; Location=48..645; Strand=+
  SCN-specific regions: Sequence locations=1-38,61-74,96-120,153 -196,219-504,545-598
atggaattttttgagaaaatcggtaaaagcggatttactaaagaatttattttatttattcttacaaagaaagaaaaataatttaagattttgaatattaacggaaaaacaatttgaatatgttttttccttccaatttttctaaaataaatcaaatcaagatttttaaatttgattgattttgagtgaagctgtgaataattttttttttaaattttcttttgttggtttttttaggtttgccaatattttcaaaatttgtgtttaacctttttcagttccatctggtgtattaacacaacaagaagtgacaagcgtggaacagtactgtagcaaacctaaaatttgtggtggtacgtccggtgggataccgtacccattgaaatttccgtgccatgagcgtaatttgacatttggcaaaattgtgatggaaattgaaaatgtgtccaaatttgcgcatgaaaaaatgtggcacattcgatgcagcaaatttgtgcatataagcggaattccatggagaattgtcgcaaaaataaacacaaacgaagcgttggcattttacctccaatgcgatgtttcaatgaaaggttcgcattaa

SEQ ID NO: 65232 - DNA, 445 bp, Heterodera glycines
  Genomic contig location: Contig_ID=SeqID_35749; Location=190..634; Strand=+
  SCN-specific regions: Sequence locations=1-87,109-350,422-445
atgtcagaatcggagcgagttgttttcaatctcagaatcggggttccaagcctaaagaaagtgatgtcgtcatccttttggcttttggcacagtttaaaatggcacattttttgttgacactctgtctcactttcgcattgttggcacattgtgtctccgcaaaacggcggcccggcttgcgcacttgggactttgaggcgaagccgggcatggacaattcggtcggcaaagcgaaggatgaacaggatgaagatgaggaaaaggaaccaaaagcggatgatggtgtaggggataaagcagtaacagatccgattccgccattcaaaatcagcagcacaacgaggcaagcaaaaatatgaaatattttatttttaaaattatttttttaattttaaatttatttctagtataaaattaaatgagtcaactattggaatccattta

SEQ ID NO: 65233 - DNA, 817 bp, Heterodera glycines
  Genomic contig location: Contig_ID=SeqID_35750; Location=41..857; Strand=+
  SCN-specific regions: Sequence locations=1-349,371-817
taattccttcgggggaccgtgccgggtgccgcggggtcttcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttcaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaaatcgattttttcaagtgtccgtttggggtactcaaacaattatggggagcaaaaatcccacgcaaaattaaagtacaggctatagggaagctactccggaaggattctgtctccccataaatcctgggcgcatccggttcggggggaactggccccgaaaaaaaaaaaaa

SEQ ID NO: 65234 - DNA, 1210 bp, Heterodera glycines
  Genomic contig location: Contig_ID=SeqID_7563; Location=1652..2861; Strand=+
  SCN-specific regions: Sequence locations=1-152,175-246,268-330,352 -516,538-1009,1031-1210
atgcgaagtaaatttatggtaagggaatactgtaaggaaagaagggaagagacgtggtaacatcacaagttttaaatttacagactgatttaggacaaagtacagtattatattccgcggggcagaattacagtaattcctttgccatcggcagcattttaagaaagaaatttgcaatttggaagtggaaaaccagttcaatccacaacaatgcactcactcattcacatcactttcattaccaattttccaatttcaattcccctcaaatcgctgctcaagtggtcggtcgttctgttgtcctttttgttcgcctccttctgaaaaggttttgccaattccttttcaaaattcgcttttcaattcgaatttattttgtataaaatgcgaatgaatcggccaaaaagtccgtccgtccattcatttcatatatttctccgacatttaaattttcttcctaattcctttttttgtaagcaaaaatattcgtggccctttgaaaaataattccgtgggaacagaaactcaacaaaaagagcaagttcagaattgagaatgttttcaaagttggcaattgccttatttttcctttcttttgcaacgaattgccaaattatttggcctttgtttcatttgggaagaactcagtccgtcggggtacgcttttgccgtcgaaaatgcttttctttttatgctttgttttaaattcacttttgggtcactggcaaattgctctgtaacagcgccccggccgcgggaattctcgtcaaattgtacgacgacgacggttcatttttggctattgtttgcttttgccttggcatttcgttcgttttcccaaggtctgtttggcttcgacgatctgttggccaaaggatacaccgaccaaaacggacatttcgccatttacggctcaaccaacgaaattagcaaaattgagccgaaagtgaacatttaccacgactgcaacgacattttgccatgccaacgaaaaatatcagtcggtgccaagaaacagaggaccaaaaaacaattggacaacacaatgttcgttcagataagtgtaccggacggagtcgtctacgaaggccatcgcccgtcggggcttttctcggtcggagtgttggaacttgggaatgactacggaggagaaagtcgagactgttttcatcgctgacattgtcaaaatatccaaataattacaaaaaaa

SEQ ID NO: 65235 - DNA, 305 bp, Heterodera glycines
  Genomic contig location: Contig_ID=SeqID_7563; Location=3351..3655; Strand=+
  SCN-specific regions: Sequence locations=1-305
atggataagcaaacttttggtggagattcttctgccaattcggcagcggaagacaaaatgagcggttgctgttcagaacacattgtggaaattgaggttcaaaaatagagagtggtatttaaaattgagtgatttaaaacgaataaaaattgaatgaattggcctttcagtggaaacatttcgactatctctccgccctcagtggcctttacacggcatcggtcgaacgtcgaaaatgcaatttgcttgtgctcgtgcagggcaatttggacaatttggaagggaaaatggtcgaaatgaattaa

SEQ ID NO: 65236 - DNA, 883 bp, Heterodera glycines
  Genomic contig location: Contig_ID=SeqID_7564; Location=241..1123; Strand=+
  SCN-specific regions: Sequence locations=1-567,590-883
atgccaccaaatacattatttgatcagtgtgtttcagttggattttccgtcgatggtccgggggttggtgttgatccattgcacttcgacaacccacggaattgtcgaaaacatcaaagagattgtgagcattttcaccaaatacttaatatataaacctgccctttacaaaactaagttcgccgggttgcgtctcgaagacggcgaaatgactcattcggcgtggaattatttgctgactcaccgttttggaaatgcacgtcattcccatgcttattaaactaagtgaaaagcatatccattgtagcacaatttggaccaaacccaaaagcattacgtggacttgctgaagtcggtgatgaaccaacgcaatttgagccgttatttgtacagtttcggacaccgaagcgatttcactgaccgactcaaagaaaatttggcgaagtcatttggattttacgtgattttaaccgaaaacattgccattttcagcgtggatgttcttttggtgagcggagcgaaggcaccgcacaacgaagtgaatcttttaaattttcgaagtttcggaaatgcatttaaaatgcctctaaggcaggggtgccagcagaaaaaacttcaatcagaatgattgtcaaaacatcaaagttttaggggcattttgaggccaaaatcagaataaggggattttttaagaaactttgcctaaaaatgatcaaattacggttacggttcagtaccctcgaaatcaaatcattttatccaaattttgtgggataattctttctttttctctcagaatatgatgcacatgttcaaaaacatggccaacgaccgtaccggtctgctgatggcggaggactgcgtggacgtactgtcggaggcg

SEQ ID NO: 65237 - DNA, 166 bp, Heterodera glycines
  Genomic contig location: Contig_ID=SeqID_35754; Location=24..189; Strand=+
  SCN-specific regions: Sequence locations=1-166
gacgccaccgatcgcttcaacgtctcctttttcctcgacgacgacggtgcgccgacgtgcccactcattggccgacttcccgcctctttacaatttttcccagcgcccgttgactcacattcggcacagcagtttgggtgaaaacagtggagcggacccaaatttt

SEQ ID NO: 65238 - DNA, 1007 bp, Heterodera glycines
  Genomic contig location: Contig_ID=SeqID_35756; Location=127..1133; Strand=+
  SCN-specific regions: Sequence locations=1-8,30-323,351-469,506 -767,789-836,858-1007
atgcatttacaagaaaatcaaaatattaaacataaggttaaaaattaaaatttacggggcaattttttttacatcagccctttaaaataatgaagtgtctatggtgagtcatagaaatgccatttgttcataataatacactgccattttatggacaaaatgatgaataacaatgtcatttgtgcagtcaatgaaatttcattcgttaaatcaaatgccaaaattcggcttattcttttcaattattttattatcatccgaaaatgatttttggtctctctgtaaaagcattttataaagtcactcaatgatagctttttgtcaatttaaatattttatttatttttatactttaagtcgcgttttgtttcttttttagcaatgggtttggcatcaacattttcattgctattcttcataaaaattgctctgttctcatggaatgttttgggccaaaaaagtcatcagctaataaacaatttatttattttaagttttaatgggtaaaatcatattttaatgcctttagatgatcgacaacttcggaagccagtaaattgtgaattgctgaaggatggcaattatgtgtgggactgcagcaggtacatgtcaaaaaaacaaacattttgaaaataatattaattgattagtgaaatagccattccgaaaagcatgacaaaacatttagtgggttaattaatggacaagagtcaagacaaaaccgtaacccttacaaacactaatgaactaaaaatagctatcatttttatttgaatttatatttcagttattactcaatttgtgccaatgggcgcgaattgccgatggagtgctattccgggctgaagctgaacccgaacaccaaccaatgcgatacgccaagtttggtggacccgtgccacagaaaacatcggccttcgaatgtgctgtatcgcgcggcggacccgttcaattgccaagtgagcagcggaccaaagggggagatttaggattttaaatctacaaaa

SEQ ID NO: 65239 - DNA, 718 bp, Heterodera glycines
  misc_feature (701)..(701): n is a, c, g, or t
  Genomic contig location: Contig_ID=SeqID_35760; Location=445..1162; Strand=+
  SCN-specific regions: Sequence locations=1-102,124-124,185-338,360 -369,392-504,526-540,588-590,612-718
  Gene Ontology: Mol. function=phospholipid-translocating ATPase activity; Cellular component=trans-Golgi network transport vesicle; Biological process=lipid metabolism
atggagcaggacatgcttctgctcggtgcgacggccatcgaggacaaattgcaggacggcgtaccgcaaacaatcgcaactttggcagcggcgaacatcaaaatttgggtgctcaccggcgacaaaacggtgagcgaattttgaagaattaattttactttaatttttataaatatttttttaaggaaacagcgataaatattggatattcatgtcgccttttgacggaagaaatgcgcgaagtgttcataatcgacgggaaggaggagaaggaagtggaagtgcagctgaaggacacgcgacgacgcatttgtagcgccaaacagacacagcaggcaaaagaaatgaaaagagaaaaataattaggggtaattaagggtaattaaggggattaatggggggtaatggacggtagggagtcaattaagcgggagggaggggtcggaatggagcagactttcaccatcctgactcttcaggtccatttcaaatatttaaaaaaacaacaaaatgctttttaatcatttgttttttaatgggtaattaattattatttattaaatggatattatttttttcatttttttcccttttcttttttctcacatttccccaatttttgtcttcttctaagatccaccgaatgtgcaatcaaaatgagcgcaacaattttttttattctcaaaatttgacactttgtncaattactaaaagcaaa

SEQ ID NO: 65240 - DNA, 661 bp, Heterodera glycines
  Genomic contig location: Contig_ID=SeqID_35761; Location=177..837; Strand=+
  SCN-specific regions: Sequence locations=1-137,159-245,267-402,437-661
atggcccgacgtcgtgatggttggaccaaaaagacaaaatttggggaataaataagggaaaactcgaggaaatttggggatgtgtgtccaataaatttgccacatttttttatccattcccccatttttatagaccaaaaaggcaaagaaggtggcaaggacggggagagcaacgggcagacggtgcaggaacattttgcattcggcgacttggaatactggggcaacgaaacggagacggtaaggaggggaaagaagggagagggatacagtcagtttcgtaatccaaaattagaaattttttttctgcgaaaattttaaacgcaaaagagaaatttttgtcaccgattttaaatttttgaaaaaaacataattcataaaatctcgaattaatttgctgaaatgtttttcttttaattttggaaaaaattacatacttatttttttcagaataaaattttaatatcacaccaattttgaaacagaatttcccaatgccggacggggtggacaaattcaccaaaattgcctcaatgaatgctgaattggtggcactggcggacaacggccaactttacgcgtggacatgggcaaagggcagtgtgccgtcaaatgtgccgcatgttgtcaacagtcaatttgcaatcacaggttgagaaaa

SEQ ID NO: 65241 - DNA, 1150 bp, Heterodera glycines
  Genomic contig location: Contig_ID=SeqID_7565; Location=207..1356; Strand=-
  SCN-specific regions: Sequence locations=1-164,186-286,309-878,903 -1150
atggaacaggagcgcaaggcacgacagaaagcggccaaaaaggccggcggcggcgtcgtcaaaaaacagtccaaaaaattggcgacgaccaatccgttgtcgtccattgaggcgctggcgaagcgagtggccaaagacgaagtataaaatccaccggaattgattgttttgtttttaatttggaaatttaatttttgttgagaaaatatcatgaaaaaatggcattttcggcagttttgtttgcttttaactaactaataattagggggttatatttttactactattttaatttaatgaattaacttacaatggcaatttgtgcaggcgctgtcaacaaaaaaaaatagaaattcttggaggggcacccgaagagtcccaaaaatttttttattcaatgtatttttctaaattttcggcgccgagggagaaaaaaaaggaattttcgccaattttggtcattttgggacctattttggaaaaatgggacccagccatgtctttaggcgtctgccgtgaaaaatttaaaaaacttttgcatcaaattccttaaaaaaatgagttaaatttttcaaaaattcacccgattttctttacaatttttcaggggtcagccatttcatttatttttttttacaggacaattacaatgccaaccaatttttggtggattcgcttccggaagtgccgggcgcgacgacggaaaacagtgacacaaaagccggggcccgtgccaatgccaaatcggtgcgttcatttgcggccgaagttcgacggaccatcgaaaatgcggacattgtcattgaggtgaatattggcggaaaaaaggatttaaacttgtctgactgtttccacttggatttggggttttttttgccaaaataatttaaaaaatataaaaactggacgaaacaaaaaccagtttatcaagttcatggcgttttactaagtccttggaattttttttttaatggcgcctctcacatccagcaaaatccttcaccagaaaatttcaatctcctgaaaagttgcattttactccactcaaaaaattcgtattttgtacggagcgccccgacatttgtgcctatgtccaaaattggacgcaaagttgaattttttaagccctgatagcctaataagcattaaa

SEQ ID NO: 65242 - DNA, 3220 bp, Heterodera glycines
  Genomic contig location: Contig_ID=SeqID_7565; Location=2491..5710; Strand=+
  SCN-specific regions: Sequence locations=1-22,45-710,736-1084,1107 -1249,1272-1678,1714-1760,1791-1902,1927-2038,2072-2132,2157 -2188,2214-2237,2263-2307,2445-2910,2936-3072,3095-3151,3181-3220
atggagcatcttaccgatgcgcctccatgggcttccgcaatgttgggactggtgaaccaaatggttggaatgtgccgcgagctgatctccatggtacgcgagcaggacggaggaagcaacccgaacagtgtttttgacgaagaacgacgactgcacagcgttgtcatcgcgcaattgcaggaaagcaacagccaaacgccaactcaacgtgcaaccgatgacttggcgaatgtcaaagaactgatggaccattgtgacatcgaatgcctgccgacccaagtgtacagaatgggcaaaaaacaagccgacggacgtccaaggttgctcaaagttgaactcccgaccaaattccataccaatttatttttgcgcaacaaaaacaaaatcaaaaattttaacaaattttccaaagttttgttgcgcccctccctatctaaaagtgatctcattgaccgtgcccgactcattacactgtgtaaatctcaacgtgaaaatgacccatcctgtgattatattgtctatgcggggcatgtgcttgcccgcgacgacattcccgcctttaaatctgacctcaattttaaatgtatttgtcataacaaatcttaatgtgttttgggtgaccactcacgaggcaataaccttaatttagctcttttacaaactaaatatagaaaatttgaacaccccatagaaaattcgaaaactttactaaataaaaaacaaaattttttatattcaacatttatcaatatgcgatccctaaataataagcttaacgaatttactgcgattatagccctaaaagattttgaattagtttttgtaactgaaacgtgggcaaaagaaaaaatacctttccaaccatatatcactaacaattacaaaatatatgaagctagcagaagcggaaaaaatggtggtggagtaatgattttgacaaaaacgagcgtaaattctttttctgtcttatctgctctaaattcaattgtaaaatccaaattattcagataaatggagcaaaaaaattaagaatagcattactttacagaccaccgaacacttctgctaatttcacaaaaaagattctgaacctcaattttatcattatgggagattttaacctaaatgcaaaggacataacttggaccagtggaacgccttatgctaagtcggaaaaaggaaatattttttgtgaattttttaataagtatggcttattccttatgacgaacggcccaactcgtggtagtgcttggcttgatctgattctctcttctaaacctgattttgttaataatgttttaattgaggatatttttagttctgatcatcttaccactaacttttcactatcttttcccagtaatagaactaaaacaaacacatttacagtacgcaattataattctactaaacttaatctactaaatttaaacttatcttcaattttaccctacaaattactacaaaaatttaccattgaagataagtttaatcatttttaccttctttttagagaatatgtagaattatacttgcctaaaatcactgtcggtcaaaaatccagaaagcctaactacccattgagtcttaaactgtcaattaaggaaaaagccagactttataaactacaaaaaataaaccgtgataaatataggcatttgtatgatagcatttcattacatataaaaattcaaataaataactttgttacaaaaaatgaaaataattttttgaataaaggaaaaaatgctatctacaaatatattaataaatttacaaaaaattttgaacaaattcactctattaattatgagaaccaaactatttttgatgattacttaaaagcagaaatttttgcaaacactgcccaagtgtgcaaatggcctaatggctagtctccttgactttcccttcttctttcccctggttcaatccctctacagaaattagattattttcaatttttttttttgtatactcgtgggtttcctataaagaaaatatgattcctcatagtttttttttaaattgatacatattttatcattttttaaatgaaaatcctaccaattgagcttaataatcgcaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaagtgatgtgaaaatcaaatctgaatttctattaatattcgatgatttggtccaaaaatgattaattgtttgaaataattgaagaaaatttgtttaaaaattttcattaatttaatttattaaataaaaaaccaaataattttgtattattttcacttgatataaattaaaatttgaattttttttttaatttttaaaatttttttgaatttttaaaatttcccggttggtcccggtttttcttgcggtcccggtcccgaaaaaaatcgaggtcccggtcccggcttctcaggtcccggcaagtcccggtcccggttttggcaaaaattcccggtcccgtggcactctagaaaaaattattgcaaaaagcatttataacttccttcatcagaataatttaatatccgaacatcagttcggttttgttaaacaccgatctactaatactcaactaattacagtattagaagattggtacgacagcatatacggtaagaaaaatatcgactgtatttatgtggactttcggaaagcttttgattcccttcctataaacattttaataaataaacttcataacattggcattaagggaaaactgctaagttggttatctgaatttttaagggataggtcttacagagttaaaattaacaataaatcttctaatttacatccgattcagtccggtgttccacagggttctgttcttggcccactgttatttttaatatacattaatgacctcccgcaggtaatcccttcggtagttagcatcaagctttttgctgatgatgtcaaaatttatgtctcttacaaaactcgtgatgaaagaagcaaattaaatattgcattggaaaatattggaaaatgggctaatgcatttggtttaaacatctcccaaaataaaacatttattcaaaacaacaatataaattatttaacaatattattaatgaggttgaatctattagtgatttgggcattttgattgata

SEQ ID NO: 65243 - DNA, 413 bp, Heterodera glycines
  Genomic contig location: Contig_ID=SeqID_35765; Location=368..780; Strand=+
  SCN-specific regions: Sequence locations=1-67,93-413
atggctcttgtataaattggttttttaaaatttttttgaatttgtccctgttaagagtgaaatgggcattttgacttaaaagctattattttgtttagttttagtgtccttatcttccagctttggcctccgtgaagtacacccggtggttgaccgtgtccagcgccaggtggtccagctcggccaggtcgatgttcaccaacaccaatgggttgccgccgtccatgtcggcacgtgccacctttgtggccacaccgcccttgccttggtcaagccaaaacagcaggccccgatcagaatccaccgcaatggcaatgggttgcgcaaccgcggtcggtgtttgatcattgtgcaggatcaccgcccggaactgttgttgatcagagggagaggatgatttttattgaaaatca

SEQ ID NO: 65244 - DNA, 246 bp, Heterodera glycines
  Genomic contig location: Contig_ID=SeqID_35767; Location=608..853; Strand=-
  SCN-specific regions: Sequence locations=1-246
cccctgtccgtggcgcaaccaatgccaatgagtacgataccgttgcaaccaatgtacccgatgcaacagcatatttatggcccactgggacccgataagaatgatgcaactaaaccagggacgactccaacaccaacacgcaccgagtgcggaaccgcaacaggcgcaacttcccatgcaagcgtcgaatgcgcaatggcaacaggcgcagccgcaacatccgatgcaaccgaacggaatgccagg

SEQ ID NO: 65245 - DNA, 304 bp, Heterodera glycines; identical to SEQ ID NO: 51570
  Genomic contig location: Contig_ID=SeqID_35768; Location=260..563; Strand=+
  SCN-specific regions: Sequence locations=1-304

SEQ ID NO: 65246 - DNA, 444 bp, Heterodera glycines
  Genomic contig location: Contig_ID=SeqID_35770; Location=24..467; Strand=-
  SCN-specific regions: Sequence locations=1-444
atgggtgtattggtttggggggaatgtttagaaaaaaaaaaaatagattttttaaagtgttggtttggggtattcaaataattatggggaggaaaaatacaacgtagaattaaagtacaggttatagggaagctattccggaaggattcggtctccccataaatctgggcgcatcggctcggggggactgccccgaaaacaaaaaaatcgattttttcaagagtgccgattggggtactcaaacaattatggggagcaaaaatccaacgcataattatagtacaggatatagggaagctattcccgaaggattcggactccccataaatctgggcgcactcggatcggagggactgtcccgaaaacaagacaattgattttttctagtgtgcgtttggggtactctagcaattatgaggagcaaaaatcctacgctgaattaaa

SEQ ID NO: 65247 - DNA, 309 bp, Heterodera glycines
  Genomic contig location: Contig_ID=SeqID_35771; Location=122..430; Strand=-
  SCN-specific regions: Sequence locations=1-30,53-117,139-309
atggtaaaaagtcgaaatttttaagtttttcttaataaattttttacaggctagaaagtcttttcgcttttgtaaggctaataaagcatgtaacgagccgtatgctaggacaatttggattttgttgacaaagaaaaaagttataatccaaagacgtgctggggcccaactgagcgagtccgtgacaaataatgctaaaaaaagtcttacaatcaatttttcattgtcatctttatggtgaaaatttcgaacaaatgaatttttgtctgtttgtaaaaagacttttttccactaatgtacaaaaataaa

SEQ ID NO: 65248 - DNA, 1469 bp, Heterodera glycines
  Genomic contig location: Contig_ID=SeqID_7566; Location=2837..4305; Strand=-
  SCN-specific regions: Sequence locations=1-333,357-619,641-700,722 -848,877-1089,1111-1469
atgcagaaggtttttaaattgaaaactccattcatctcaatttatattgcccgtttcattcagtgcttattttactatgctggccataaaatatggagttttgcaggttcgaaagagctcggcgcgctcttcatattcagacgtatcaactaagggcctatcgccactctcaggcgagatatggccaatcaaagcagagtgtgacgcataatcacgaagcactgctccagaattcttgtaatgtttcacggcagatttttgtgataatttttttcactgatttcttttatctctacgcatatgcattatttgtttaagctcaaggccttatcgaaaaaattgtcaataaaaacaaagtttgtttaatgaatatttacatcaacaaattaatgacaatttcgaaaaagaaagtcaagtaatttttagaagcttttatttcatgttttgttgctcacttgttgaaccgcacatgagccgttggaaatattttcgccttttcttggcaagttttttcccgaactgtttcacgacagttaattgagtcaattattttcgccagtttcttttatctccaagcgttagttattgcatttcacttaccttggaaaaagattacagtaaaataaaatattgttttgtgaaaatttacgacaaaaatttatcgaccatttctaaaggggaaggaaaataaatgtttgcctaatatattaatttatattttcaaatgattgaaccgcatctgttgcttatgtttttaatattttttgattttgccatatattttggctttttggaatttttccaatgtccgaaaatttatgtttgcttttacatgataagtaatgatttggttatttttgtatttttcttcttttcatcatgaaagtcatttagccattcatcccctctaatgaaaatagttttctgcagctgatttaacaatatttttctttgcactatacatgtagtatagcactggttgcgccttcaattctgccccttaatagaaggttcctcagcaaaaaataatactttctcaacaaatgaattcgcttcgcccaccccttagtattgtgataaatctcgaataaaaaattctcaactattttcccaaaaaatgcagaaggtttttaaatttgaaaactccattcatctcaatttatattgcccgtttcattcagtgcttattttactatgctggccataaaaatatggagttttgcaggttcgaaagagctcggcgcgctcttcatattcagacgtatcaactaagggcctatcgccactctcaggcgagatatggccaatcaaagcagagtgtgacgcataatcacgaagcactgctccagaattcttgtaatgtttcacggcagatttttgtgataatttttttcactgatttcttttatctctacgcatatgcattatttgtttaagctcaaggccttatcgaaaaaattgtcaataaa

SEQ ID NO: 65249 - DNA, 273 bp, Heterodera glycines
  Genomic contig location: Contig_ID=SeqID_35776; Location=1140..1412; Strand=+
  SCN-specific regions: Sequence locations=1-103,139-273
atggcaatccttttaaaacccacaaaattgcccatgcctttcggtgtgacaatgacgcaattttggccaattgccccgggctttcttgggatttatttggtagcttttaaagaaataaaaaaggaaggcatagaatttgtcatcgctgcattaattaattcatcctcagcttccaaatgcgcatttatttcagtgtcggcactttcgaattgttcgaattgctctcgagactcattagctctttacactctgactaatgagtcttttttttaa

SEQ ID NO: 65250 - DNA, 755 bp, Heterodera glycines
  Genomic contig location: Contig_ID=SeqID_35780; Location=85..839; Strand=-
  SCN-specific regions: Sequence locations=1-755
attaattgaaaatattgatttgtattccggttattcttccgtaaaaaatgacgccaccttagccattatgcctagaaaaaagagctctttcgaatggtaccttcaaatcaaaaaacgactgtcagggagctgagctgcagaaaaaaattccaagccaaggccaagccactatagcagtatagtgtcaaaaattaattgaaaatattgatttgtattccggttattcttccgtaaaaaatgacgccaccttagccattaggcctagaaaaaagagctctttcgaatggtaccttcaaatcaaaaaacgactgtcaggaagctgagctacagaaaaaaattccaagccaaggccaagccactatagcagtatagtgccaaaaattaattgaaaatattaatttgtattccggttattcttccgtaaaaaatgacgccaccttagccattaggcctagaaaaagagctctttcgaatggtaccttcaaatcaaaaaacgactgtcagggagctgagctacagaaaaaaattccaagccaaggccaagccactatagcagtatagtgtcaaaaattaattgaaaatattgatttgtattccggttattcttccgtaaaaaatgacgccaccttagccattaggcctagaaaaaagagctctttcgaatggtaccttcaaatcaaaaaacgactgtcaggaagctgagctacagaaaaaaattccaagccaaggccaagccactatagcagtatagtgcc

SEQ ID NO: 65251 - DNA, 2503 bp, Heterodera glycines
  Genomic contig location: Contig_ID=SeqID_7567; Location=530..3032; Strand=-
  SCN-specific regions: Sequence locations=1-192,214-540,562-576,598 -700,724-796,860-945,973-1193,1234-1335,1357-1420,1449-1507,1529 -1645,1667-1934,1959-2075,2097-2173,2195-2243,2265-2472
atgactgatcagtctctacaggtgttaagcaatataaagcgatcaggaaatgtttgtgcttagagtaatatgagaggatgagcaaagtgatcggatgggaggagagtcgaacatagagcccggtgcgggattttgcggatcccattccgcaatcccgcaagctcaattcgtccacgggaaatagatgaagtggcaaaaaatttcttgagtttataattttggaacggagcatatacctagatgtaaataaaaagtaaatgactaaattatgagtacataagtatttgtttttcattggattattatgttgtactatatgtgtcagggctgttccgggtgacccgaatcccccgacatttttccgtcccgaaacctgaaacccgacccgatatttttctcgtcccgaaacaattggataaatatggtaaaaaactcgttttagaagaaaaaaaagcaatttcttgagaaaatcgaccaaaaatcgaaattttccatttttttgcttatttttgacataccaattttttaagaaaaattaaatttcatcaattttttcgacaaattctgctaaaaaaatgactttttcagaaattttttcggtctttaggggtcaaaaaggccaattagctgatgagggccgttctaatagaggttaaaaatatggaaaatatggatatggaaagtcatcctagaagcttcaaaacaggctaaaaacatgtttttcttgcgtttcaggcctcccacagtccaggaaaaaaatatggatttccatataatttacaaactctagtaataataaacaaagagggaaacaaactaaattttaaattattaacttttatttattttttaattttttgtgtccgaattatgctcaaataaagacgataataaaaaacattggaaaagagaaataattcaaaaaatgtttctgttatttgaatgttattattattattatattttatatttgttcaaaatttccgacttaaatacccgcaaattttttgggcctcgaaatgatgctattatccctacagctgaacaccagcagatcaaaatttaatctatgatttttccttgacctgtaaaagaaaagtcggggaacagaggtaacaaatttcctgacaagatttgtcagtatggcttgagaaatttaaaaaatataggtgagcaaaatgcttgtcccgaacaaattaacttaaatcataaaaaaaaatttaatttttttttgtcttggatggcacaactgtactgacacaaaatcgccaccctcgagatgtgccactgtattagacacgttaagttaaaaaaatgatgatttttgaaaataattttgatgcttttccaaccaattgaataaccttggtgtatcatttgaaagctcttggaaagaaggaaaatattaatcatagggcccaaactcaaaaacacacaaaaacacttttaggttttcttatgcgctgaaaacgattaagcaatccaaagtttttaagcactatttaactttaaaccggtttttgaaagagttcaaactacggagaaatgtacaaattgggctctcctaaccatttaaaagggtcaaagccgggcaaatttggtatcaatcggcagctcttgatgagttacatttaaaaccaatgaataaagtctcaaagttaaaaaataacaattttgtgcataaaagaataaaaattaacttatttcttcggtactgaaaaatctattttcactgggactcagttgtctcggtgatcagatggcatcagatacttttattgggtcaaattattaagacagatttgacggatttaaattagctaagcaaattgaaaaacagaataagtgaaattattcagaacacataaagcaaaagaaattgcggaatgctgagatcttggcaaatcccatgcccgtctcttaataagattatgaataaatatattttttattaatttcaggggagggtgggaggctttaagagagagagagagaatggctttgaatggctcttcaaatggttcttttataggctcttccaacggggcggaggcgttcctggcacggatgagcggcagaagacagaagaacaaccaagagatcaatggagcaaaattggagaatactttttttatgggataaatggggaaaggcggagattaagggggaggggtcacgggaaaggtggaaaaaacggcaaaattcctttggaacgaacgatttgatccggctccaaagttggcaaaagatttcttttgaaaaagatttattggtgatcattgatcaacagcagtgtccagttttatatcctaaaaaccttgtgtgccaaaaaacatcgccacaccacctgaaagctctcctttgttttaattgtgaattttttaatcccgaaaccggtccggatcaaagttctcttatccttacttatccggaattttcaagagtcggctcttgttaacatcaatataatccaaattttttatttaatataaagaaaaataaa

SEQ ID NO: 65252 - DNA, 1934 bp, Heterodera glycines
  Genomic contig location: Contig_ID=SeqID_7568; Location=523..2456; Strand=+
  SCN-specific regions: Sequence locations=1-273,324-420,443-447,470 -500,542-552,574-674,700-933,967-1327,1387-1550,1576-1891,1913-1934
  Gene Ontology: Mol. function=protein binding
atgaacacttccgatgtttttgaggcaatgttccgttttgactcccaaaatggaaaagcggaaaatggtattaatattaatgatgtaaaattgggaaatccaattagtctgctaatttccctaattaatttaattagcctcagctaattgtcctgttgtggaggtccccgacattgaaccaacaacgttcaaacttatgttgaagtacatatacgtggctgattttagcgaattaaacggagaaaatgcaatggcagtgctttatgccggtggatttatttttaaattaaattaaataaataaaaaataataatttttaattagcaaaaaagtacaacatccccgccctggtcgaccgatctttgcaaattcccatctccgaattgcgcaatgttttcatggcttatgcctatgcttgccttttcgaattgaaggttggaaggacagatttaaattcatattttaatatatatccccctaatttaaaaggatcatcagtgtttttttgtataatttttgataatttaattatattttttaaggattttgccaacaaatgtctgtcttatatttgtcaaaatgcagcccatttgttcaagtcagatgactttttggaaattgatcagaaaatcttttgtgtgcttctcgatcttgatcgtttgttgctaagcaatgaatttgaaatttggaaaactgtaatttcgactttttctttttttcatttgcattataattttcgttttttttcaaatttaggcactccgttgggccgatgaaaaatgtcgtcagaatggcattgaatgctcctcggataatcgtcgttctgtacttggtccggcattgttcaaaattcgttttccaaatatccctgaggaggatttttcaaaattcgttggtaatcggacaataaaaatttgaattttcttttggggcatataaatttttacattttttttttaaatttttcagttccatccggtctgttaacagtggaagaagtgtttggcgtttatcagttcaattcccatccgaatctttatcttcgtggagtgcccgagctgtactcgttgaaattcccaagccatggacgaatttctgattggaacacagccaagcgcaacggaagagggacactggcgttggaaattgaaaaagtgtcggaatttgcgggagagtctgtcgggggttaccgatgcagtgataccgtatacatcaacggattggcatggaatattcaagcagaaatcagggaaggcactgctgctgatgatgagaagaaatatttgggatttttcttatggtatgagcgaacaaaacacggtacaacaattttaattaataattaaaaattaaagaaaaattaatatttgttttttacaaataatagaaaaacctttgaactgccttttttcggcaacatttcgaattgtgtcggaaaagagcgaaacggagaattccattgggacactttgtgattataacaatcaaatgaacagcagttggggatttggaaatttcattagctttgaggtgagtgccaaattgtttccttaattaatattaattaataattatggctaattaaggaagtggtcaacccgatcaatggttattataacagagaagaggacaaagtgacactgaccattgatgtcatgactgttgatgaaccaaaaatggacaaattcattttgggtcaaaacaaatcgacagggacactttttatggaaattgaaaaagcgtcggaatttgggcgagaagtctttggaagtgatcgaaaaagtgaaactgtgcacatcaacggattgccatggaaaatattggcaaaaattcaaacgaaaaatggaagcgttgacaatgagaaatggttgggcatttacctttcgtgcggtgctccagaaaaaggtgtaaatgaactaccaattattgcctaa

SEQ ID NO: 65253 - DNA, 633 bp, Heterodera glycines
  Genomic contig location: Contig_ID=SeqID_35783; Location=127..759; Strand=-
  SCN-specific regions: Sequence locations=1-87,109-633
atgatattacctgataacatattattcattaccctaattaaaaaattttttagaagagctggtcgaacggatctgtacggatttgaatttgtgggaaaaatgttaggtttgtccttaaaagtggttacgaaaaatttgaattattttatttgctaaaattgccgctaaaaaacatttactttctatatttctgttgtttctataaaaattatcttaaaaaattgttatggaagcgctacgaaaatattgaaaagattttgaatccgaccaaattttgacaaaatatttggcgactggtgggtcaaaaatgaaagagaagaaagtttaataaaaattgaacaaaacgcacaaaatgattattcaacagttgatcagagtggtgaagaaatcgaaagcgacccaattgatcaatttactgataactctgatcaaaacattgccaaaagagaaggaggaaaatgacgaacaaaaaagtgaaataattcaaaaatttgataaaattaaagaaaagttaagagaaatgggaaaatggaaaagaaaaaatccaactaaattgagaggaaaattggaaaattattaggcacaagtcgccataaaatatacaaatggaaaaacgaattaaatttaaataaa

SEQ ID NO: 65254 - DNA, 600 bp, Heterodera glycines
  Genomic contig location: Contig_ID=SeqID_35784; Location=156..755; Strand=+
  SCN-specific regions: Sequence locations=1-304,331-550,575-600
atgcctataacaaatctgacgtccatttcgaattgcgaattcgataaaaggtgtaaatgtgagttaagttaaaaggcaattttcgattttttgttcacggataataacgataattcctttgccaaaagttggtgtttgttgtttattgaaaatgatcggccatcataaacaaataacaagtcaacacaccacacaccatcccaaaaacgagagatgaaccaataaatagagaacatagagaaaaatacgtctctcactttagcgtactatttctttactctgctaacctttttctgataggcctaactaaaattttcaagaaaaattttcctaaccccctaggaatttttttcgaaaatttccccgattacaagccatttttggcttttcaggtcaccatgaaggagtgatttgatcaagttggtgtaagagacttttttgatcagtatcaaaagttagcttagcagaaattttttcagaatattttgcctacttggaattgaaattttggcgattaactattttgttcatttacttttgcacctgactgtatttaattataaaattatattatcaagacattacagtataatttttgta

SEQ ID NO: 65255 - DNA, 396 bp, Heterodera glycines
  Genomic contig location: Contig_ID=SeqID_35788; Location=538..933; Strand=-
  SCN-specific regions: Sequence locations=1-396
atgaaatttgaccaatttgcgctcgtgatttttctcgacaaaaccgaccaaagcaagttcgaccagagaagagaaaatgaaagagacgcagacaaagaaccaaagatcaattgcctgaggcaaatttggccatttttggaggaattcaaaaataagagagactttgacgaacgaaacgcggggcaaatttttcacgacatttccgaattggaaagtcaatgccatgagactgaagtgaaacaaaatgatggaaaacggaacggcaaacgaacggagaacgaacgacctggacacgccgagagtgatccgggcggggagtgcacgactgtccagccaaaaggcgatccagctgacacaggggggataaaacaaacccatttaaatcatttggataag

SEQ ID NO: 65256 - DNA, 1367 bp, Heterodera glycines
  Genomic contig location: Contig_ID=SeqID_35788; Location=1..1367; Strand=+
  SCN-specific regions: Sequence locations=1-270,292-304,326-332,376 -979,1008-1060,1082-1367
  Gene Ontology: Mol. function=glycine-inhibited chloride channel activity; Cellular component=integral to plasma membrane; Biological process=cell surface receptor linked signal transduction
gatgcgtacaccctgaatttgtcggattgggcttttcaggcgcttgggatcagctgaaagtcacttttcacttcaaacgcctctacggttattatgtgctccaaatgtacctccccacttatttgtccgtctttatcaggtgggccaattcgaatgggtcaatcatgataaattataacattctaaatttaaaaagatatggcaaattactcaaaaaataattattttctggccttgagctatcttaaaatctcaataatttttgattgattgacaacaaaaagttcttttccaaaacacaggcggttttttgggatgacaagcaaaagaagaataataaaatttaataataaagaaaatttataaatttatttactggtagagactaccggtttctcttatattcaacaattaacaattagttatttttgggttaaacctgttttcttttagtttacgggtggcgcgtccgttaaaaaaagccgggggttagccgccccctccccgtaaccaattttgactaatcccttaatccaccttatccaaatgatttaaatgggtttgttttatcccccctgtgtcagctggatcgccttttggctggacagtcgtgcactccccgcccggatcactctcggcgtgtccaggtcgttcgttctccgttcgtttgccgttccgttttccatcattttgtttcacttcagtctcatggcattgactttccaattcggaaatgtcgtgaaaaatttgccccgcgtttcgttcgtcaaagtctctcttatttttgaattcctccaaaaatggccaaatttgcctcaggcaattgatctttggttctttgtctgcgtctctttcattttctcttctctggtcgaacttgctttggtcggttttgtcgagaaaaatcacgagcgcaaattggtcaaatttcatcgggaaaggctaagccgacgcaatccgcacaaacattcgacaaggcatttcccttttttggaattttaaaatttcatttttaagctccaaaccgcgaaattctctcgctctccctaccacaacacttaacaataattcacaaaatgacgatcaaattagaaatggcgaagttgtgagaagcggatcactgctcaaaagggtgtacagtcggcgttacagtttgctaaggcatagggccagaaggtaatcgtactgtaatagacgtactgtcattctttgcggcatactgtatgcaccacttgttcctttaaagaagcttgatctacgacgatgatgaagcgtatatgcactggcgaacgcccaccgagctgagcaaccgcgtggacgcagtcgccgcgcggcttttcccggcgttatttgctttatttaatggt

SEQ ID NO: 65257 - DNA, 304 bp, Heterodera glycines; identical to SEQ ID NO: 51570
  Genomic contig location: Contig_ID=SeqID_35789; Location=397..700; Strand=-
  SCN-specific regions: Sequence locations=1-304

SEQ ID NO: 65258 - DNA, 234 bp, Heterodera glycines
  Genomic contig location: Contig_ID=SeqID_35789; Location=776..1009; Strand=-
  SCN-specific regions: Sequence locations=1-234
gtataaaatttctcaaaaaaagagatagccatttttctgggataacgtatatatataaaaatcctctcaaaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 65259 - DNA, 222 bp, Heterodera glycines
  Genomic contig location: Contig_ID=SeqID_35790; Location=625..846; Strand=-
  SCN-specific regions: Sequence locations=1-182
atgccaatgtcatcaaaagctttttcgacattttatatagggaaaggtgcacaaaaattaaatttaaattgcagttacagaggaatttgtacgaaatgagcatttcccgtgcattgtgaaggaatggagtgaaaagggcagatatgttgagcacttacggcgaaattcgtgcatttcgtaggtaaatttttaaaataattaaaaattttatatttaaataaa

SEQ ID NO: 65260 - DNA, 128 bp, Heterodera glycines
  Genomic contig location: Contig_ID=SeqID_35791; Location=160..287; Strand=+
  SCN-specific regions: Sequence locations=1-128
atggagattatgacatccaaaacattaaacgagccaacctcatttaatgttaacggacgagttcatcgaccggaagacggagcagagcaaaaccaccaaacgatgcacggagcagcggatgcgtctaa

SEQ ID NO: 65261 - DNA, 250 bp, Heterodera glycines
  Genomic contig location: Contig_ID=SeqID_35791; Location=652..901; Strand=+
  SCN-specific regions: Sequence locations=1-250
cagtgatgcagggcagtgagtcatcaccaagactaaagctgtacttttctcaacaattcagtgactgatggggttgtgatgacggctgatgaaactgaaatttcgcaacagacttggcgcccacagtagaaaagaatgattgacaaatgtgcaataattttaacatccataagttaatagtttccggattatgaactatggactgtctcgtaattattgtcgttttttgataaagtgaaaaattcaaaaa

SEQ ID NO: 65262 - DNA, 1495 bp, Heterodera glycines
  Genomic contig location: Contig_ID=SeqID_7570; Location=475..1969; Strand=-
  SCN-specific regions: Sequence locations=1-72,94-1410,1437-1495
atggcactactcatcaacggcaccgacaaacactacgacaacgcgtacagagaggacagttatatcactctgcaggtgggcatcagaagcagggccatgtgggcaaagcaggccacttagtggtgcctaattatgctaatgagctaactgactgacataattagaactgatcattaccgttaactgagtgtttccgtttttaatggtccattttaggaattgcaagacactttggctggaacagtgagcaaattgtccaaatggcctattctctttgagtcttttcagattaattggccaagatatctgaaaaatattttgccaaacgaagtgattagccgaaggtattccgaagcaattggaacagtcaaagtgcgaattgcggaagttcaactgattaaagttggagccaacttggcaactcaactcgcacaaaatgaaatgttttcagaaattcgaaaaattggcacggagtctgtcgggacaaatactcagtgattacatggattggaaagtgatcctcagcggaattggccacttggacaaccgctttttggaggctcaatttgtgcgcatggcttcttcccatttgtacaattgttttttaaaccatttaaggaattggaccgcgttttgcaaggatctttggcacgtcccgcccaatggaaagaatgcaaaaacgttgtgctcggcttcttccccgctctgatcgaaagaggcgatttgacaatctttttttggcatttctttcccttttatggtcacttcactttcagtttatattcaccggcatttggaagtgaatgcaaccaaaacgcagttgaaggaaatgttcgaagatgtgaagacgtccttccaccaaatgctcgaccttaatttgtggatggagcccaaaacgaagtcggaggcattcgaaaaggtcaaaagggtgccatggaggggaggggagactgagcattggcactttggcatgccattatttgccaattcaatcaaaatgccaatggtttgttcaacttcagcttgagagactcaatgttttgatcgaatacatggacgccatttttaatgaaacgaaactaaaaaatcatttcaaagaggtcggtcgttctttacaattgccaatcccccccccccaaaaaatgcgtttcctctcgagtacgacgtgcacgaaaggacagactttccccgaaatggccttttctttgtccaaactgatgaaccgcaaaagtttcctgcaactgctcgagcccgttgaagtggaattcagcagtttggtgatcaatgggttttattacccaattaaaaattcaattggtcagtctttccatcccttttatttgctgagttaatttactcatttcagttcttaccggaggaatccttcaggttacaaccaattccagcaccattttaattttttttttttattatttgacaatttaagggcgtttttttcaattcctcccgaccgatgtaaaacccataaaataaa

SEQ ID NO: 65263 - DNA, 829 bp, Heterodera glycines
  Genomic contig location: Contig_ID=SeqID_7570; Location=2396..3224; Strand=-
  SCN-specific regions: Sequence locations=1-105,128-218,240-829
atggccaatttggacagattggaggccaaaaatgtgaccattttcatcccggaacttcacttctcttcccaaaacggagtcattgaaatgagcagcttcaacatcactgccgacttcctggaagtgaactcagcagaaggtgggcataagtcagacaaggcgcagcggaattggggcattttccgaattttaatcgctttaaatgagtcgattaaaacattgcttaataaatacaaaattacggatgctatgtttaaactctctgcttggtctgtccctcccaattaccgtcgtttgtattttcacccatcctccgtaggtggtgatcagcaacgagccgactcttcgccgaagacaccgccgcttctgccttttgcaaatgaacccttctcgtcaccgagttcttcgttcggttcgaatctgttcgaataccccgaactcgttgcatcgctaaatctgagtttaaacccgtgcgataatttctatgaattcgtttgcgatggatggatgaagtcgaatccgatcgacgaggacaagacgagtgccaaccaattccaactgatcaacaatttgatcgaggacagagtgaagggtcggtcagctcattgccaacaattcgacttttcttcgattattgtgtattgttcagcgattttggacgaccgtgctcatttccatgctcttcccccctacgatcggatgatgttcgccatgttcgatgcttgcatggtcacaattgtctcccccttttgttgaccctttcgcttttccttcaggacaatgtcagtcgccgtgtggcgggcagcaacattctgctgaaaacattaaa

SEQ ID NO: 65264 - DNA, 179 bp, Heterodera glycines
  misc_feature (18)..(18): n is a, c, g, or t
  Genomic contig location: Contig_ID=SeqID_35793; Location=1..179; Strand=+
  SCN-specific regions: Sequence locations=1-115,139-152,176-179
ttacgcatcggcaacacncaacggcccttaatggcgcgagtcgatgtcacgaggggaatcacttacgaccttttgaaggccatttcctcttcatgcaacaacaacaaacggggcgatagtaataaataattgtttttgctcaatttccatttgcctttttgtgttttaaaattttactt

SEQ ID NO: 65265 - DNA, 297 bp, Heterodera glycines
  Genomic contig location: Contig_ID=SeqID_35794; Location=559..855; Strand=+
  SCN-specific regions: Sequence locations=1-297
atgccgttatcttcgcccgccgatgccattgcaattgtcgcatttgtgttgaagccgacgccatacattgaagaatttttgcaccgtttgtctttgttggaatatccggacaaaaacagtcgtgtcaatctgcgcatttacaacaaccaaatgtacaaaaaacgacactttgaaacttgggcaaaacggcgaagcggaaaaaaaaagacgatttgggattgtgcaaattttgaatggcacggcaaggggcaaaccaaaattccagcggaagcaggggcagtgaaatttgaaatataa

SEQ ID NO: 65266 - DNA, 208 bp, Heterodera glycines
  Genomic contig location: Contig_ID=SeqID_35794; Location=1..208; Strand=+
  SCN-specific regions: Sequence locations=1-55,77-208
atttctccacaagtccgacaaaaacagcgaagattttgtcatggtaactaacaaatacatttttgttccttttaaattaccatttttttcctgtacagcttgaaaattttctgtacaacaccaacccgctcattttgcatggcaatgggccgtccaagtcgcaactgaacgtgctggagaattacttgactcgtggcaaaatttatca

SEQ ID NO: 65267 - DNA, 159 bp, Heterodera glycines; identical to SEQ ID NO: 53078
  Genomic contig location: Contig_ID=SeqID_35795; Location=224..382; Strand=-
  SCN-specific regions: Sequence locations=1-14,52-159

SEQ ID NO: 65268 - DNA, 885 bp, Heterodera glycines
  Genomic contig location: Contig_ID=SeqID_35798; Location=141..1025; Strand=+
  SCN-specific regions: Sequence locations=1-6,29-76,160-278,344 -455,499-603,658-689,711-852,876-885
atggaaatggaacagaaaaagcaagagggtaagggaaaagagtgaacaacggttactgtacctaccataatatacctaataattattactatattaaatattattttcgcttaagaaattcaaaagattaaatacattaaaattaattaataatttttagttagtacagacaaaatcgaacatttgcaaaatgaacagaaaagaaatattaatgcattggaaaaggagctgaaaaagaatcagatggaaatagttagttgaattttaattttaggcacttttaaatattatatttgaaatatccaaaatttaatttagataaatatagttgaattttaatttaggcacttttaaagttccgacaaaattgttgggatgccaacaatagtcataataacatcgacataattgatgacaaatgtttggcggtcaatcataaggaaaatgaatgtaacttttataaattttaatttataaattattattttttttaattaagccgagttttgcaaaatcttcgctacccatccaattttatttgacaaggatttctccaagattttttactttgaaattgaaatcaaaaagatgcaaaagtaacagtaatataatacataataaaaatgtttatttttttcttatttttaaaattatttagttcctttgacaatttcctctccttcggattcagcaccaaacaacagaaaaacgttgacgaaataaacacttattcatattgtaatcacggcttttttatcattaacgccgaatatcattatcaagaagctcaacaagatgattccttcaaagaaaatgatgttgtcggatgtggcattaattcggccacccgacaggttttcttcaccaaaaatggacggcgtcagg

SEQ ID NO: 65269 - DNA, 549 bp, Heterodera glycines
  Genomic contig location: Contig_ID=SeqID_7571; Location=134..682; Strand=+
  SCN-specific regions: Sequence locations=1-408,431-468,491-549
atgatacgcattttgtgctctttccaacaaccactggtcggtctggacgtattaaaccccgaagaaatggtcagttttcatccctttcttttgtattattacgctgtttttctattatttcagatcactcctggccttgaccgcgaattggtgcaggacatgttccgttcattgagcatgttgcacctgcaacagcagttattggcaacgaagagcaaaagcggaggaagtaggtcagtggaacgaccgacaaaggcactgttccctccgaacgattcgatggcgcagagtgacgaactcagcgaaagagttactaatctgatggaaaccctacggccaatgctcacccaagcattggcaaattgttttttggattaatatcgttgtatcatgttcgtttgaaataacttttttgaagtttttcaaattaccgcttggaattgtcatgcaaagacaaggcttacaatgagaaaataactttaatcaaacagaggacataccgagttttttcaaaaagacaatccaagtcaaacccaatctttaagaaaa

SEQ ID NO: 65270 - DNA, 185 bp, Heterodera glycines
  Genomic contig location: Contig_ID=SeqID_7572; Location=106..290; Strand=-
  SCN-specific regions: Sequence locations=1-6,169-185
  Gene Ontology: Mol. function=structural constituent of epidermis; Cellular component=intermediate filament; Biological process =epidermal differentiation
atgaatggaggagtggcagcaggcggaggtggaggaggaggagctggaggtggcggtggtggtgggggaggagtaggaaacggaggaggagcagcaaatggtggaggagcaggaaatggaggagggaatggcggaggagcgggatcagggggaggatttggaggaggatctggaaatggacaagg

SEQ ID NO: 65271 - DNA, 310 bp, Heterodera glycines
  Genomic contig location: Contig_ID=SeqID_7572; Location=476..785; Strand=+
  SCN-specific regions: Sequence locations=1-250,273-310
tttggtaaaacttttaattaacaaaagaatggcagaaaattattttctttttttagtgcgtccataaactgtttgagcgttaagcagaacaaatatatactatttataaagattaaaaccatttcgagcaagcaattggattggcctatttatgtgtgtctcacagtgaacccaggttaagctgaccaaacaaaaagtttctttttttatcctcattcaatgatttagcaaaattttattatacccaaacaaaaaatatttttaattattttctttgacagaagatcagtcactttctttatttagtcga

SEQ ID NO: 65272 - DNA, 680 bp, Heterodera glycines
  misc_feature (23)..(23): n is a, c, g, or t
  Genomic contig location: Contig_ID=SeqID_7572; Location=773..1452; Strand=-
  SCN-specific regions: Sequence locations=1-193,219-393,422-529,571-680
atgaacggaaactgtaccgatcncagctacatgaagacgtgtcttgacccggtcagcaagcagtacactaactcattagcaatcataagtttccattacagaattacaacactctgtccatgtccaaatgctgcatcacttgcacaaaagtgcgcaccgcagtcactgccagcctcaacatttccatttcgttcagtagcagcagcagtagcagcttgcaaactcagaatggaaagtgattgccgatgagatattaaaattcgcttcctctttttatgggttgaaaaatttaaacaatttgacttttattcctatatttaatttgtttcaacagtattgatgtgtgtcattatattttttgacagaagtatgttatcttataaacgcagttcgatatatatatatatattttttataaaaacatatgtctggcatttttttgagtcaggtatcatatttagttgatttttttgaatttttcatgattaaaactccaaggaggcataattattttttattgaagaaatccattaattaatatttcttttaaaattacataataattattttcccagttaagctcataaattaataattttttacttatttgtaaaaactattcttgcttagattctatttataagaaatacttggaaacataaaactttcgactaaataaa

SEQ ID NO: 65273 - DNA, 395 bp, Heterodera glycines
  Genomic contig location: Contig_ID=SeqID_7573; Location=52..446; Strand=-
  SCN-specific regions: Sequence locations=1-7,170-184,363-395
  Gene Ontology: Mol. function=RNA helicase activity; Cellular component=cytoplasm; Biological process=post-embryonic development
aggaaacggaggaggaaaaggaaacggaggtggaaaaggaaacggaggtggagacggaggaggacgcggaaacggagggggaggaggaaacgaaggaggaggaataggaaatggaggaggaagcggaaacggagggggaggaggagaaggtggtggtgcaggaagaggaactggaagtggtgacggaggaggaggaggagacggaggaggaaacggaggaggaaaaggaaacggaggaggaataggaaacggaggaggagacggaggaggaataggaaacggaggaggaaaaggaaacggaggaggagacggaggaggaataggaaacggaggaggaagcggaaacggagggggaggaggagaaagtggtggtgcaggaaaaggaactggaagtg

SEQ ID NO: 65274 - DNA, 1036 bp, Heterodera glycines
  Genomic contig location: Contig_ID=SeqID_7574; Location=469..1504; Strand=-
  SCN-specific regions: Sequence locations=1-97,119-769,791-804,826 -846,871-877,901-926,948-1036
  Gene Ontology: Mol. function=protein phosphatase type 2A, intrinsic regulator activity; Cellular component=cytoplasm; Biological process= signal transduction
atggcgaacattttgctgtcccacactttcgagtccatgcccttcaatggggtggacgaactgctccaaatccttggcgacatcatcaacggattcaatgtgccgctgaaggaggagcatcgacagtttctgtttcgagttctgcttccattacacaaatcacccgcgctgccaatgtttttctccaagttggcatattgtgtgatgcttttcgttgaaaaggacgcctcattggctaaacccgcgataaaatcactgctacggaattggccatcaaaaagtggcatcagagaagtgggcaaaatgaaagtgacaccggcgaaaatagttacactttcagattctgttcatcaccgagttggatgaaattttgagccaagttggtgaggaccaattccgagcaattatgaagccattagttggccgattggttcgatgtacgaccagtcaaaatgcacgagtatggaaattgtcgacttggcatttaaaatggataataatgtttcagctggcagaaagagcactccttctctggaagagcccgaaaatgttgacatttctcaaggacaatcaacttgcattccctgaggccattcgggccattgacaaagcacagagacattggagcagtggggtcattgcaatggtcagtcaatttttgggcatttaagcagaatgccaatcaaacaaaaaaaacagtcggccaaaacgatggatgcgctgcgaatggcactgacagaagcgggacaaacagcaacagaggaggtagggagaagaaaaagcggaaggaatttgagggaggaacaaaaattggaagaggaagagagcgatctcatcagaaatgacaaatattaattaataattattattgacgctgctttcttttttgaaacaattttttataaagttcacgaaaaatgtgaaccaaatttttaattttgttttgcagaaaatgacaatttgtttgagtgctccttattcttcaagtcgtcaccagtttaagctaattcagcagaagttccaatctctgaaataa

SEQ ID NO: 65275 - DNA, 1357 bp, Heterodera glycines
  Genomic contig location: Contig_ID=SeqID_35805; Location=248..1604; Strand=-
  SCN-specific regions: Sequence locations=1-29,51-794,818-1192,1265 -1357
atggcaaattttggacacaaaatcaaaaagtgccaaaaatttcttcttttgtatactgcgcttggtgtgtacagaaagggaatttcaaaaaaaaaaaaaattacagtattcgggtaccgtactctatttttgcattttccgccaatttttttgtttaccgtcaatgcgatgcattcggagaatggccgcctttgcctcggccatccgtcggcattggaccaagaagcggggcgactcgctgaggaagtacagaattggcacgcatggggtggcaaaagcggcggaaacgcgttgcaatgtgcgccagtcgtgcgcaaagtaagccatgatggcgaacagcacaaaattgggtgacctgtgtgcaaatttgatgaattcatcaattggttttgcccatttgtctgtattggatggacacggacaattgatcaaattgacatttgccatgggtaccaaccaaccaggcacgtaacaaatttttaagaaaaactgggcaaatttttttttaaaattgtaagcatttttcataaaaagtgcgttaaaatttccaataaaagattttcctggcggcaacaaacggcaccgacccaattttaccatatttttgatcataaaaaattttttcggactatcgcggcctgacgggtacccaattgctcacattactggactaattgatcagttaacactttgttgtgttgaatgttgaattatagaaattagtaaccataaccatagacaaatgatcaattgtctgattgaataaaatggacaatccatccagagacattttgtcataaaatttcttaaaaaatttctcctaccaagtgatcaagttggccaagcagaagcgatgcttttttgggtaatgttccgatgtaaaaacgaccaaggtgaccttgaaaaatgggaaatttgcatgatttctccagaaaaaattctttttttttgggtttaccatagttccagcgttgaaaaaattgacaaaaaatcggacaatggtaaatgaaagcaaatcgaaggtgaacgaagtggcaaccatcgacaaaatgcacaaaatcagcgcaatcaacatgattttgcgacgtccgtatgagtctgacaaatagccgaacagcatggagccgaaaatgacgccaatcatcgaaaataataaaaaaaaatttgtcaattggaaattttatagtaagacaaattattaaataaattattaaatgattttatttttacaaaaataatgatataaaaatgtaattaattatatcaggggttctatctgttcttatctgtaagaaatgctctgattttggagggtagtgacacagtttggttctgatttattgaaattactaataaa

SEQ ID NO: 65276 - DNA, 90 bp, Heterodera glycines
  Genomic contig location: Contig_ID=SeqID_35806; Location=844..933; Strand=-
  SCN-specific regions: Sequence locations=1-90
atgggagcaaaatccaccgcagaattaggtacagactatagggaagctattccggaaggattcggtctccccataaatctgggcgcatcg

SEQ ID NO: 65277 - DNA, 1005 bp, Heterodera glycines
  Genomic contig location: Contig_ID=SeqID_35807; Location=176..1180; Strand=+
  SCN-specific regions: Sequence locations=1-54,76-147,179-529,552 -556,613-726,767-771,793-1005
  Gene Ontology: Mol. function=transcription factor activity; Cellular component=nuclear heterochromatin; Biological process=chromosome organization and biogenesis (sensu Eukarya)
atggtgccaaaaccgccggagggagtggcggaaaaagagcgaattggcacgaacgaagagaggggggaaacggaatcaacggacaatggaaataacggacaaatgcatctgaatgcatttaaagggcagagaaaagtgatcggagaaggggcgggtggaagtgatcagctggacattccgacattgagcgaaagaacggacgaattgagagaagagaagcagacggaagcggagagtcagacgacagaagagagacagacgcgtgcagagaaacatacaaaagtgccatttgaggaagagggaaagacacaaccgaaaacagcggaagaagcaaagtcgagaactgatcaaagagacacgggagtccaattagtcgacgaaggggcgagaagcagagatttggaaaagcctaaagaaacggcatcgaaagtgtcatccccaatgaaaagaatggccgtgcaagaaaatagttgggaattccataaaaagtttgcggaaagacttgtgaataaaacggcaaaagatgaggaggaaatgggcacagatgaaaagagaaaggaggaggaggaagaagagaaaagaagtgagagggaggaggaaaaggaggaagagagtgtaacaacggaagagagccaacagagagagaggagggagagacaatcgaatttaaacacaacgccagcatttggggaagtgtttaaggggagaaacgatcaacaacaattggaagaggaagaagagaaagagggagaggaggaagaaggagtatgggaagacaaacagaaagagaaatgggtgggacggagagacgaggagtcagagccgaaatgcgaggaaaggccaaaagagggacacatggcacaaatgccggcggagattgaagtggaggaggagaaccccgccgaaatgttcgattctccaccgctcgacgaaatgacaacggacgaatcgagcagttcggcgggcgaagaaacgccgattgtggtgagacgagaacggatatga

SEQ ID NO: 65278 - DNA, 745 bp, Heterodera glycines
  misc_feature (719)..(719): n is a, c, g, or t
  misc_feature (728)..(728): n is a, c, g, or t
  Genomic contig location: Contig_ID=SeqID_35809; Location=157..901; Strand=-
  SCN-specific regions: Sequence locations=1-432,454-585,612-692,714-745
taaagtatcagcctaaatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggtactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaagaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaacccttctgaaaaaatatttaagaattaattttgncaaaaatanataattaatgaaaaagt

SEQ ID NO: 65279 - DNA, 1039 bp, Heterodera glycines
  Genomic contig location: Contig_ID=SeqID_35810; Location=418..1456; Strand=+
  SCN-specific regions: Sequence locations=1-434,456-461,483-485,507 -749,780-946,971-1039
atgtcacgatgctcttcagttcagtcaagcgggcccgagttcagctcgaatgtgtccgttgaatcagcgatttttgacgacaatgagaagatggagcaggatcagaacgagggaaaagcatcggatgacaaagacagaacgatggttgcaaacggcgaagggatggacacggcaatagtcaaggaggagggggcgacgacgagcaatgggtgagtgggacgggagacaaccaaaccggcggaataagtgcgtttaatttcagcttcaaattggagttgagacaacaacggcagaacgctcacagccaacagcagctgaacgtgccgctccacctgaattccagcgacccctctctcagtgacatggccaagccattggcaaatttgcagcatcagtccgcttttcagacgagccccgccttcccatttccgttcggccagaactcttttattcagccgcccttcaatcgcttcttttgaaggacgaaaatgagcctttttggaatactcacttctatcaattgactaaacgacacccaatttgcttttgcctatttattattctccatttcactttctttgtcaaaatattgcgggcctttcttttgagtctctttttaatttatatttccatttatcaaaagcctcagacactcacgggaacccatttctctttgtaccttctttctccatttgacctcccatttttgccagcaggtcttttcgttgttcagcttttactcatataatcaaatttgtttttatttatttattttctctatttcacttcataggcattccaaaatcttacctttaaggttgctcataacggttttttcacccgtattttttcaaaattagacgaagaacgaacataactgaatataaaactaaaaaacacaatatctttggaattcttaatccagtatgaatccaattttgggaccataatcaaattttgtacttcagttaattataaaattctcataaaatcccaccactctgctcgaaatatgcgtttgcgcttccctcaaatctaa

SEQ ID NO: 65280 - DNA, 1072 bp, Heterodera glycines
  Genomic contig location: Contig_ID=SeqID_7575; Location=2054..3125; Strand=+
  SCN-specific regions: Sequence locations=1-170,193-196,220-1072
atggccgaggccattgagaagctccgcctcagtgtcgtacagctgaaaaacaacggcacacagaagcgacaggagtgtgccaaactgtcccaggccatcgcgtcggtcggcggagagggaactgcgaacgctgggacaaaccacgcaaatgtggggggtgggggttacggaaaaaataaaggttttttggaattggattttttgggctgtccctcccccgttttctgtcccattctatcggcctaatttagcattgacaagctgactgcggatattgtgaagtgtgagtcgcagttgaagcagctcagcgacttctctctgtaggacgacgtgtggaaaatgctgcagggcattcatgtaattaattgaccaacgacaattgattacaggaaaccccagttttactgactctgcctaactctgattacctttttcaagacggacctgaacacattgcgcatggacatggtggagttggccagcagtgccggggacgagggcaccgtcggcaaagccaacgcactgttggaacgtgcgggcgacaaattggacctgtccatggagcacattggaacattaaagcgtcgggtacagctcagcaaccaggtggaaaatggcattactgactgacattaaattggctttttggcactttcagttggccgagttcaaagactgtcgggcgaacgccagcgaaaaagtaattcaaatggagacaattcgggagagcatcggtgacaaggcggagcaggtcaaacagttggagcagctgatcgccgccaccggtcgcgaattgcctgagacggaacgccaattgcgcgccatggaacgctcgaagaaggcaaaatgcgaaagtgctaaagcaatttggccgtttcttttcaaggagttggaaatgacggtgcagcaaaacttacgcaaaatgacgctcgacgtggacagcatcaacgcgacgctagacaaaatcaccgagatgggcgagtccaacgagcgcgaccgtttgagcatgttcgccacaccgacggactttcgtgaaatggtcacacacccttttggggataaaattaattaa

SEQ ID NO: 65281 - DNA, 679 bp, Heterodera glycines
  Genomic contig location: Contig_ID=SeqID_7576; Location=40..718; Strand=+
  SCN-specific regions: Sequence locations=1-679
atgaacccacaacaaatttggacgaggataaggtgggtaggcgcaatgggcactgattgggagagggaatcactttcattcattcataggcactttttgattttggtccaaaaatttcccatttttatggtttctcccctttttcggctaatctgtcctctgttctgtcgcgtttgtcaaacacattccgtttcatatggaaaacattggcgaaacgtggaaaagttgggtccaaatttgaaaaccgacgccgtcggcgggcggcggagcaatcggagcacaacgcatttactaggcggacgacttggactttgaggaggacgaaaatgcgaatgtaaaaagacgagaatttgcggcttttaaatggaacattttgtttgacagcaaaatgattgagggggaacagaacaatcgccgctccggcaacagagaagaggacgaaatggagctgaaccgctcgctgcaactgattgtcatcacttacgtccgtcggctcgtcgagcatttgcacttggcatgccgtcccgagtacatctacagcatggccaaggacgagaacggcgtgtcgcacatcaaagcgcaccgacaaatttcggccgccggcgacggggacgacgaattggaaatgtgtctacttgagccaaaaaattttgaaaaacactcaatctcatcacattga

SEQ ID NO: 65282 - DNA, 816 bp, Heterodera glycines
  Genomic contig location: Contig_ID=SeqID_35812; Location=91..906; Strand=+
  SCN-specific regions: Sequence locations=1-183,205-256,278-347,369-816
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgatttttt

SEQ ID NO: 65283 - DNA, 658 bp, Heterodera glycines
  Genomic contig location: Contig_ID=SeqID_35814; Location=1..658; Strand=+
  SCN-specific regions: Sequence locations=1-180,202-435,459-658
tgatgaaacggaaggacgggaaatgcgaatgaaagacaaatggaatttgtcagaatgccaaaaaaagttgggagagacttcggcagcgaattgttcggtttgccacaaccttcgaacggcggacaaagcccaatggaaatgtttttcaatttgtttggacgaaaaaaaagggaaacggtgcaggaaggaagaaagaaacggagcatcgaaaatttagccaatttggggaagccgggctcagagtttgtgacaaaaatggccgaacaagcaaaaaacgatgacaaacaggacgagaaggcggagatcaagcagtacctggagaagggagtggccactgcggaaggaaacaaaaaggcggagaaattggcctatgtttggtactcggaactgctgtattggacaaacaaatggatcgaggtggacactcccgccgaaccccaaaaatttagcacctttttaaggcattagaaaatcgggtgatgggagtcaaacccgaactggcacaacagttcgtattctcaaaaacgggaatggccgcttacagggagctgaaggaagaggtggacaaatgcgaggcgaagttggccaaactgaaggaatggatcggcgactatttcaagtgaaaatggagatgaccaaccatcccatccacacagcc

SEQ ID NO: 65284 - DNA, 96 bp, Heterodera glycines
  Genomic contig location: Contig_ID=SeqID_35817; Location=202..297; Strand=-
  SCN-specific regions: Sequence locations=1-96
atggtatttatttccactgcaaaatcactgcccctggtcacttacaatttcaatcagccaatccaactgcttcgacttctcaaaatgaacccgagg

SEQ ID NO: 65285 - DNA, 388 bp, Heterodera glycines; identical to SEQ ID NO: 51536
  Genomic contig location: Contig_ID=SeqID_35819; Location=380..767; Strand=-
  SCN-specific regions: Sequence locations=1-20,42-275,297-388

SEQ ID NO: 65286 - DNA, 641 bp, Heterodera glycines
  Genomic contig location: Contig_ID=SeqID_93; Location=4714..5354; Strand=+
  SCN-specific regions: Sequence locations=1-6,64-505,527-641
atgttgctcctgctcctcctcctcctcgacatgttgctgctgctgctcctcctcctcctcctcgtcagagttcccctcgatgcgcactaccacctcctcaatgggcaatggaacccgggggaaaacctggtcctaaatcaaaaatttggctgttgccatgtcatgactcatcattaccaagggtaccctttctgcattgcgtagcccgaacacctcaaagttctcagggtgggcaccaccgacccgtgctatttcgctaaattcctgatgtttatttgctgattttcgccccaatttcctcacatttggcgtgctctcgttatgttgatggcaccggcaacagctgcatgggtatacacagcttccatcagacgagcgagggtatacccaatctataaaatgcatttcaattcttaaatccccgttctcgctaattttacatggctgagaacttcctcatctttgaggtactggtgatcggatgattggtacctaattaggtaccaaaatcgaacaacgccacagacggtgcattgcgccttgtcgtacaagaccaaagacgtcacatcatactcagtggtgccatcgtcctcttctgctcgatcgtcagcgtcctgatccgggtgtcgatgttggcacta

SEQ ID NO: 65287 - DNA, 2195 bp, Heterodera glycines
  Genomic contig location: Contig_ID=SeqID_973; Location=1596..3790; Strand=-
  SCN-specific regions: Sequence locations=1-710,750-812,848-1168,1190 -1537,1560-2090,2112-2195
  Gene Ontology: Cellular component=membrane; Biological process=lipid metabolism
attaaatctcggtgcatatgtgtaagatttgcgatgggactggaggaaggggtgggggggggggcgcgtcagtgtccaaatgacacgcaaatcctgtgatttgttatattttcagaccgcttttttcggcgcgctttttctaaaaaacttttgagaactgatgggggcatggtggatccggcaaaatttttgaaaattagtgcaatttggtaaaagattttgtaaagaataacctattttgtgatttactagccattttttttaaagaaaattaaagttttgtcagcttcgacgtggaaaaattggaatttttgaaacgaaaaggatttgtcagctctgacggggtaaatatggaatttttaaactaattttcgagaaaaataatccaagttttcaaataattttcatttaaactttggatattcaaaaaagaaaatcgcttcaaaaaaattttctttataaaaattctgccccaaaaatgcgcggcgcgccgcgcataaaaaaatcccgcggtcacgcatcgcggattcaaattttcgcggtcgcggatcgcgcaaaaaagacgccgcgattcgcggatcgcgcaaaaaaaaacgccgcgattcgcggatcgcggtcgcgtcccagccctgataggcacagctggagaaatttttgaaaatttaatgcgatttgttaacagattttgtctaaaattgaccaattttgtaattttgagttaattttttaaaagaaaaaatagggtgaaggccatccggcggtgccgataggcgccgccgggaaaatttcacaaattttgaatgaaatttgcgataaattttaatatttaatttattcaaaaatatttggcattttgtccataaaatttttcaaaaaaatcaataaaatcccgcagaatcccgcacaaaaagtcaaatttgcggatcccgctgcgggattggaactcaaaattctttgcgggacgggatgtttatgcgagttttatgttttggtacgttcgttcattccttgcacttattctagccgaaattatttttttgtttcttacaggaataatcgaatcgttcgaagttaggctcgccttgctggtccctttccacgttttgttttttctcttcctttggacaatggttcaaacaatgatcgctcctaatgaaagacctccggacaatgtgcggcacacagtgcacattttgatcactttattgtttttcaattcaacattcccgcccaaattgatgaagaattgaagggcatcatcagaagcagagcatataacaccaaagaattctacgcaattattgaacgttatgtaatggatcagaaaattgagctcgcttgcagggcccaaaacggaggtggaactcattcattttggaattgaattggcatcattttgacacgtcgttttgttaagctattcgcttttgcatgcgatgcgcctgcattaagcccgacagatgccaccattgttccacctgtggacgttgctttctgtgagcatttaacattttctggttgttcctttcaggaagtacgaccatcattgcccatgggtgcgtttgtgatttccgtcggatacaatccattgactccttttcccttctatcagattaatgcctgcatccgtttcaacaactataaattctttgtgcagttcgttggctatgcttggcttctttccgtttttattttctccaccatttttccctttttatgttagtttcattttttccaatttttctaccagtaaaaccattttcctctaagtttagcacattttgggatgaagtttgccggattctcgtcacttttctcttcgttctgatgtttttgcttggcctttctctgactttctttttaacttgacatctttgtttgatatccaaaaatcgtacatctcttggtgaatttatgtgatcttttgatcatccctttcttctttattgaatcagaaatgatcgttggtccgccggtcttcacatatggcgaagacaagcgtgcctttgacttgggcattcgccgcaacttccacgaagtgtttggcaccgtcaaatggaaatggttttttcctctgtttagcaggtgagtttatttagataattttttatatgggtttttcgctgatgagtttgtttttcagccaaggtgatggcgtaagatttgagcgaagagaagaagttcaggcagttgct

SEQ ID NO: 65288 - DNA, 2261 bp, Heterodera glycines
  Genomic contig location: Contig_ID=SeqID_975; Location=1..2261; Strand=+
  SCN-specific regions: Sequence locations=1-3,25-96,119-513,543 -816,838-901,923-932,954-1070,1092-1477,1500-1652,1676-1762,1785 -1900,1922-2261
  Gene Ontology: Mol. function=protein serine/threonine kinase activity; Biological process=protein amino acid phosphorylation
cttatatattttaaaagccaaaaatggaattttcccaaacaactctcgaattagtatcgtttttagcacaaaaaaaattttgaaaatattttactgccctcaaaaacaccaaatttaagcatgaaatagggagtggtggcacaaattagttaatgaaggggccatttgggtacaaaagcgaacacacagaaagaaaaaaaagaaatgctagtgaagaaaacactttgttaaaaaaaacaatcattttaatggttattattaggattataaattatatgattttgcatatttttctgcaccaatttaatgcatcaataataaatgatggaagcagaatttgtaaatattaattaatgtaaaaaagaaaagaaaaatttttctaacccttgttgagcagcagtttttttggttacccgacatttgcggaccgacatttgcggatttttaaagccgacatttgcggacaaacacttttgcggatagaaacattttttttttcagttattaaacaccaaaaattaacaaaattttttatttaatttccctaatatcgattaacaaatcacgaattgtttaacaaataaacaactgtaagtatttcttttggagcgttgcgtacagcagcaaaactgacattccttcgatgtttttctttatgcgacttttgaaccattttcgccttaatcttttttatccaaccataaaggcaaatttcggttaaagatgtttttccggtaacgtcctccagataagcgaaaacagatcaggtttccgatcatttattgtgttgccccatgtgtattcaccgagttgaacggttatggggaagaatttgaaggctctacaataccgacttattaaaaaacagttttgatcgttgggatgattaaattcgaaaggaattaacattgattgagaaaatttttgttgataaaaaataatgaaaaaagctatccgcaaatgtcggtccgcaatataattcagccgaagaaaaaaaagaaattcagccatacagcggagcaaaacaaacaaaaatttcgcttcctaacctttttaaagtaaattagcgcaaaatgtccttaagtttaaaatcaaaatttgtagtgcgaacttatctttttttattttatcgatactatgacgaaaaatcaaaaaattatgggcctcaaaaaattgagatgcttccataaaattatcaaaaattttagttacctagcctaatacgaaaaaatactagaaaaattcaaaaagaaaatttcaaggaaattcaaggaaataaaatcgaccctgctctatccaatggtatataacacatatgcattttccgacttacagttcgggtggttcccttgttagattttcaaaaaagctaaaatacttttttttcttcaaattttttaattttttttgcggcgacgttatgtcccggcgacgttttgtcggcgatgttttgtcctgttccggagcccaccttaaatttttaactaaaaatatcttttttatgacttaaatttgttgaaaaacaggactgtggttacttttaaatagcttaattgaacattaaaaaagtatcacttaattttatagccgattttggcgtatccgccatcatgaagaacaacgagcgacgcgactcgttcatcggcacgccatattggatggcaccggaggtgatcatctgcgagacgttcaaggaccggccgtacgactgcagaggtcatcgtcgtctaatgtccttttttgggccactgttttccctattaaaaagggcacaaaaaactgtgcaaacactccaaattattaattaactttgtttaatagcgacagattttgcgtttgcgcaacgcgtggattgactagtcaatccgtgcacaaatctgaccaattcccacgagtcattggccttaaaccaaaaacatttcttattcttataattagttgccattaattaatgatattattatttggaccggaaacccctcactgattttgacaatatacagcactggttgaagcacacctgcttaattttaaattttttagctgacatttggtccctcggcatcacttgcattgaaatggcacagatggaacctcccaattacaatatgaatccaatgcgcgtggcgttcaaagtgcagaaatcagagcctccaaccctcgaacagccacacaaatggacgaccgaattcagcgactttctgcttaaatgtctcgtcaaaaaagtggacgaacggtggggcgcttcacaattgctaatg

SEQ ID NO: 65289 - DNA, 802 bp, Heterodera glycines
  Genomic contig location: Contig_ID=SeqID_975; Location=3268..4069; Strand=-
  SCN-specific regions: Sequence locations=1-366,388-734,761-802
atgagaaggggaagaaaatcgacccgcgcaaggacctgtgtccacgaagccactcatggatggatattatggaaaacaaaagattgtagcgacacattcgaaatggtaagaggtcggaagaaaataaacaaacggtcataaccattgttaacgaaattcttaccccaaaaaatcaggctggaattttaacgatgacatttttagtttttacacattttttggtgcgctttaaaaaaatgggacgacactaggaaaaattgtatttggcgcctataggcaccgtcggacccactcccctccccgttccttaagtttggaattaattggattcacaaaaaatgtctcaagtccacaaaaaatgacatcatttcaatttttgtttcctatttattagctcaaagttcggaagaagccgggtcggttgaacaatggatattgctcatacttcacaacaaaatggtatacccggcctgaactcaaaggcaaattacttatgacgatgggaggacgggcaacggaagaagtcttgtgggcgttcaattggacatcattcggacagagctgatgcatggatactggcagataaggttagaatttgagtcaatgatgagaatttagcttcttttttcattggatattcaaattgctttaaagacctcgtgaaaagttcccggatttttcggggtcgcttaccacgaatctgatataattttgtcccgaacccaaaatcgaaaattcttttttaaatttaatttttggtccttgaaagttaggttaagcattcggaattggctttaataaa

SEQ ID NO: 65290 - DNA, 2020 bp, Heterodera glycines
  Genomic contig location: Contig_ID=SeqID_976; Location=1..2020; Strand=-
  SCN-specific regions: Sequence locations=1-778,802-847,955-1066,1114 -1161,1183-1213,1259-1318,1340-1391,1440-1735,1761-2020
aaaaaattaattagttaaaaaaacatttgaacctcgcgaggtacgcattaagcgcaaaccaaaccgaaatgagcaaaagggaacgaccatttttggacattccaaggcgaagaatgaggcgaaagaccactgcaacaagcaaaatcgtcaaataagccgaagaatggcatttgcaaattaattaattagttccaaattaacccgaatttatggcaaaagcccccagcacatttggaagtgattgacggaacaatttcagttcaatgtccgaattgtccattcttagtgcgcgcgaatagctaaagcatgcgatggcatttctcgccaattattccccattagcaaatggcacctgctcggctccagccaatggtcgagccaatggccgacactccgcgaggcattggtcgccagcaaaaatgccaaaagcgaatgggaaagccaaacgacgaagtaaaagcacaattcgacgccaccgattggataatttccgctgattttggaccacattttagcactttttgttgtcatttccatttagccgattattttaaaggcgaaaaccatgaattaatggcattgtttctcttttttgttgtgccgaattaataaaaccatccttaatgaattaattttctaaatcaataccattccgttaacaattttaacctcgtctctgcagaaatgccgccactaattgtcaattttcacttttctccacggcatttcaaatccattggaagagagagaaattcgatgaacatttagccaaggaaagaatttatttacttttggtatttcgaagaattttaattattttctcacaaaaattttcggcaggaatgaatttatttttgtttctttcattttcattattttcttgtgtctttttaatttttatttgtaagtttattttcattctccttttcctataattttgctatttttagttttgctcaattcgcggaatttttcaatcactgaccaattaactgctaatggtggcagccgttccgtggctttaaggtgcagtttttgtaaattgaaatataaaatagataaaccgatttttaaaaataaaattaattaatattataatttaatatttattaactttttccggaacctttgcttttcagcctggtggcgggacaaaattattttgttttctttatgtttatttagagtctctttcaaatttaatcagtcaatctttaaaattaatataaaataattattcattaaatttaaaattaatggaaagaaattttttggcagtgaaatcgaaaggctaaagacagaagtgaaaggactaaaggaaaaaattgagcaaatgcaaagcattgacgccaaagtgttgcagacaaaaatgtgagttaacggaggaattgaaaataatattcaaaatttaattaaaatatattttattcattaattaaccgtgcgtaaattgtcagtaattatccgcccgtgcgacagcgaaacgaagcgcaacggaagcgcattctgatcacgggcggggcgggctttgtcggctcgcatttggtggatcggctgatgaccgacggacacgaagtgaatgggtggcacgaaatgagcagaaaagacaatctgccgagcaattagagggcaattagcagagactaattggcggtgaaaaaccaaatcaattgttactgtagttgagaattgtttgttggcatttcaacaacatccaaaacaggtgatagcgttggacaatttcttcaccggaaggaaagggaacgtggagcgatgggttggccacccgaacttcgagttggtccaccacgacatcgtcaaccctttctacagcgaaggcaccgtttgattttggcattttcctttcaatgctttgtcagttgaccaaatttaccatttggcctcgccggcgtcgcccccgcattatatgtacaaccccgtgaagacgttgaagacgaacatcgtgggcaccatcaacatgttggggttggccaggtcggcacaacaagtcccccccccc

SEQ ID NO: 65291 - DNA, 79 bp, Heterodera glycines
  Genomic contig location: Contig_ID=SeqID_976; Location=1741..1819; Strand=+
  SCN-specific regions: Sequence locations=1-79
atggacaattcggacattgaactgaaattgttccgtcaatcacttccaaatgtgctgggggcttttgccataaattcgg

SEQ ID NO: 65292 - DNA, 1392 bp, Heterodera glycines
  Genomic contig location: Contig_ID=SeqID_7577; Location=1376..2767; Strand=-
  SCN-specific regions: Sequence locations=1-636,658-751,773-938,960 -1275
atgcctgtactgcccgtgaaatttgatcagcgacttctgttcccgctgtgccgtacgtgcgctctgaaacatccgcatggagccgtcaataaagactacgagtgcacacatcgtgaagatgatgagcgggggtgggtgtccactgtgacgtcaattgaggcttcccggacgaaattggcacaaccgaggaagatcagcagcaattcgtagaggaatgtgaggaaaaattcggaatccgtattgagagggaaaagatggtgcacaacaaggccaagcggaccatcgcaaaactgtgcaacaactcactttgggggcgattctcattacgcaacgggttgtccaaaacgattgtgaccgactcgcccgcggaactgcgcgctctgcttaacaacccagcggtggaggtcagctccattgaccagctgaccgactaatgcgtattggtcacctatgcggccggaaacgaatgggtggaggaacacgagtgctcaaacattgtgctctctctttggacaacatcagtcgcgcgcctccacttgttgcggctaatgcagacggttgttcgcgcgccaaactcggtgctcatctacaccgacacggacagtgtgtgtttcgcccatcgtgaggcggacgggtgccctctggagacggggccccatctaggcgacctttcggatgaatggccggtccatgaactcgtgtaatttgtttccggtgggtgcaaacagtacgccctgcggatgcggcaccgacaaagcggggaggagaaaacggtgctaaaagtacggggcataacactgagcgtcactcgaatggttaaaaagggcgtcgcaattttaaatccgccattttcgccgcattctgcactgttgtcaacatcattttgacaaaacaaatatagcagcgaaatgcctttaaattcggttttaataaagccatatcataaattagttttttattccagagataatattaataaatgattaactaatttaattgttagctaattaatagagatatttttgaaaaaccggttacagggattaatctgtgaaaatctatttttgtccaacatcactgtgccaaaataatatagcttccacgaaatgcttgcaagtgacagtgttaaaattcctttcaaatttcagagaaaatattagagttgagcgggaccgggaattttgggcaaaaccgggaccgggacttgccgggacctgagaagccgggaccgggacaacgatttttcttcggaaccgggaaccgggaccaaccgggaaattttagaaattcaaaaaaattttaaaaaattttaaaaattaaaaaaaattcaaatttaaatttatttcaagtgaaactaatacaatattattattttgttttttatttaataaa

SEQ ID NO: 65293 - DNA, 294 bp, Heterodera glycines
  Genomic contig location: Contig_ID=SeqID_7577; Location=2859..3152; Strand=-
  SCN-specific regions: Sequence locations=1-170,192-294
atggccttcatcacatctaaggtgcaacaagtgctcgtattttgggagtgtgaaatcaacgcggagaagcgcaacaacgacgaaatgaagcgcgcctttgcacagtataaggacagtggtccaattcggttgaaggactgctaccatggaggacgtgtgggtccacaacgactgcattatgaggtgccaaaggggtggcggatgaaatattacgacgttcgttcgctctacccacacgaatgctgtgacagcatatcctgcgggccacccaacacgagtgaacatcatcggtga

SEQ ID NO: 65294 - DNA, 669 bp, Heterodera glycines
  Genomic contig location: Contig_ID=SeqID_7577; Location=3272..3940; Strand=-
  SCN-specific regions: Sequence locations=1-54,76-336,372-669
atgccggtgccgctcggcgctctgcccggggcgttcggactcaatgtgcaggataaggagttcttccctcatttggcgaatgttgaggcgagttatgggcacattctgcagtcgctaccgccaaaagctgactacttatacggcggaatgacgcccgaccgacagcgcagattcgaccagtggtacgcagaacaccaccatcagcagttcgacctatgtgaacagctcgcagcctactgcaccaacgacacgcacaactaattgaggcgttggttgcttttggcacagtttttggcgatcagagacccgttggagtggcatggatgcttggatgacgaggacgacgaagaggaggaggaggaggaagaagacaacgataatgcattcgatgtgattgtcggtggcatcgacataacctgggagccgatgaacatcgccagtgcctcgatgagacactttcgcctcaatcatctgaagcgagatcagctcgcgatcgtgcccgagtacggctactacacgacaaacacccagagccttatagcgctcaaattcattgactggtacgccaaaaagaacggggtgagcattcagacggcacactcgcccgacggagagaaaaaattggccaatacactgtggacggatacatcgcggcgaccgacaccgtga

SEQ ID NO: 65295 - DNA, 1419 bp, Heterodera glycines
  Genomic contig location: Contig_ID=SeqID_7578; Location=289..1707; Strand=+
  SCN-specific regions: Sequence locations=1-51,73-159,182-995,1017-1419
atgggcgaagaacgaattgtggcaagtattagcactgattctggaagtgccgtgcataatgcaattgaaaaaggacttccgattgtcaatgacgatctgatcagagccgctgaacaggatcagacaatcctgaaggtcaaaaagttcgtcaaaactcaatggccaaacaaaaaggcaatttcggacgaacttatgcaattccaccgcaggcgagaggcattgacaatcgaaaataattgtttgttatattccgaacgagtcgtggtccctgcctctctacaaaatgaggtactgcaacttttgcacaaagggcaccccggaattaaacggattaaaagcctcgcgcgccaatacgtttattggcctggaatggacgagcacatcgaaaacatgataaaatcttgccaaccgtgtgctgcagaagcaaaagcaccagtgaagactgaacttcactcttggccgaaaacggatggtccatggaaacgaatccatatggactacgctggaccgttcttcggaaagatgtttctcatcatcgtggactctttttcgaagtggcacgaagttttcgagatgcgttcatccggaacaaccgcaacaattgaaaaattgcgcggcatttactcgacttttggcttgccggagactttcgtcaccgacaacggcatccaatttacgtccaacgaattcaagcagttcgtcactcgaaacggcattacccacctattttcggcgccttataaccttatgtcgaatgggcaggctgaacgctttgtcgacacgttcaaacgaacgtccagaaaattaaaaggggagggaattgccaacgcattggagacgtttttggtcacgtataggacgacgccaagcgagtcgctgaatggcaaaagtccggccgaaatgttccttcagcgcaaagttcggacaacattggacctgctgatgccaaaacaaagacagccgatcatccgtgacgaagcaatggaaaagaacttcaaccgacgcttcggagcaactccgagattttttttagttggagataaggtttatgctcgtcaccggctgtcgcaacaatggaatgctggacacgtcacgtcttgcaaaggagtgatgtacgacgtggagttcgtgctcggatcaacatcacgttttcacgcgaaccagctgatcaagagtgacaccgatcaattggacgtggacccactgaacgtgtttaatgaagattttggtttgccaaaaatggcacatcaaccaaatcagcgcccaaatgaggccgtggttgaaccaaatattgtggacaatgctgagccagcaaatgatccaccacctgtcgaacaacagccaatttcaccgattcgtcctcgacgacagtacccgaaacggaaccgtcgtccgcccgatcgctactcgccgaagtga

SEQ ID NO: 65296 - DNA, 304 bp, Heterodera glycines
  Genomic contig location: Contig_ID=SeqID_35829; Location=551..854; Strand=-
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatactctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 65297 - DNA, 122 bp, Heterodera glycines
  Genomic contig location: Contig_ID=SeqID_35829; Location=1057..1178; Strand=-
  SCN-specific regions: Sequence locations=1-122
gcgcttttgtgaggtataaatttctcaaaaaaagagatagccatttttctgggatagagtataaatttaaaaaacccctcaaagataaaaggtctattgcgcaccgcccctcccctatcatg

SEQ ID NO: 65298 - DNA, 630 bp, Heterodera glycines
  Genomic contig location: Contig_ID=SeqID_35831; Location=399..1028; Strand=-
  SCN-specific regions: Sequence locations=1-630
atgccagtcatcaccgtcgagcgtcaatggtgcgtctgtcccgttgtcatcagaagcagaaacggcattggccatggcaccgacagctacggcagcggctgtgacaccgtcaataacggcgccggtggtgaacaatcaacacaaacaaattataacggaacagccggcggcactgaaccaacatcatcacccaaactggcacgtaaagcgggcttttttcgtttcagaattcgaattatacagagggtcgcttgtccaaaaaacccttttaaaagttgaaacttttttggtcgcttgtccaaaacccttttaaaagttgaagtatgtttttaattattcaggtattttgtggcattagaacgagacgccaacaacacaagaggcaacagcagtaacaatgactccgccgaactgctccgtgacgagcgagtgtggcgaatgtttgctcgcagccaacaacggtgtgcagcgattcgcgacgcgtcacgcgcacgtgcccaaattgccgccgggcgacgcgctgttgtagccgatttgttgaccggtgggtcgtcggaatcgatgtactcccaaacatcaccgcccaaatcgcctggacctggacaaaatgtcgccgcaaaaaaaaaataa

SEQ ID NO: 65299 - DNA, 1456 bp, Heterodera glycines
  Genomic contig location: Contig_ID=SeqID_7579; Location=1..1456; Strand=-
  SCN-specific regions: Sequence locations=1-320,343-479,501-563,601 -1086,1108-1189,1211-1260,1283-1342,1364-1456
  Gene Ontology: Mol. function=non-chaperonin molecular chaperone ATPase activity; Cellular component=intracellular; Biological process=response to stress
gtggaaacgctcggcgtcggctacaaccgcacattgggcggtcgtcagttgacacttcgactccgcgaccaccttgtccgcgcgttcaagcaacagcacccgtccacgagcaataccgttgaacagaatttgagggcaatggccaaactgatgaaggaggccgaacgcgtcaaacaggttgaattttcagaaaaaaatattagaaaatttgacgaaaagaaaaaaaaattttttttttgtcttttagcgatttttttttttttttgggaaacatagccagtgggaatgccttctcggtggcgcctatcggcaccgccggtcagaaaatttgaattttaacgacaaaatgcaaaaatgagtacttttttttttggcggaaaacagctacaaaatttctgtttttttctctcggttgctcacattaaagaaaagcttttttggcccgaatttcaaaaaaaaaaaatcttcgggttccccctccgaatttttggtttttggttacgacttgaacatggcatcttacaataggagtaagtatcgcaattcctggtaattattcttatgatatttttggtgatttcataaatacgctcttttaaaacccatagattttgtcggcaaacacggaccattacgcccatgtggagagtgtgtttgaggaccgcgacttccgcgtcaaagtcacccgggacgagttggaggcgatgttccaagactttgagcaattccacatggagcccatcaccgacgcgttgcggatggcccaacttacgctggacaaattggaccgtgttgtgttgatgggtgccggcacacggatgccacgcctacagaccgtcctcggcacatttctccaggggttggttggcactatttaacgattgcaagagtttggcgacatcggcagcttttttgggcccattgacccattcattttgacccaaaattcaaagcctgtcgaaaatgggaccggattaaaaaaaagcgaaacagtttttggtcagaaatgaacaaaaagtttacaaacaataggaaaaaaatttgggagagcgaaataaaacaatttttttttattcttttcgggccaaaaattttaaaaaaaattttctcctgtgtcatttaaaattatcagcgccgggaggaaaaagcaggaatttgtagccgtttttcgccaaaacatgccaatttttgccattttgggtcaaatcttcacaaatatggtaaaatgggggtttcgcggtgtcgtcaagtgcacccatgaaaaataaaattttttttttttggaagtttgaagttgaattattaaaatttgcttaaatttcctaaatccgatatttaatttaaaaaatatcaaatttggagaattgcaaaatgatgatgacggtaattctgttttttgtttcaagcaaagagataagcagacagttgaacaccgacgaggccattgtgtgggcgc

SEQ ID NO: 65300 - DNA, 1052 bp, Heterodera glycines
  Genomic contig location: Contig_ID=SeqID_7580; Location=1795..2846; Strand=+
  SCN-specific regions: Sequence locations=1-566,588-1052
  Gene Ontology: Mol. function=cleavage/polyadenylation specificity factor activity; Cellular component=nucleoplasm; Biological process =mRNA polyadenylation
ggaccgggcagaaggcttcgcaaaatgtggccaatgttcggaaacacatagactacatcgcaaacgcactcaatcacatggaggtaagcaaattcatcagtaaaatgtgctttttattaaattcccgcggttagattatgtgaaagttcataaaaaaaaaagatggaattccacctctcaaagagaaaaatcttattttataagtcatttgggaaaattgttgtctcctgtctctcccaattcattttctatcatttgatttgggtaggggatggttcgactttcccccgattcgttcgtatggacgagagtcgccggagtccaacacgttcattcgcttttgcctttctttttgccttcttcaataggcacgcctttggcagtctccgcaccgtcgccaattgcggtgggaacgtccggtcattcagccggacattctctaccagtcgtatgtgttaatgccgaaacttacgccagaagtgccggtggattgcgttttgagtaaatttgtgcgtgccgcgatgaacaaagtgaagtgtccgatttactcactttgcgttcgtttgttttcttccgcttttttccttccaaaaagtgttttcagtggaccccggagggcaaacgactgattaccggcgcatcatccggtgaatttacgctttggaacggaaccgcgtttaatttcgaaacgattctacaggtaattgggttctaattggattggcactttctgtctgaaatggggaggggtggtttggagtttttgtgaatgaggtcagacagtgcatttaatttaacgattttttttttttgttcttttgtgatacgcataaaaaaactcaattcatattttaggaaatttttaggtctcccattttggggtctgcctccgttagcatgtttattttttttgttttacgtgagccgctctttgcatttgcaggcgcacgacgtggccattcgggcgatgaaatggtcccacaatgaccaatggttggcgtcggctgaccaaggcggctttgtgaagtattggcagccgaacttcaacaatg

SEQ ID NO: 65301 - DNA, 2390 bp, Heterodera glycines; identical to SEQ ID NO: 7581
  misc_feature (138)..(138): n is a, c, g, or t
  misc_feature (291)..(292): n is a, c, g, or t
  Genomic contig location: Contig_ID=SeqID_7581; Location=1..2390; Strand=+
  SCN-specific regions: Sequence locations=1-12,34-59,82-103,125 -299,321-484,506-608,630-1046,1068-1625,1649-1697,1719-1850,1872 -1890,1912-2274,2297-2390
  Gene Ontology: Mol. function=cleavage/polyadenylation specificity factor activity; Cellular component=mRNA cleavage and polyadenylation specificity factor complex; Biological process=mRNA polyadenylation

SEQ ID NO: 65302 - DNA, 398 bp, Heterodera glycines
  Genomic contig location: Contig_ID=SeqID_35834; Location=293..690; Strand=-
  SCN-specific regions: Sequence locations=1-225,248-366
gaaatggtaaagacattttccgcgttaatggatgcgcacgagataatgagaaaaagtgcccgacagtgttctacacattctgccgggaatcgggtgggaatttgtttaactgtcgccattgtgacgagttggtcgacggcaaagtgtgcaacagctttgatcagttgatcaaccttgatcagtctgaggagcagatgaacagcatttacaagtcgcacagtcatcacagtaacagcagcagcagcaaagccgagaagcttggccctgtttccgccttcacctggatcagcagcaatttgttgctgctttttggtaatggggaaaaaaactaaaaaatatttcggcaaaaaaggatagaatttgaagaattaaatgaaaaaaaattataaaaaaataaa

SEQ ID NO: 65303 - DNA, 1099 bp, Heterodera glycines
  Genomic contig location: Contig_ID=SeqID_35835; Location=19..1117; Strand=-
  SCN-specific regions: Sequence locations=1-738,760-1099
atgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcg

SEQ ID NO: 65304 - DNA, 395 bp, Heterodera glycines
  Genomic contig location: Contig_ID=SeqID_35839; Location=518..912; Strand=+
  SCN-specific regions: Sequence locations=1-395
atgttctccgtccgcttcttcgctttccttctgctgctggccgtcctttgtttttccctcgtcgagtgcggtctcatcggtatttcgactgtttttgcggattaataatatccaaaattcgtccaaatccgtttaggcattggtgccactcccattgaagccgcttggtgcggcgtcgtcggccaagagtccacccattgcccgggaggtgcccttcacggcggatttcccgccgtcggcggaacatacggatttggccgatagaaagcggcgcatttggatacggtaaatcatttagtaaatcgtttaaatgtattgaaatataaatttaaggattcttttggactactgacaaatcgctgatgagagtgaaataaataagttgaaataattga

SEQ ID NO: 65305 - DNA, 409 bp, Heterodera glycines
  Genomic contig location: Contig_ID=SeqID_35840; Location=288..696; Strand=-
  SCN-specific regions: Sequence locations=1-233,256-287,309-322,344-409
atgccattggcaaacttggccaagcgacggtcatcaatgaggacgaactcaacgctatgcttaaggttggatggactggccaaagtttaagagacctgcacattccaggccttgggcttgctaaccgctggaaatcaaaattaatttcatccaattttggtggattttttgaaaatttacccctttggggttagccgagtcaaaaaatttctcttttaatcgcttcattctcctgttttttctttcaaatcaacaaaatttgtataaatttagcgtaaattctttagtttttcataaaaaacactccgttccatggacagggagacaatataaaaaatttaaacgtttttttttgttgaaactgaaagtatattacctccattttttcaggaagtctgttccgcgctaa

SEQ ID NO: 65306 - DNA, 567 bp, Heterodera glycines
  Genomic contig location: Contig_ID=SeqID_7582; Location=689..1255; Strand=-
  SCN-specific regions: Sequence locations=1-71,93-205,236-378,408 -529,551-567
atggcattggcaaaacttaaaacatcagtttttgccatttctgttgtgctttttgtttcaattgacaagtgccgatgtacaaacattctgttcacctttttccatgacacgggaagccatttccaatcggtgtttccattgatgcaaaagtacaaatattttacaaaattggaggggatttataagatagaatcaattaactagctaattaattaatattaattgaatttaaattggatgtgtgttttgtttaggctggcgagtcggggcaataatgtgtccgttttggacacagtttatgagcaggaccatagccttgaaatccatcactttcgggcgcttttgcccaaacaccataacgatgaaacagttaatggcaattaaaaattgaaaataataataaaaatgttttttgttcagtctaaacgtcactttgccaatgacatttggtcacgccgtctttccgccactgatttgggcctttattttgggacatgtgacaaggaactcggaattttgatgcaaaatcacagccaaaaagcaagcactaaagcattaattaataaa

SEQ ID NO: 65307 - DNA, 236 bp, Heterodera glycines
  Genomic contig location: Contig_ID=SeqID_7582; Location=1326..1561; Strand=+
  SCN-specific regions: Sequence locations=1-17,39-74,100-116,139-236
atgcgaatgaatgaaagtgagtaacaaacaaaataaagcggcaaatcagcgacagcttatcggaaataattgggaagaaaaagataaaacaaatgaatgaattggtcattgtgaacaaataaaattaataataattatcattttagagaaaaaaagcaattattttgtcaaaaaggaaaatgaatgagcaaattttgtcgcgttatcgtacaataattcgtttaccgtatatttaa

SEQ ID NO: 65308 - DNA, 224 bp, Heterodera glycines
  Genomic contig location: Contig_ID=SeqID_7583; Location=80..303; Strand=-
  SCN-specific regions: Sequence locations=1-224
atggcattaacagaaaagggcatgtgcttatttccaacacagaaaatatacaaatgtgcagaaaaacgaatcgaggggagaatgatttattggacagttggcaaatgatggcaaaatttgctttcaattttttgccaatgttaatgacttcatccattcatctgtttttaatccatttcactgctccatcgcttggaatattttcgttctactgtcaatcgtaa

SEQ ID NO: 65309 - DNA, 387 bp, Heterodera glycines
  Genomic contig location: Contig_ID=SeqID_7584; Location=1057..1443; Strand=+
  SCN-specific regions: Sequence locations=1-387
atggtgagaaatgtgtacaattggggcgaagcaaaggcagtaggagagagagagcagcaaatagccgacacaccaccagaagacggagctgagcatcgtccgcaaatccatggccaacgaatgggcgcagtacacccaaccgacggcgaacagttcaaatgccaaaatggccaacacagtgacgtaattgaggaagccgctggccaattcgtagccgaaggcaccggcctaaaaaacacttaaaaaatcaaaattaaaaactggggaaaaaggacctgagtagcgaaaaagagggaggaagaagcgcagaaaaggcacacgaaaagtgcgagggaaaagcgaggacaacactaattggggacagcaacaaatgagaggcatttggga

SEQ ID NO: 65310 - DNA, 2958 bp, Heterodera glycines
  Genomic contig location: Contig_ID=SeqID_7584; Location=600..3557; Strand=-
  SCN-specific regions: Sequence locations=1-333,355-448,470-559,596 -608,630-646,668-905,927-1152,1174-1917,1939-2499,2531-2683,2706 -2725,2747-2958
  Gene Ontology: Mol. function=betaine/GABA:sodium symporter activity; Cellular component=integral to membrane; Biological process=transport
atgtggtttgaggacagaagtttgtccaacatgaaggtgatttaattggacgaattcgtaaaattaatgcaataattaattagcaaagggtcaattaaatgattaattaattcgatggcactttctgtttgttttggcattctctccattcactttggcattgtttgatcagtttttcctttgttttttgttttgtccatttcttccgatcaattcctcctcttatttttcataggtttcttctctgatcgtcgaggaatggcgggacatttggtccgccaaatccgagtttatgtttgccgcttttgcctatctcttcgccaccaccaattttctgaaccttcccaggcttatcctcgacaacggcggacgtaaaaaaagaaaaattacaaaaaaatgaaattcgtttttaatttagccgcctttttggtcgcttatggcgccgcactcgttttggtcgttttgccaattgttgcactcgaaatttgccttggtcaactgaccgggcgggggcctgtccaggcattttacaacatttgccccgtcttcaaaggcattcatttaaaatatttttaaatttattttatttaatttaggtgtcggaatctcccaaattttgttttcccttttcgttttggtcagtgcccatttttcacatttttcatcaatttggactgtctaaggcgacgatgactcactttttggcccgacttatcattttcatttatgctctcttttggacattaaccgacgacagacccggtaaagtgtggccggactgattcagtcccaccgttttaatcattccagtcccggccttactaaaattttaggcctgccttggctccattgcaaaaactttcccgagattcaatttgggccctgcagagaatcgatgtcggtgatcagtcagaacggcacctcggccatcgttggcactgtccaaagattggccacctttcacgaggagtcggcgatgagcaaatttcaaaagtaaagggaaatcggacaaattcgaattattttttgtgaacatacaaaaatactgaagaaaatttttttacattcattttagccttttggatcacaaaagtgacagtgtcgtcgacgttggcaattttaattggcattttctcgtcgcccaatgccttatttggattttggttttttgtgccatttgtttcggcgtccgttggcttggcaaagtgattgtggtccgtcctttctctcttttcgcttcttttcgctttaatttattggccaatttggcagttctctttcatggttccgctcgctttgcttttggccctttgcggtcgcgcgatgttcgcctcgggcgccgttgaaatgttccaagaattttttgtggattcgttggattggcacaaattgaaggattatttggtgggagggcaaagggcgaaataagcaataattgtcgaggcaaatgcattactttcgctgtgctaaggtttggaaaacggccgttgagcaggccattttggccagtggtgtcggcttcggcgctttgatcaccgtcggatcgtacaacaaacggtccaacaatttggtgaagtgagtgccctcacttaaaaatgcatctaaatctcgagaataacccttaaaatgtgcagagactcattcattttggtgtttacccacgcgctgatcagtgtcctccaagtggccactgttgttgcgctcgtcggccatgtcagtgccaaaagcggactcagtcccgaccaactgattgaccagggtctgtgattttttctgttacagtaccccttttcctctctttcggttacggtgtttggcattttaaaattggcaattatttttcgttcaggtgagaatcagttttaccagttgctcgtcttccttggctttctgcctcatgccaagattctctccggcctctttttgtttctctgcgccttcgttcttctcaatgtttttgttcgtctttttatctttttcccgcttttgtcttacagtattaccgtttcaccccccccccccccttacagtatcttctcgcactttccattctcgccactttggaagatgcgttcggcgagaaatggtctcgggttggttttaaatggatttattcccaaatgcctctcatttgttgctgtccccaattagtgttgtcctcgcttttccctcgcacttttcgtgtgccttttctgcgcttcttcctccctctttttcgctactcaggtcctttttccccagtttttaattttgattttttaagtgttttttaggccggtgccttcggctacgaattggccagcggcttcctcaattacgtcactgtgttggccattttggcatttgaactgttcgccgtcggttgggtgtactgcgcccattcgttggccatggatttgcggacgatgctcagctccgtcttctggtggtgtgtcggctatttgctgctctctctctcctactgcctttgcttcgccccaattgtacacatttctcaccatttttcccaattttaaattttcccccaaggcaatttccgtcctcaacgttctcggctattccttcgccaaatattcgccccaattgcgctcttgggaatggtccgaatggtgcggcgtcgccgttgcactttttccgcttcttcccattcccttctgcgcccttttggccattttccgcgcctgcgcccgcggcggtccgcgttcgctttgccgggtgtttcccattttcaattattattttttgaatttcgtttttcagcgcttctgtttggctttccgttctccgatgcgctacgaactgatgaagggctcagtgagcagtggcggggtgcaccaccgcgtcacctctcaccacggcctcccccgttcgtcccgcttttccgccgcttcttcggcgcccaccggcggttacgttctgttgccgcaggcgcccctcgtcagtcagaattatttacaa

SEQ ID NO: 65311 - DNA, 204 bp, Heterodera glycines
  Genomic contig location: Contig_ID=SeqID_35842; Location=846..1049; Strand=+
  SCN-specific regions: Sequence locations=1-2,26-100,199-204
atgggatggaaaaaggaggaagatgaacgaactgatggatggaagagagggagggaatcagaagaaaaacacggactaatggggagaagagaaagcaccaagaagagggaggaaaagggaaaaggagaaaaggaagagggaggaaaagaaaagagggaagaaggaaaggaaagggaggaaggagaggaggaggagaagcactga

SEQ ID NO: 65312 - DNA, 527 bp, Heterodera glycines
  Genomic contig location: Contig_ID=SeqID_35847; Location=272..798; Strand=+
  SCN-specific regions: Sequence locations=1-71,125-204,282-467,489-527
atgttcgaaattatcttgtctctttttatttattggtctctactttttttccaacaaatcccggatgaaagtaattaatttaaaattattataaaataatttaataatattttaacattattaagacattgattaccctgatcagttggaccttcgtttcacaaaaacgggacagctccgaataccaactaccaaagaccaaggtaaataataaaattatgtaataaataaagagaaatattcactttaagattaattttaaaaaacaattaatataaattggcaaattttctttgcttttccgaataaaaaattaaattatagacaattgcgggtgctgctgggccatctcgtcgactacagttttttcgacggcggtattcgatgcacggattgggcaaaaagatcgattgttgaatttctccgagcaatacttggtcgattgtataagtgagaaaaaaaagcatttgagtggttgccaaggagtgcccattgccgactcttttgagtaaatctttgttttttta

SEQ ID NO: 65313 - DNA, 644 bp, Heterodera glycines
  Genomic contig location: Contig_ID=SeqID_35848; Location=288..931; Strand=-
  SCN-specific regions: Sequence locations=1-330,366-644
aaccaaaaaatcgatttttcaagtgtccgttggggtactcaaacaattatggggagcaaaaatccaacgcagaattaaagtacaggctatagggaagctattcccgaaggattcggtctccccataaatctgggcgcatcggttcggggggacgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagt

SEQ ID NO: 65314 - DNA, 215 bp, Heterodera glycines
  misc_feature (144)..(144): n is a, c, g, or t
  misc_feature (174)..(174): n is a, c, g, or t
  Genomic contig location: Contig_ID=SeqID_35850; Location=1..215; Strand=-
  SCN-specific regions: Sequence locations=1-215
ccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaattcgttanaaattcctaaattcaaaaacccgaaaacgntttttaggcctagctcgaaaaattttgaaaattttcgaaat

SEQ ID NO: 65315 - DNA, 135 bp, Heterodera glycines
  Genomic contig location: Contig_ID=SeqID_7586; Location=1453..1587; Strand=+
  SCN-specific regions: Sequence locations=1-135
tcaacatcgaggctcaagacgggcgcttcgcgcccgtttttaaatttgttggccttggacgggcgcttcgcgcccgttattcaaattttgttggccttacagagattagaagagatacaacagtgattaaaagag

SEQ ID NO: 65316 - DNA, 228 bp, Heterodera glycines
  Genomic contig location: Contig_ID=SeqID_35852; Location=98..325; Strand=-
  SCN-specific regions: Sequence locations=1-228
aatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 65317 - DNA, 107 bp, Heterodera glycines
  Genomic contig location: Contig_ID=SeqID_35852; Location=731..837; Strand=-
  SCN-specific regions: Sequence locations=1-107
gtataaaatttctcaaaaaaagagatagacatttttctgggatagagtataaatttaaaaattccctcaaaaataaaaggtctattgcgcccgccctccctatcatg

SEQ ID NO: 65318 - DNA, 318 bp, Heterodera glycines
  Genomic contig location: Contig_ID=SeqID_35853; Location=469..786; Strand=+
  SCN-specific regions: Sequence locations=1-191,216-318
  Gene Ontology: Biological process=reproduction
gtcaaatgcgtttatggttgttgtgccgactgctgacaaaataaaaaggctgagactcatccgtgccaatgcgactggtcctcccccactcagtgtttacatgctttcatttgattccctctcccaaatgtcctttcgtcggaatttgccaaaaacgatggcgtttctcgagaatgaaatgaaatctgttgtttttaatggtattttttaaaatagtccaatcaagctacagtttttcttccaggttataatattgtcggcgatggcacaccacaggcatttattccaattttgacggcacaaacggaggaggaattg

SEQ ID NO: 65319 - DNA, 301 bp, Heterodera glycines
  misc_feature (69)..(69): n is a, c, g, or t
  Genomic contig location: Contig_ID=SeqID_35853; Location=641..941; Strand=-
  SCN-specific regions: Sequence locations=1-117,139-258,283-301
  Gene Ontology: Biological process=reproduction
cgtctcgccatacatgtggcatagcggcgcgggaaaaatacgccacgcgaaagggtaacttcgtcaacnaaactggcacttcgataacgtttcctcgtcaacggctaaatgcttttgaatgatcaaattattaaaagaagacaaaatgccctaaccaattcctcctccgtttgtgccgtcaaaattggaataaatgcctgtggtgtgccatcgccgacaatattataacctggaagaaaaactgtagcttgattggactattttaaaaaataccattaaaaacaacagatttcatttcatt

SEQ ID NO: 65320 - DNA, 541 bp, Heterodera glycines
  Genomic contig location: Contig_ID=SeqID_35854; Location=37..577; Strand=-
  SCN-specific regions: Sequence locations=1-253,276-312,334-343,366 -373,396-433,456-541
catttcaatcactggcactcaatccaccaacattccaatcactgggactgcattccaatcaccaggactgaacccaccagcatttcaatcactgggactcaattctcctgcatttcaatcactggcactcaaaccaccagcatttcaatcactgggactcaacccaccagcattccaattactgggactcaattctcctgcatttcaatcactggcactcaacccaccaacatttcaatcactgggactcaacccaccagcattccaatcactgggactcaattctcctgcatttcaatcactggcactcaatccaccagcattccaatcactcggactcaacccaccagcattccaatcactgggactcaacccaccagcattccaatcactgggactcaattctcctgcatttcaatcactggcactcaacccaccagcattccaatcactgggactcaattctcctgcatttcaatcactggcactcaacccaccaacatttcaatcactgggactcaacccaccagcatttcaatga

SEQ ID NO: 65321 - DNA, 296 bp, Heterodera glycines
  Genomic contig location: Contig_ID=SeqID_35859; Location=374..669; Strand=-
  SCN-specific regions: Sequence locations=1-78,101-201,224-296
atgcaatgcgataccggggaagcaaatactcaagttttaaagattgtaggtaaagaagttttttaaacgatttctttagaattttttagtcaatatttaaaaaattaaaagattagggagctgaaattcgcagttcacaaatctgtaatgtacgggctaaaaacatgggatttcacgggatatggacactaattgcgctaaaaaatttttctctatatttaatgaatacttgaaagtcggaatttattttagctttataaaaaagaaaaatacgcaatattttatatcagaataaa

SEQ ID NO: 65322 - DNA, 165 bp, Heterodera glycines
  Genomic contig location: Contig_ID=SeqID_35861; Location=389..553; Strand=-
  SCN-specific regions: Sequence locations=1-165
atgtttggacaaagtttgagcaacagtactcaggaagccaggttatcagaatatattgaccataattttatgaaacttagccaaatttttgcaattttgcagaccagaagaaatgccattagagctatcaaataatatcaagaaaatacaaatgtgagcaataaa

SEQ ID NO: 65323 - DNA, 927 bp, Heterodera glycines
  Genomic contig location: Contig_ID=SeqID_7588; Location=1635..2561; Strand=+
  SCN-specific regions: Sequence locations=1-409,445-880,922-927
atgggtgtttccggttcttcattgtctgcttacgtgcaagtcgcagtccacgtacgaaaagatgtttgacatgatcagaaaccgctggccgacattttcaccaacaaatgcgtccatggacttcccctccgcgcaaaacatccacaatgctcaatcaacatttgcctattccatttggtgcgcaacatgaaagcacgtcttaccgacgagcaaactcacgtaagaatttttttttattaattttgaaattctcaaatttagcgtttcaaaacagacgcagcctttgcacgatcagccaaaatggtcacttcgctggcgttcatgccgctggctgaccttacacccgcgtgggcagcactagaagaccatctaccaaatgagcttgagagcgttctcgattggttggttgaatttatttttttcaattttattagtaattttaaaggtttataatcaactacgttggacgtcttctcaacaatgacacacgcactcgtccattgtttcgtccagaagaatggagtgtgtatgagcgcacaatgaacagcaccgaccgcacaaacaacttcgctgaagcgtaccatcgcacgttgcaacttgccatcggacaaggacatcccccaatatggaaatttataaacattttgcgcgagcaccagaaaataattgacgtggacttcgaacatttccttgccggaaatgctcctgccgatgaaatctaagcgttaccgtgaagtggacagacgaattttgagcatattacagcgctacaatgaggaaaaacagcagccacaaatcaacgatgatcaccaatacggcaaaaatcaaaataacccgaatttgttcattgaaatgcttgggggaatttcgagcaattatcaaatggattgttaattttttgttaatttatttgctattacattttga

SEQ ID NO: 65324 - DNA, 277 bp, Heterodera glycines
  Genomic contig location: Contig_ID=SeqID_7588; Location=370..646; Strand=+
  SCN-specific regions: Sequence locations=1-277
aaactccgtctcgccaactccgtcttggggccaactccgtctgagccaactccgtctagccaatttcgtctggcaaactccgtctcgccaactccgtcttggggccaactccgtctgaaccatctccgtcttgccaactccgtctggccaactccgtcttggggccaactccgtctgagctaactccgtctggccaactccgtctggccaactccgtctggccaactccgtctggccaactccgtcttagtgtataaggggccaactccgtctcgac

SEQ ID NO: 65325 - DNA, 562 bp, Heterodera glycines
  Genomic contig location: Contig_ID=SeqID_7588; Location=3713..4274; Strand=-
  SCN-specific regions: Sequence locations=1-41,63-67,89-93,115-119,141- 145,167-171,193-197,219-223,245-249,271-562
gcggacggcaataacaagagaaatgggcggctggcaataacaagagaggcggacggctggcaataacaagagaggcggacggctggcaataacaagagaggcggacggctggcaataacaagagaggcggacggctggcaataacaagagaggcggacggctggcaataacaagagaggcggacggctggcaataacaagagaggcggacggctggcaataacaagagaggcggacggctggcaataacaagagaggcggacggctggcaaaaagaggaaaatagcgggaaatgaaaagaaaaacaccgtttttatgtagaatttttacgattttatttgaatattttttaccaacccacttataaatattatagaatgtatttcaaagttttttttttaattttgcttcaattatgtcatgttcaaccacaacaaggcaagttttgtagtttaagcaaacaaaaaatcgaaatcaattttcagaccgattagaacccgataagaggacaacgaaaagcaaaacgatgactgtttttgaaggctatgaaatgcgtactgata

SEQ ID NO: 65326 - DNA, 477 bp, Heterodera glycines
  Genomic contig location: Contig_ID=SeqID_7589; Location=483..959; Strand=+
  SCN-specific regions: Sequence locations=22-454,476-477
atgaaaactttatttctattttctctgttatttttctcttcatatgaaaacccaattcgcaaacaacgagctgttcgcaatgaacgggcaatagctgggttagcacaattggcagcatcacttgtggccgtgaaagcatttattgccgcaaatgcagctttaacggcttctacagccgtagctttggcagcacttggaaccgatatctaccttgctattgagctcgtgagatgtaagtttatgataattgaaaaggcggttgtgactctaataactcatgttaagcctctgatcactatgaggaattgctcaaagacttcttcccgttaacatttgttttggacgattatgaattcactgtctcggccaaagattataccccggattatatttttagaaaaatatcacaacattttggccataagacagaggaaatatgcataaacagtatgttttaataaacaaaaatgtttttta

SEQ ID NO: 65327 - DNA, 429 bp, Heterodera glycines
  misc_feature (422)..(423): n is a, c, g, or t
  Genomic contig location: Contig_ID=SeqID_7589; Location=1..429; Strand=-
  SCN-specific regions: Sequence locations=1-42,64-68,90-94,116-120,142- 429
ggcggacggcaataacaagagaaatgggcggctggcaataacaagagaggcggacggctggcaataacaagagaggcggacggctggcaataacaagagaggcggacggctggcaataacaagagaggcggacggctggcaaaaagaggaaaatagcgggaaatgaaaagaaaaacaccgtttttatgtagaatttttacgattttatttgaatattttttaccaacccacttataaatattatagaatgtatttcaaagttttttttttaattttgcttcaattatgtcatgttcaaccacaacaaggcaagttttgtagtttaagcaaacaaaaaatcgaaatcaattttcagaccgattagaacccgataagaggacaacgaaaagcaaaacgatgactgtttttgaaggctatgaaanntggact

SEQ ID NO: 65328 - DNA, 284 bp, Heterodera glycines
  Genomic contig location: Contig_ID=SeqID_35867; Location=48..331; Strand=-
  SCN-specific regions: Sequence locations=1-284
atgtgccgtggtattacaaacgctcaccgcccattttttgtggcgtttgtgtgcccgtttatttgggcgtttggtccgttcgtaagttcatcgttgtgcttggctttctgctctttctgatcggaggtctgctactgctcggccttctgctcatttgcgtggccatcgaatgttccgctgcgtttgaccccctttttttcttcctttatttgtttttttttcagtgccgggggtttacttccgttcgccttaatgcttatcatttgtgggctaactacttttga

SEQ ID NO: 65329 - DNA, 49 bp, Heterodera glycines; identical to SEQ ID NO: 57477
  Genomic contig location: Contig_ID=SeqID_35871; Location=538..586; Strand=-
  SCN-specific regions: Sequence locations=1-49

SEQ ID NO: 65330 - DNA, 3724 bp, Heterodera glycines; identical to SEQ ID NO: 7591
  Genomic contig location: Contig_ID=SeqID_7591; Location=1..3724; Strand=+
  SCN-specific regions: Sequence locations=1-351,393-471,495-663,685 -813,835-1006,1028-1697,1730-1785,1807-1879,1916-2044,2084-2158,2180 -2241,2264-2400,2452-2594,2647-2804,2905-3085,3107-3295,3340 -3438,3468-3603,3639-3669,3691-3724
  Gene Ontology: Mol. function=ATP binding; Cellular component=integral to plasma membrane; Biological process=N signaling pathway

SEQ ID NO: 65331 - DNA, 3230 bp, Heterodera glycines
  Genomic contig location: Contig_ID=SeqID_7592; Location=111..3340; Strand=+
  SCN-specific regions: Sequence locations=1-129,215-406,441-972,1008 -1215,1286-1367,1391-1641,1664-1679,1716-1891,1927-2225,2267 -2394,2416-2610,2750-2855,2897-2925,2950-3146,3168-3230
  Gene Ontology: Mol. function=transmembrane receptor activity; Cellular component=plasma membrane; Biological process=glial cell fate determination
accgcagtacctgtcgacaaattcaatcgaacagatttgatggacaaggaaaactgcaagaaggcgggatgcgaggccaaatacggaaaccatcgatgtgattcggaggtgatttgttgaaaaaagtcgaaaataaataataataaattttaaaacaataattattatttgaaatcccaaaaaaaaacaaattaaaaaaataaatttaattttagtgcaatttatttgcgtgccaattcgacggcggcgattgttccacaaaacaggcacaaccctttggcaaatgcccacaggcaagctattgtgcccatgtgtttgcggatggcaaatgtgacgaagtgtgtgggctttatgtcactatagcaatttatttttaaatttgttcgttttccatgtcactatttgcaaattaatttttaaataattgtaattatttttttcaattttctccatccatccctttgaattaagatttgcaacaacgagcgctgcttgttcgacggctttgactgtttggagcggcaccaggcgacgtgtccatggatggtcgactgtgccaaagtgtacgcggacggccattgtgacgagcagtgcaatcaggcgaactgcggatgggacgtgggtggcacatttggaatatcaaaataattatagaacggacaattgatccaaaggacgagggaagtgctggggccgattttcatatgaccggctcaattttatcagatttaaacgatttttaaatttgaaaattcacagggcggcgactgtgcccacgacgcgcatgagcccgaccccacggcggatgaccaacccaaattgctgctgggcgagctgttcctggcggtcgcactacatccgtctacactgttcaacgatacggcactgtttcgccaatttttggtcgcattgagtgcccatctccgtgcgtcgttggcactgtcaattgaccgatacgacaaaaaggcatggaaaatttaattttaaattaatttaaaaattttattgtattcagcccaaactttttgaatggcgatcagacaaaggcattggcaaacgcattgaattgtcaccggaagtgaacgcaacggcactgttcaatgtccgctacgatgagaaggaggaggaagcgggcaaacgaagcaaaagaaaggcggaggaaaagggtaattaaccaaatatattattatttgagttaattgaacaattactgagtaaaaataataaattcaaaaattctttaatatttatttcataataattatattattttcatttttattttcagatgttgtcgaaggcattgctttgtttttgcaagttgatgtcaccatgtgcaatatgtaagagagaaaaaaaacacttacttaaaatatttttctattaaaattcttggctttttttaaggatcactcccggcagtttggcacagtccacccaattggtcggcgttcacaaactgtgcttttcggacctggaaaatgttgctgcttatctgggagccgcaaatgccaaacaggtgattggattattcgaattctattaatttacagttttaatattctccggtttgaccccgcttgatttgaaagacagtgtctgggaatggcaccaatttgccgatttcccaccttgtttttgcacattgttttcgacttgaaggataaatgtaatccgccatttttgacagggattaaattttcattacaattaaatgcacatagtaaaatgacaattaacaaagtgggagataatctccacgtaaaggctcggaattgacgtgaaaatcaaaaaagaagtgctgtggcatatttttattgggtggggcaaaaggcaatttggggagggacacataaattttggggtggacatttcccatggagacactacataattggttataaagaagaattaaattcatttttatgaatggaccccaattaaataattttacatgcctaattagcactaattaattcagttcccgtttctttgcttaagaatctcgacattcccatcacaattctgcagtccgaagcgcttaaaccgcgcgcctcttcgctgttcttttggtttgctttgctcgcctttgcgatagtttcgattgcgtcggccgctgcgggcacagtgttcgcaagcggtcgcattcgcagccgacagcggcgatatgcaaaaacgtggaagccggaattcccggcacaagagtcgaaaggtgatccataatgttgatttacaaattcaattttatttcatttctatattttaaaatgggatttccccatttttagtcgccaaaaatttgctggcaactttgtgcggtggggtcggccctggccactatcagccgccgttgattgacggcaacacgcagcaacacctgtttaacgcgtacacgcaacacaaccaccaccagcaaaatgcctaccaattccatcagccgcagcaacagcatttgatgttcaacgccggcagcatcagcacggacagttgcgcttcatccaccgccgcgtcggccattccgctgattcgccacgcggacagcctgaacagtttgacgagcaatgtgctcgcaaacaatgccatcaacaaaaatcagcaacagcatgggtgaaaaaataaaatatctaaataatttagaaaaaaataataataattttcatttttgcattgatttattttaatataaatatttcaaatcttaattatttgacaatttttataaaatagaatatatatattttttaattttcagacaatttcatcagctaattgacttgcagcaacagtattttgggcccgcccaataccattcattagtccctcataacaaacagcagacaattcactcaaatgcgtaataataatttttattatttttcaaaatatttaatttatacccttcttcaagtgtccacccccatcatgctcctcctgctgttgctgctggtccgtattgctcacgctcgtcctcctcgggcattggcgggtcatcgacggaacattccccgattggtaaaatcattttgaaaacgatttagttttgattattagcacccatacaataacatgcattttgttatcagattcgcacggtcagatggtcgaagacatggaaagacgaaagttgttggcccaccttcgtgaaaatgccctcttttctccgaatggactgttagggcatgaagaacggctggagcctcaactcgtaagtaaaatggaatttgtttaaa

SEQ ID NO: 65332 - DNA, 669 bp, Heterodera glycines
  Genomic contig location: Contig_ID=SeqID_35876; Location=314..982; Strand=+
  SCN-specific regions: Sequence locations=1-268,290-669
gttttcggggcagtccccccgaaccgatgcgcccagatttatggggagaccgaatccttcgggagtagcttccctattgcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggca

SEQ ID NO: 65333 - DNA, 525 bp, Heterodera glycines
  misc_feature (385)..(386): n is a, c, g, or t
  misc_feature (408)..(408): n is a, c, g, or t
  Genomic contig location: Contig_ID=SeqID_35880; Location=1125..1649; Strand=-
  SCN-specific regions: Sequence locations=1-75,121-233,255-446,471-525
atgttcgaatccgagttcggggttcgaaatgaaccgaactagatgacataatcgtattctccgaccctaaaaacctataataaaagaattttatttctaaaaaaaattttgaaaatttttcagggctaccattttacactagagaccggcgcgggacgggatcccgcacgggatttcggtgagcggcagaaagaaggccttacttttgtaaaggacagtatcctctgcaccgtactttcccagaattttggaagggccagcaggagtcatgtttaaaaaggtacatctatctcggaaaccctagtgctggtctaacttttttttttccaaaatttctgccagacttacaaaaaatgttctaatcaaatttaatttgggcttattnnatgcgctgtttcccgcagatcnaagcgacgaaaaatttctccttttcccgggccccagtgacaaggggaaagaaaaaaggggttcaattttggaaaaaacaaatcggattttttttttcggggggttgggaaaaataaa

SEQ ID NO: 65334 - DNA, 781 bp, Heterodera glycines
  Genomic contig location: Contig_ID=SeqID_35881; Location=17..797; Strand=-
  SCN-specific regions: Sequence locations=1-46,68-167,189-360,382 -480,502-781
atgagaaaatttttggaggtaatactggagaattggtgtcacggcgaaaaataaatttaaaatttttcttttcgagttttccggtgtaaaaaaatatgctgattacggatctgagctcagaattcgaaaaatcattgatttgtctatgatttttcatcaagaacttgatttttttaataaatttttatgtaagaaacatgaaaacatgcattctggggttttgggagttgctgatcatgaatatgactttagttttggccaattccgaatctcggcccgaactcggacaaaatatcgaaaaattgatttttatgtatgagcattttcaatttcgactttgttcgagtttgggtccgggataaaattactcaaaattaatgtcagattcgtgataattaatttattttcgccgggacaccaattctccagtattaccaatgtctatgtgggtcaggtggacaataaaagttcagcgggaggaaataaaatttctttcaaaattgcttgagaattttttcaggcgctccaactgcacaccaaactgatgaaggaagcgttggacagagacgtgaagcaaaaaaggggcgaaggaggcggcgatttggccaaatcgaacgaagtgatggaaaagcgaaatgggaaaaaagggattttaaatggtacccttttcaaggtgaaacacgcaaaagcggaggcggaccgacgtgccaaattggacacggaaaaggaaggcacggcacgagacgcaatcaaagaattggagaaagtcggtgttgaataa

SEQ ID NO: 65335 - DNA, 622 bp, Heterodera glycines
  Genomic contig location: Contig_ID=SeqID_7594; Location=1028..1649; Strand=-
  SCN-specific regions: Sequence locations=1-44,80-105,128-207,234 -266,288-353,382-433,466-573,595-622
atgcaaaatgctttacgtgtcaaattggccgagttacagaacagcagacgaacaaaagaagaagaaaaggagcagcagaaagaggaaccaccacaaaaagttggcattttgggggtttatttgtattaaggaagtgaaagaaatgaaatggatgaatgccattttccgacccaaataaaaaatcagtccgggcatttgtgcttatgtccaaaatcggtttaaatttttatattttgcttcgcaattatactaaattaagaaatcagttttttagaaaattaattcagacctttttataatttttataatggtaaaaaatgtgttctaagttcccacttttggtaagctaagcgttttcccctgcccctttcagttagatttttccctcttcgacgactccgaattcgcgaatcgttcatgggtcgaactcattgaagaggaggaggcggcggcgcggaagacgcacaaagcaaaagcggcgaccgctgaaacgaccgccgcgtccgctgcccctccaattgcttctgttgctgcggtcgcttcgtcttccgcttcccccagcaataagcgatgcaacagcgaaagagcggaaaagggagagaatgtgccgaaggcgcaaaag

SEQ ID NO: 65336 - DNA, 198 bp, Heterodera glycines
  Genomic contig location: Contig_ID=SeqID_7595; Location=206..403; Strand=-
  SCN-specific regions: Sequence locations=1-198
atgttggagagggtaaacgatggcgaagaaccgctcaatggtcagcgaaatgatggcgaaattgctcacgtaaattgccgtgttccaagtgaaacggacggagaagcaaagggcgaaactgacggtgtcaaaattgacaaacattcgcacgaacatgctgagaaggaccagcgaatcggaggccaacagcaccaaaat

SEQ ID NO: 65337 - DNA, 996 bp, Heterodera glycines
  Genomic contig location: Contig_ID=SeqID_7595; Location=947..1942; Strand=-
  SCN-specific regions: Sequence locations=1-642,666-727,749-872,895-996
atgtgtgcttctttgttttgcatgaactattgttggcaaagtgatggatggcttactaaagattcggattttgttttgctgtttgttggcatttccttaataggaaacggcgtttattgtgccgttttgatgtgcctttggtcctctacagcctaataagcagtgatggcaaatgaattcattttttggcacaatattctctccagaaaatttatttattagacactttcccttttggtaaatttacaatttctttaaaattgcacaattttttcatttaattattttcagcgtccttaaattattgtctctgccgctgttttcgtttcgattggtttcatttggagactctttttggcattttccgtctgcacatcttttgtcgtcattgtggtggaccttggccttattgttgcccgttttcgaagccatttgcgacaaaattctttccgaaacaccgggcttcaatagtaatgctcgagaaaaatattctgacttttgttcgtttggaagaatttgagaaagtttttgaggttgtacatgaaattgaaaaggacgtaaacgaaagggacgacggccaacaaaacattggtggcacgcatttcgccggggcccgtctcgccttaaagttttgttgtaattaaaatttgaaaattggaatttttagttaatttgtttactaaatgtatcaattagcgttttcacagtgcgtgacttgaaaatgggtcagtgaatcagaatatcttggaaaaaacgagacccggtagtataatacttatatcttgattggtatctaaacaagcttacaacaacctatttacagtataatttttttagggattgggtaaatttcaaatttctttagactttaaagaaactttgaaaaaattcagaacgaagtttttaaacaatttcgaccttttataaatgctacagtactttaatttagaaatactgtattattgacttatttttccggtaacttacaataataaa

SEQ ID NO: 65338 - DNA, 63 bp, Heterodera glycines
  Genomic contig location: Contig_ID=SeqID_35882; Location=24..86; Strand=+
  SCN-specific regions: Sequence locations=1-63
atgagcgctacaattatcagagtgccgaaaatcgcatgtgatctaagcctagcaaaaaatggt

SEQ ID NO: 65339 - DNA, 652 bp, Heterodera glycines
  Genomic contig location: Contig_ID=SeqID_35884; Location=29..680; Strand=-
  SCN-specific regions: Sequence locations=1-56,78-271,293-652
atgattgtcggtactaagcgccacttcaaaaagttcttcctcgaggaggagggacgcgagggccgtccgttcaaccagaatttaacgccaggctccgtaatccaagagaaggtgacgcgcgcggacatcacggaattgtaagggagaaattttaatcgcattttgtgctttggtttttaatccacgcattttcagctttcttcagccccacgcaccgattcaggcaaatttttttgttttttcactccatccaatttaaccgacaaaaaaatttttatttgtttccagggaacgggcaaacccgtagaatacgccatgttggaggatgagattggcatcagcatggacgaattgcaaggagtgattatggcgttgtcttactcgcatcaggtaaataatgttgatgccgattctccgagaaaaattgaaattttgtgtggcctattagtaaaagagtaaccgtttttagtgcaattagtctattttctccgttaaattttgcattctcattgtcagattgtcaatgttgcggtgagcatgcccgagcctgtataccaagcccacgaattggccaagcgagggaaaaacaatttcgtgactttgaagtatggccattaaatgttgaacttttttttaatggtgggggattaaa

SEQ ID NO: 65340 - DNA, 374 bp, Heterodera glycines
  Genomic contig location: Contig_ID=SeqID_35885; Location=130..503; Strand=-
  SCN-specific regions: Sequence locations=1-374
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaatatatatttgcaatttatcaacaattttgagaagtgagttagaaatgataaacttcacgattcaaaccaattttcgttgctctaattaaccgcgataaagacattcgaatcaattaaatagcttctgagataataaggtttatcataaaatttcatttaaaaataaa

SEQ ID NO: 65341 - DNA, 469 bp, Heterodera glycines
  Genomic contig location: Contig_ID=SeqID_35886; Location=718..1186; Strand=-
  SCN-specific regions: Sequence locations=1-141,163-175,197-228,262 -380,422-469
atggtttatgttggcattttcagtcagctaatgcggcttgcacatcagcagcaaaggccggcggaggtgaatcgacgccaacgccaaaatgctaacgacggcacatttgataaatgagatgagtgaaaagaagcaatgatcaatttaatttgttttatatttacaaatttattggcaaaattaaagacatcaattacaaaaaatatcatttgtcacttcaattattgcaatattttttttagttaaattttaaaaattaatgtcctttaatgggctgaacttatggaagtaatattttcaatttaatagcatttcctaatttttcattcattaagacaaaaaaaaacaaaaaattggagtttcgtatagagagagcctcattaaatgcttcaaattatattatttgtaaattcatttgttttatagaatctatctaatcttgtcgcaaaggctgtttaatgtaaataaa

SEQ ID NO: 65342 - DNA, 333 bp, Heterodera glycines
  Genomic contig location: Contig_ID=SeqID_35888; Location=234..566; Strand=-
  SCN-specific regions: Sequence locations=1-85,134-333
atgtgctgctgtgttcgaatcgttgggcttaatttcggctgaaaaggaggaaatttatttgcaatttgaccaatttttgaaggagaaaatttatgtaaaaaaaatatttaaaaaaatattttatttttattttcagccaatttccaaagcgatcgaagcatttctcggcactatgcgcgaatgtgcgcagatggcacgcgactcggcacgcgcgtgtgccatcttttcgcaatggagccgcgaatttggggaccaattgcaattgcagccgaattgggaggtgaaaagagaaaatttaaattaaaaaagaaatgcaaattgtttgaaaataaa

SEQ ID NO: 65343 - DNA, 463 bp, Heterodera glycines
  Genomic contig location: Contig_ID=SeqID_35889; Location=126..588; Strand=+
  SCN-specific regions: Sequence locations=1-48,73-92,129-315,339-463
atgactcgacgccgcttttggccgcgtgtgaaaatggagacgaaaaaattttggccttccttttggaaaaggtaaaaccacagatcattttgaataaataaaatatattttttaatttttttttttttgacgggatgataatgataattaattaatgataagcggatgggaaatatttaatttttgtgtctttcgaatgaattatccatcaaattcaataagcagtagagctcgattgaacgacctggaaatgaagctttttcgctcctaacttgggcctgagttttttcattttcgacctggatttcctagacaaaaatccaggaaaagcccaggctttgatccatggccagcaggtcgtgctctaacaatgactgcttctctcatttgtggtgtttgttctctgttaagaaaggcgacccttcccgttgcaacaaacaaggccaaaacgcattcacaataa

SEQ ID NO: 65344 - DNA, 63 bp, Heterodera glycines
  misc_feature (26)..(26): n is a, c, g, or t
  Genomic contig location: Contig_ID=SeqID_35889; Location=1..63; Strand=+
  SCN-specific regions: Sequence locations=1-63
tgaatttagaaaatattatcatgccncggtggtacagttactgcttgaaaacggcgcagaccc

SEQ ID NO: 65345 - DNA, 590 bp, Heterodera glycines
  Genomic contig location: Contig_ID=SeqID_7597; Location=300..889; Strand=-
  SCN-specific regions: Sequence locations=1-62,84-471,494-590
atgccaactgttcgcgaaatacttgagagtctgcaaaagcgagtaaaaaagcctcgcattgctacaaatgaagacagcgtactgaatgttgagaggacagacgcagaacaacaaattgaaggcacttcaaccaggaacaatttggacgtcgcttcgagtgatgacgaagaaaattgtgagcccgttcaattcaaacgtggagaaacaatccggggagctctttgtctttggtatcaaggtgttactagttttttttgatttttatttctttattttcaggctttcgatttatcaaaaacagaaaagatggtagctggttcaggtgcgaacagcgcaattgtccagcgacagccaaattggacgacaacgatttgatgacaggcattttgggcgcaaaaggacatcaccatggttgcgcaccatcgcgttatgatgcagagacgaaacgaaatcagatgaagcgcctgatcaaggaggagccaaaaacgaaaccatgtcaaatccgcgctcaaattcggactgacatcgacgatgaagtcttcgaattgctcggcaccaatgaagcgctcgaccaaatggcgaacaggtag

SEQ ID NO: 65346 - DNA, 439 bp, Heterodera glycines
  Genomic contig location: Contig_ID=SeqID_7598; Location=9..447; Strand=+
  SCN-specific regions: Sequence locations=1-6,28-57,79-439
atgaaaattttgagaagcttcaaaatttccaaggaaccaaaaatttgtttagaaggaattttctttgaaagaaaattaattgatgtggaaggagcgcctcaccttttggtaatacattggtttgtctacaacccccatttttcaaaaaaaaaaaagttttgttttaatctgtgtaaaacgccttttcctggggtttcgaggtcgctgataataagcttgacaaatagcgaatcctgaattcgaacaaacatagaacattcaaattttcgaaaaccccgggaagatgttttacatgacttttttcgaaaaattgggagaccacaatattatttattaccaatttttccattgcagatcggtggaaaagataagcagtttccgtgccacgagatgcccaacaaaattcgcttctgtttcctccaaattgagtaattcaata

SEQ ID NO: 65347 - DNA, 348 bp, Heterodera glycines
  Genomic contig location: Contig_ID=SeqID_35896; Location=83..430; Strand=-
  SCN-specific regions: Sequence locations=1-348
ggcatgcgcgactcggccacttcgtcgtcgtcggcatgctctgcttcatcgacgcgtaagttttgcgctaatgatttcatttgtctcttaaactgtcgaagcttaatttgcttcgaattttctcacagttcgtcgaccgttcgaccatcccaccaacctctttttgtgccaacaagcgctgaactcgtccaacaacttgacgctgaacggcatgcccacgaccaacaacgagctactgttcccctccgccacaactcctctcctgcaccaatacggcaccaccgcccaacttggcactgctcaattcggcatctccgcccaacttggcactgctcaattcggcatctc

SEQ ID NO: 65348 - DNA, 168 bp, Heterodera glycines
  Genomic contig location: Contig_ID=SeqID_35898; Location=618..785; Strand=+
  SCN-specific regions: Sequence locations=1-62,88-168
ccatttgaccggaccaagcgcttttacaacatcagcgactacataagcagtaagtgtttggtggtctctttcctctctcctttctgtgcgccggtgcggttgggccccaaaatttcgtttcccccacccgtttgagccaccgtcgtgtccattgcgcccgccagcgaa

SEQ ID NO: 65349 - DNA, 324 bp, Heterodera glycines
  Genomic contig location: Contig_ID=SeqID_35899; Location=533..856; Strand=+
  SCN-specific regions: Sequence locations=1-163,201-203,225-324
atgttcgaggcggccaacgacaaggaggcgtactatcacatgttggcggagaagatttacaaaatccagaaggaattgcaggtaaacaaatgcgagggaatcaacgcaatgccaaaaatgtttttcaaaagcgatttttgggaggcataaacaaacttttaagaattttatttcataaaaataaatatagaaattttttagacggagaaaaattcttttaaaaagccatccaattttattttggatccaaccttcaaaatgaccgttcgtgttgcattcatgggctgttcctatttttgcaggaaaagaaaaaccggaggctga

SEQ ID NO: 65350 - DNA, 430 bp, Heterodera glycines
  Genomic contig location: Contig_ID=SeqID_35900; Location=134..563; Strand=+
  SCN-specific regions: Sequence locations=1-73,95-249,274-430
atgcatggttcttcaccattaacagaggctaatctgtgcatgaaatttgagtcttctttttcatggaaggattgggttaggtaaaagctatttttatataagccgtcaaaatcaaaatttgctcaggttacgtgacacttggaatgccgttgttacgtcgcaatcgcagattcacaggcattctgaacagctcgacaaaattgtttcggaggaaagcagttacagaaattatgtgctgcgttgcgcactgaccccaacttaattattattttaggcatctgacattcaaaatcgacaaattatgatccaaattgtggaaagaaatgtgaacaaagcgagggaattggtacgaacggcgcgatatcagttgaacgctttcaattcggcgctgagtcaaagtgaaaaaccaatttatgtgcaaaggaattga

SEQ ID NO: 65351 - DNA, 553 bp, Heterodera glycines
  Genomic contig location: Contig_ID=SeqID_35901; Location=367..919; Strand=-
  SCN-specific regions: Sequence locations=1-68,90-105,136-553
atgaatgatcaaaatggaccaacaaatattgaaaattttgtgcaaagattatttgtagaagaatctaatcaaatttttgatgaaaatttggaaatgaaagatgagaaaagtgaagaaatgtccacaaattgtgatcaattggaacaaatgacagaaaatagtggacaaatttatgatcaaattccaattttaaatgataaacaaaagagagaaattgttgaaaaattccataaaataaaagagaaaattaagcaaatgggaaagaaatattcaacaaaagaatggaataaaattgaaagaaaaattgccacaaaattaggtgcaaatcaaatgaaaatttacaaatggaaaagagaatttggaatgatgaagaacaaaaattattcagttgaagaaaaaagaataatgttaaagcaatttgatcaaatatatggcaaattaaaaacgaaattaaatgaaaaattggaaggaaaagggacaaaatgccaaaaataatagctaaaaatttgggcataaatattagaagtatttataattggaagaaagaaataaa

SEQ ID NO: 65352 - DNA, 1668 bp, Heterodera glycines
  Genomic contig location: Contig_ID=SeqID_7599; Location=1194..2861; Strand=-
  SCN-specific regions: Sequence locations=1-383,414-667,717-1005,1027 -1361,1383-1668
atggcaaaaacaatggacgaattgcaaaggaggacagtgaaagtgaacactttgatgacaccgacgaaggaacagcagcaaaagcaaagcgaacagaagcatcagaaagggggagaagcagcggaaaattgggcaaagcaaaacgacgcgggacaaaacgccaaaggaaatgccaaagacggagaaggcacaattgggggagaattgagcatgagagataaggaaatgtaagtgccaaggggggattaatagggagggcactacaaaagccatggccaaggggccaaagagttgagtgggacgaggacttgggaaaagcgcaagcagagaagcgaaattcgaattcatcggactcaaaacgaaaaagagtttatttttattccaaaaatatattatttatttaaatttaatttcttacccaaattttacgtcagtttttttaagtgaggaaagatttaaatgatttttccattgtttgcttaagaatcgcccgctgttggcggaaacgaattgcgaccgatcggtgcgaccttttccacaaaacgatgctccgatgcattgaggcgagcccaaaactgaatgaaatcatcgcatgcggaagatactgttaccgtgacttgacaaaatggccaaaactgaacagaatttggttagttttggggcggggattaaaaataataaaaaaatatttattaaattaaatattaaattttattcggtcaaaatgtccacagaaaaagtgccggtttccaccatgaataaaaaaatattcatttatttagccaggcgcagttcaaattttacgaacggctcatctacgagctgaacatggacgagcggcggatggccgaccaatgcacgcggctgggcaaaacgcacgcggagtacgcgcagttcggactgaagccgcactttttggacatttaccagcagagtctaatcggtgagggcattcaaaaggaaatgccacgggggaggaaattattttgccgattttaaaggtacataattttatttttcagcacttatttccaaaatggaatttgccgacgacaacgaaagagcagaaacgattaacgcatttggacgactgatcagattcatcgtagaagcaatgatcgaagggtatggccaaagagtgactgagttgagaacggagcgaaggggcagcggagagacgacggaggaaaaagggcaaatcggacgacgaattgaaaagtgatcgaaacgaactacaaaacataccatagattattcatacaaaacaaaaacatacacatataaatatgtagccttaaagcaatgtttgagagatttgttggtgatttgagtaccggggatggacggatggagccccgaggcccaaaaatgaagttgaaattccgagccaaaaaatgtcggacgcaacgcggaattccgtctggtgagtagcttcccggtgggaggctaatttttgagacgtccgtgtttttattttccaaaaacctctattagaacggccctcatcaacaaaattagccttttttaccctcaaagaacggaattccgaaatcatttattagtaaattttcttaagcattttgctaaacatttaacttaaaaattggtaaatttgtgtcaaaataactaaaaaaacgcgaaaagagccgtttttcgctaattaataaa

SEQ ID NO: 65353 - DNA, 732 bp, Heterodera glycines
  Genomic contig location: Contig_ID=SeqID_35902; Location=124..855; Strand=+
  SCN-specific regions: Sequence locations=1-96,118-477,500-732
atgaccgccattgtcgggggagagcccaagccgaacgttaaatggctgcttaatgagcaggaaatggacgccgtcgacaaaaatgtgcaggtcttttttatgaaaattcaaatgatggcattgaaacggtagaaatccaacgaagatacggtatctgacccaaaattgacctaaagatcacttccggacccggcggtcgccaaagtctgcgaattgggcagacaaacgctgcgcaacactccggccatttgatggtacgtgccgaaaacagcgaaggcgccgccgaatcgtcggccgacgtcaccgtacagccaaagccgggcccaccgtacttcagccgggaaccccaagaccacgaagtgtccgatggagtggagtccgtcaagttcagtgccattgtgcatggcaacccggtgccatcagtttactggcgagtcactctcattatttaattgccttgataatgaatgctaattaattttttgaaaaatgattttcattaatttaaaacaataatcggcaggtatctgaagggcgaatgcctcgtcagcggggacaatttgcgcgtcaaatatgacgcggtcagcggcaaaacgtccattcggctgttccacccgaacacggacgactcgggcgaggtgaaagtgatcgcccaaaatgtgcacggacaggccgaggctagcgcaaaactgaaggcaattgaaaaaacaaaattggaataaatatgggcaa

SEQ ID NO: 65354 - DNA, 438 bp, Heterodera glycines
  Genomic contig location: Contig_ID=SeqID_35903; Location=159..596; Strand=+
  SCN-specific regions: Sequence locations=1-438
atgaccaaatggttgttcacgccttgtccgaatggtgtgccgaagtggctccaatgttttgtgaattcaccggttggtcaatggtcgtcaatgatggaacagattaaagcggtgattatccctttttaattgcttttttctatgattttttgtcccattttaggcattttccaatgcttcttcggttacttttcgcattcactttctgctgtcttctccgattgactctgttgttccatttgttgatcggatcaacgaagtgactggggaggaattggcacttcaacaatcaaatggcttttggctcacccgttgtccaattggatgggataaccgaaattgggataatgtgtgggaagaattaagtgctcgacagaacccaattgacattgtgatcaatagggatcggattagcggattcgtgttgagtatcctatt

SEQ ID NO: 65355 - DNA, 1065 bp, Heterodera glycines
  Genomic contig location: Contig_ID=SeqID_35905; Location=268..1332; Strand=-
  SCN-specific regions: Sequence locations=1-47,131-247,289-290,314 -356,404-407,429-520,542-981,1003-1041
atggaggaatggaaacaaaaaaagaaagcatttaaggatataaaacgaaaaattaaaaagtaagtatttaaaaataagaaaaaactataaagtctaaaaaaatttaaaattttttgagttatttttattagggcctccttatttacatattttcgtatatatttctgggtttttgtacatatttcatacatattttagcattttttatacataataagcgatttttcttacacaaaaaagtaagcactaattattatatttatttaaattttgaattttttaattaatggccaaaataaactaacttttctaaatgaaactttttctttttgaattctatgcctacatatgattgcttaatttaaattaattaattcaaaactttttttttaaattaaattttcaatggaagaaattaattttaaaaatgcaatttccaaattaagtgacattttcgataagaccgaaaagggcgctgagttttcatttggcaatcacattttcaatgccgtagagcgcaaaaatggtatagtgggcaaattgttgtacgattgggagaagaagaaactgtacgaatgggaccgtaaccaaatgagcatttgggtggcaaaacagtacaaaaatccggacccgccggaacacagtgagttacagacagcatactactgtatatgcatggtgtagtgttactgtatgtaaaatgaataggaataatataaattagtagaatgttactgtatgcaaaatgaatagaaataccaaaataccatttggtacctctgcacctattaagacacttttttatggatacggaacacagtgagtgggttacagcatactatactgtacattagtagaatgttactactgtatgcaattttttttgttgatagaaaattctaagaaaaccagcaaaatgtgaaaaatttttaattaattctcactgatttagattttttttttaccaaatattgtttttttggcatttttaaaaatttaattggtgccatttgtttagaagaaaaaaaaattgggtaaagctaaaatttattaatttttaataaa

SEQ ID NO: 65356 - DNA, 237 bp, Heterodera glycines
  misc_feature (30)..(30): n is a, c, g, or t
  misc_feature (33)..(33): n is a, c, g, or t
  misc_feature (35)..(35): n is a, c, g, or t
  Genomic contig location: Contig_ID=SeqID_35906; Location=678..914; Strand=-
  SCN-specific regions: Sequence locations=1-112,162-237
gcaaggcattcggcgtcaaagatccgtacncgncnggacatccgaatttgcacgagtgagaaggagaacgagtgggaagaatcggacgaggaacgtgtggcacgccatgcaaaggaacgagaggaggaagaggagcgtgagagaaaggaagaacagaagcgtaaggaagaggaagcggaacgcctccgtcaggaacaactgcagcaacaacagaatcaggaacagcaacctcagtag

SEQ ID NO: 65357 - DNA, 869 bp, Heterodera glycines
  Genomic contig location: Contig_ID=SeqID_35908; Location=76..944; Strand=+
  SCN-specific regions: Sequence locations=1-357,389-810,843-869
  Gene Ontology: Mol. function=calcium-dependent phospholipid binding; Biological process=vesicle-mediated transport
atgggacgcactttggccccattcgctggccatgaccacggcatttccgtgttcggattcggcgactcgaccaccggcgattggacggtcttctcgctgaacgaagagaaagactgtgagaatttggaggaggttctcaggttagtcggcgaattgctgacaaaggaagttcgtcgcgttttcagcgtgtacaatcgcatgactccaaacatcgacctcagcggaccgaccaatttcgcgccgctgatttaccgcgccatggaaatttgccaacagcggagagacgtgacaaaagcatttataatcaaaagtaatcactttgtttttcagtatcacattttggtaattattgcggatggccaagtgaccaatgaaaaggccacggtgaaggccatcgtttccgcgtgtcaatttcctttgtcaattattgttgttggagtcggcgatgggccctgtgaaaatgatgcgggtcgatcaacaggccaattcagtccattttcaataattttttaagatttttgatgagtcattgcccaaaaggccgtgggacaactttcacttcgtggagcttcatgaactgatcaaccaaagggctgatcagccgattgagtcgcgagaattggcatttgccgtccattcacttttggaaattccggaccaagtaaaggcaaaacaacgcattgtccacggcatttttcattattcagtacgcgaccattcggaagatgggtctcttgtcatcgaccgcttttttcactcgtcctccttctcattcgcctcgtcggtcaaaatcgccaaaagcggcgcagaaaatcaatggcacaacagcagacgacgagggggcgcaggagaaggagacgaactgttga

SEQ ID NO: 65358 - DNA, 577 bp, Heterodera glycines
  Genomic contig location: Contig_ID=SeqID_35909; Location=44..620; Strand=+
  SCN-specific regions: Sequence locations=1-132,155-577
atggttttcaatagaaaagaacgattacaaatttctaagaaaattggtaagcaaagagacaaagggaagagattgtccaacaaaaatgtgaattggcgccttggtaaacaaaatcaatttgcttaattatctgctaattagttacattttttgtcagtaaatttggagaaacggaagcaacgcgaaaggcaaacaattgaagaatatgaagagaggaaaagcaacactaacaaggaggaagaagaacatgtggaagaggaggagcagcaacatgaaaagcagcaatccgattcgaatggcgtggcaatggaatgccaaagtgaaaaaggtgggaggagggcgacggcacagtgccaatttcagatattggatttaaataagccattaaattgtctcggcgcttgacaatgtttttttttttgggaacgacacgaatgataggatcgttgtaggaaaagagaaaatcgtggttcatcattccattttagaaggttggtattcgctgactgttgcgttgccgggcacaattttggacaatgttcagacgtctgagctcaaaacctatctgagtggagag

SEQ ID NO: 65359 - DNA, 348 bp, Heterodera glycines
  Genomic contig location: Contig_ID=SeqID_35911; Location=7..354; Strand=+
  SCN-specific regions: Sequence locations=1-348
atggaaggcgcgagtaccgtagacgcatgtcatattttgcgcataatactgtaccagatttgtctgctggttttggatggtgatgatcatttcgctggcgcatcggtcggtcagtccgaaaacggcgaaagtcatctgaattcgaagaaagtgaacggcggaaatcgatttcaaatacaagaatgggatatggtaaaaggattaatggcccgtgtcctactgtacagaattcggtggcaagtagacatagaatgtcaacgcgcaaaaatgccaaaaaagacaaataaaagtggcataatccttcattcgacttaatctatttaattttaatcagtgtataacattaaa

SEQ ID NO: 65360 - DNA, 603 bp, Heterodera glycines
  Genomic contig location: Contig_ID=SeqID_35911; Location=502..1104; Strand=-
  SCN-specific regions: Sequence locations=1-25,49-420,451-603
atgcagaagaacgtgcgctttgtcggcgacagtcccctgcagagcaaagccatcattcagttagatggtaacattcccatgatatctaaatttgtcaaaatggatcctggcacaaaatctatggcaaaattttcctcttgtaaaatctggattaaggagctaatcccggttggcgtcccgacgtttttgaattaggatatttcagttttgttaacattaccataaaagattccacaaatattttgttttctgtttcagcaaagaaatcggccttcttcccggccattgatcttatcgaatttgtttgccgatttctcaattctcgccctgattacatccaaaatgatttctcacagcccgcgaaggtgcggaccatcgtcaaacagatcaaaggtgaatgggtgctaaatttacatgtccattaaatatatttttttcattttaaaaaatgaattgctaaattaccaaaaatttcaggtcttgctgtgcaaactgtgcatttgccagaaagtcaggtaatgtaaaattatatacatattgatcaccaaagtttttttttatatgcgataccaaaaaaattttgacaatttcttaataattaaa

SEQ ID NO: 65361 - DNA, 61 bp, Heterodera glycines
  Genomic contig location: Contig_ID=SeqID_7600; Location=423..483; Strand=+
  SCN-specific regions: Sequence locations=1-61
acatttatttgatttattttaccatattcacaatttgatcagaatataggtggtcaaaagt

SEQ ID NO: 65362 - DNA, 1404 bp, Heterodera glycines
  Genomic contig location: Contig_ID=SeqID_7601; Location=136..1539; Strand=+
  SCN-specific regions: Sequence locations=1-269,293-348,370-429,452 -523,545-862,884-1075,1097-1142,1168-1185,1209-1246,1287-1404
atgccttcccgtgcttttcaaagacaggttcttgtggaatggcggaacaaatcgaacacaattcgcggcaaagtgaccaaagcacagctagatgaacggcgtcgttttcatgcacagtgtgtcgaaaatcgtcagagagacggtcaggattggattgtctatgcaggaagcgttatcttacgggaggaaattcacatttttcggcgccaaatgatagataccgattctcgtaaaaattgactcgagacaaaatcacctaagcatttctcaaaaaattttcaaaatttaaattgctgcctaattaatattaggtcaataatgaacaaaatggaagagatttcactaattttagaagccaaaaaatacaaatcttaacattaactgaaacttggacaacagaaaaccaggacatacctttttgtccttggattaaagaaaattttaattatatctttgcttcaagaaaatctaaaaatctcttacgtagcggtggctatggtattcttcttagaaaagaaattaaattttttgttaaattttctgatactaaatttaatagttaaattttggttctacaattacaaaatactaaatcaattaggcttatattaatatatcgtccgccaaggactacttttaagcaaacaaaaaatctttttagtttttaaaacctttttctgtgtaaattctataattttagacgatttaaatttttctaaaaaagacctagtatggaaggaaggcaaaccattttccttgagtaattttggtgaaatattttgtgacttctttaataggttttcttatgttaatgccactcatggaccctcaaggagaaattcttggctagacagttttaccagcaaatgataaaattgtaacacaatgttctatcgaaggaggcattttttcgtcagatcatttagcccaattttttatattaactgttccggaattaattcctaaatcaaaaacataaatattaggcgatttactccatcaaatgtgtcacttttcaatgtagttattgcctcaaggcttagagctttatcatgtggaataatcagagtaaatgaaaaatatgtatcttataacaatgcatagatatattgttatgagcagtgtattggaaaaattcagcaataattttattatttactgtatttaccgtaattattttgacaattatttcaattttatatttaaagttttcaccaatcggaagaggatacaaattaataagccgaaatttaattacaattattatttcttttttattaattaatgacaaaattttctcggcgagagggtcacataaatgtgacaaaaattcatatgaaatttctgatcagcaaacgccaaaatttaatgaatcacaaaatattattgttcataaaatcacaa

SEQ ID NO: 65363 - DNA, 857 bp, Heterodera glycines
  Genomic contig location: Contig_ID=SeqID_7601; Location=1860..2716; Strand=+
  SCN-specific regions: Sequence locations=1-38,60-159,183-261,283 -433,455-857
atgatcgaaccacgaaccagcctgatcaaattcgcagccgagttgttcaacaccaaggctgaatttgtgcagtgcattgtgctgacccgggccgacaaacgagagaaattgatcatggaactgagaaaggccgacttcaacggggtcaaaatttggagcaaaatggacacaaagccaaaagtaaatttaaacgaaaattggtgggaattcgttttagacatgccatttgaagccgaatttggaggcaccaattcggtggtcgaattaaacaaacaaataaatgatgattttcgaccaaatttgtcaaaattcggaccaggtttagtcttaaaccgaaaattttacccgatttcgggaataatgctcgaaggagtactcgatatttatgataaatatcgagaattctggtggaaaattgaaaaggaaaacacccaaattcaaaattctaaaagttgccaaaagggtgcaacaaaaataatgaatgcaaatgaagaaaaagaaaaaactatcgaattttttatggaaactgatgaggattcggttgattttgaagccgaatcggaattttttcaggaagagaaggagcaaaattcggccaagagggctgatgggcgtctaaaactgacggtaaaggcgaattccaatcaaaaccgtgttttgacaattaagggagttaatgctaaatgagagcattttggacgaaagtgatgaggactcttgtggaaagtccaaccaaaaggccgaaaaagtgaacaacgccaaaaggcgaaaaatcgtgtatgagtgccatgagtgccaaccgtcaacgagtgcgcaaaacgcaatttcaaatcaaatgggttttggtatagaaaata

SEQ ID NO: 65364 - DNA, 98 bp, Heterodera glycines
  Genomic contig location: Contig_ID=SeqID_7601; Location=4593..4690; Strand=+
  SCN-specific regions: Sequence locations=1-48,70-98
acttcattttcaactactctctctcactaattgttgcacattccccaattttatttcttccttagtaagtagtattggtgcacaatgcgcacttttct

SEQ ID NO: 65365 - DNA, 485 bp, Heterodera glycines
  Genomic contig location: Contig_ID=SeqID_7601; Location=2741..3225; Strand=-
  SCN-specific regions: Sequence locations=1-242,264-485
atggttaaaaatccaattctttccaattcgttcgtcacagcggtgacactcggggggctgaagttcttcttcatcatttgtgccaacggttttggcagatttcggtcagagcggcttcgatcgcgaagagcatggcggccaagtcggggttcggttgtcggatgtgatttgccaattcgtgcattgcttctgccgcggttctcgccaagtcctgcgcttgtcggtcggtctgatcagtgctgttttgccattttgggggtggaaatgagcgccaagtttcagcttgtgggggggggaacgccaatgatcaggtcggccacagaaaaagtgtccccgcccgcgccctcttgcgaattttgttgttgcgctgtttctttcttctttcagtgctgtgccgagcagttgtccggcaacagtggccaattgggagaccaattgggggttggcttggaccaaaccgccgatttcggaacctgtttcgttga

SEQ ID NO: 65366 - DNA, 752 bp, Heterodera glycines
  Genomic contig location: Contig_ID=SeqID_7601; Location=3848..4599; Strand=-
  SCN-specific regions: Sequence locations=1-159,181-722,744-752
atgaagtgtcattggctgagtttggcaccgcttttatattggcactttcagcgaaaagactgcacggcatgcaaatgcgaagcaatatcgcatggaagacggtcaaacaaaaatcagatagcacatgccaatgaagagagtgggcagagaaataaaatatctgtgcaaatatgggatacatcagagaaagagagtcagtcatacatacataaaatgttcgtccaaatatgggctacatcagagaaagagagtcagtcatacataaataaaatgttcctgcaattatgagatacaccagtgaaagagatcggcaaaatacagtgccaatattcatatagagaaatagatttctgtttttctcataataatatacttctatgactattatagcccacactatacacgctatggaactatgcgcccaattttggcatggtcataaatctttgtttgcctgtaagcattttgcatgcccacttttggcagagtgccaatttattgctgacagcctaataaggggaaattcgcataaaaatgagatttatgccaacaccaatgtgtgtataaaaatgtgattgcacttatgcatctgacaaacaacactaagacatgacaatcattgtttaagcatatgaaaaaaactatacgattttttgcctcgcgtccaattcagtcccattttattttaatgcctcatgaaatgaggctaggtaatatataaacaaacttcaaaagaaaaatattgtaataaa

SEQ ID NO: 65367 - DNA, 278 bp, Heterodera glycines
  Genomic contig location: Contig_ID=SeqID_7602; Location=1224..1501; Strand=+
  SCN-specific regions: Sequence locations=1-30,52-278
atgtcaaaaccaatacgcatgcgtattaatccatcatggagaaatctgagagaaagattaactcaaataagaccggtggttgaagctcaagagataacaccggaagaaatcgaattattaagaaaatcacttgtaaaacttaaacgttcagtgaattttattgatgaaagaattgaagaatggcgaaattacatggctaatgttcaagccgcacaaagagccgaagaagaaggcctttttgacaatctaactaataatggacgccacataaccgaatg

SEQ ID NO: 65368 - DNA, 720 bp, Heterodera glycines
  Genomic contig location: Contig_ID=SeqID_7602; Location=45..764; Strand=+
  SCN-specific regions: Sequence locations=1-115,137-242,291-508,530 -562,586-720
gccagacagtccaaagtatgattccccaattttagccggttcatctggcagtccgaaaaaaggttataaattgcaaatttttactccaataaattaagttgcattaaaattgatgaacaaaaaacgtaattaattattaaataaaacgtttattttgaatgattcaaataatgaaaatgtgttattaatcattttatttttcgccttttaggaaaatcgccacatgccgatccgaaaaaaggttataaaaaaaaattcataattaatttttcttttaaaatataaaataagcaatttttgcttgaatgaaataaaaagtaccatttaacaaattcataataaaatatcgaaaacaataattttagcccagaataaaagtcccatttaaaaaaattcataattatgcaccctaattaattgtaattaagctgcttcacaccttgtgccagtaacaccagggaaagtatgatgagcaaggtaaccaacagaaccatgctaccggttgccaaattttgtaatcattagccttaaaatggtgaagaaactgtgtggaacgatgatgccaaccatgaacaaacccaaagctgttgtagtagatgtagaaaaaaaactgtggtatcatcacgctattattgttgtgtaaaaaacgatccgtttttacctcttttcgggaaaaaaaactgcaaaaaattcacaaaaaaaaaaatctcacattgtgca

SEQ ID NO: 65369 - DNA, 747 bp, Heterodera glycines
  Genomic contig location: Contig_ID=SeqID_35912; Location=828..1574; Strand=-
  SCN-specific regions: Sequence locations=1-369,419-747
aataatctcctaaagaaggatagtgaggcagcactaagcggtgaaattgttggcgatgaacgggaaactgaaaatattgttcgtactttaattaccatcatcgattcatttgaagaaaatggtattcctctgaaattgatatattttctaaaaaaatttaagaattcttcgcgcaaggactttaccgattgagcgggtctttgactacgcaacaaaatgcacttaatattatcgaaaatgccaagggacgggaattggtttgtttttttatttttggagctctcagcaaattacatacaattatgttagctaacaataagactatgctctcaaatcctcacaaaatctcattataaaaagattgtcaagattttaaaaatttattttcaaaaatgactaaatttaaagattaaaaaaagattgtttaatacttgactttggtctttaatgattttaaaaatcaattgaccaagtaacggaaaacgaaactttaaacgaaagcgagaaaaaatgtcaaaaaaggacgaaacacaatttcgtacattcctggctccaatccgaatatttcagaaactttacttcatttacgagttgaatgccacggataaggcgtcttgcattaaaactcttttgcgtaaaatgcccgacactcttttcccacactgtcaacgtgttgctctgctcgacctttctgggtttgtgtttgttgcatttggtttgggcgccatgttatttttgctgaattag

SEQ ID NO: 65370 - DNA, 385 bp, Heterodera glycines
  Genomic contig location: Contig_ID=SeqID_35914; Location=441..825; Strand=-
  SCN-specific regions: Sequence locations=1-10,33-137,159-385
catttggtatattattatgtcaaatttacaaaattctcctgcttattgtgtgcttgtgaatgaccaaagggatggcgtgttgcgcgagataattgaccatcttggtcttttggaaagtggcgggcttggagcccagcaaaagaaaattggttccgaaactttgccatgccacacgctccacttggacacaaagtattacacatgcgatgttcctctgctcagttgtcactcatttgtgcgtttcaaatcaatttgtgcagctgaacgacgaagcaatttgtcagtgttcgctgtgctcttttgtgtcactcggcaacagttgacagatgactttctggcaacggtctcaaaatactcggccagtttggagaaggcggaaatgaag

SEQ ID NO: 65371 - DNA, 663 bp, Heterodera glycines
  Genomic contig location: Contig_ID=SeqID_35916; Location=185..847; Strand=+
  SCN-specific regions: Sequence locations=1-260,287-307,332-598,647-663
atgccaattgaatcatttgaattggtgaacgaacggacgaaggaaaagctgacactgaaacagaatatcgatgaattcgacgtaaatgtgtgtaattggttgttgcaacggtgcccaattggagagacggcgacggcgccagcaattaaatggggagacagcttaaatccgagtgccaatttgaaccatatcagatttgttctgtggagtttcgataaatccattgggtgagcagcagcaatagcatttgaattttatcgaaaaataaaatatttaattaattttaggccattgtcgccactagcggaagaagataaagaagaagataaagcggatcaaagcaacaaaaatgtcgtctaaaatgtacggaaatgatttcgataattatatttgagaaatgatcgatctcaatttgttgtgcttaatctcagaaaaatcgattcagaaggcaagataaagtatttcgtgcatttgaaccggttttggtgcatatttagaatttttcgaaaattgaattttcgaatttttgttcgagtccgggtcaggggttcgaaatgggccgaaatagatataagaatcgaattcttcgacccagaaaacccataaaacaactttatttcgaaaaaattttttgaaaattttctttatatcattgaaaaccta

SEQ ID NO: 65372 - DNA, 375 bp, Heterodera glycines
  Genomic contig location: Contig_ID=SeqID_35917; Location=102..476; Strand=-
  SCN-specific regions: Sequence locations=1-375
atgagcacagagaacaaaagcagtgacaaaaccgaatcgaatggaccaaaagtgcttagaattcttgagattgtaaaaaatgcacaacaaaagcatgggcttagacacgaaaattatcaacgttacaggtaacaattgagaagtatccaattctcgaaattggccgcgccggcccggtttttgggcgttaactcctttcatagttttacaaaatgaacaacatttagggctatcggatataccaaattggttcgatttgtacaactaatgaaacgagttatcgcctcgggtcggcaccctgttggtcggcgctcttttgtccctcaccgcccatgctttatgatggcagcacttcggacgaaaaaagaaacctaa

SEQ ID NO: 65373 - DNA, 559 bp, Heterodera glycines
  Genomic contig location: Contig_ID=SeqID_35919; Location=1028..1586; Strand=+
  SCN-specific regions: Sequence locations=1-559
atgaagttttggttgagccccgcttccgttattctcgggtccttggcaatttggtcagggtacgttcatttgttcgtccagattcgccaatttcactcaatttctacttaattttaggctctcgatgttgattcggcttctgcgtttgctatccatgacaagttcttggctgtcggcttccaatcggggcgcatttgtttctacgatcacatgggccacgaaacattgcattcggtgggaacaatcgtaaaaatacactcattcccattgctttatgtttttagtcgtcccgttaccacaaatgtgccgtctcctccatttccattgatcgacctggcaattattttatcagctgtgccaatgatttcaccgttaacattttcggcattggttcctccgagtttaaccaggtcatcgtgccaacaaacattcaaccattcaaatgttgttatatttcagcgcctttttcttccctattcggccaaagtggtcgaaatcgcctccgatttctctcgacttggttccaatcaccggtttttggtcggttctcgcgatttga

SEQ ID NO: 65374 - DNA, 969 bp, Heterodera glycines
  Genomic contig location: Contig_ID=SeqID_977; Location=1515..2483; Strand=+
  SCN-specific regions: Sequence locations=1-257,279-427,449-591,614 -637,659-969
atgccgaccatggaaatggaagtcaaagcggcggccattaaaagcacgaaaaagggaaagcttcttcaggtgcagtcattggactaacttattcgaaataaaaaatgatttttatagttattctcctcaaccgagtccgataaacgagcattgcttctttcggctgaaagtgagacggaattgcaattttggctcttctcaattgaacgagcattggcatggaataacagaggtggaaaaacgcttttcattgtccattttccaaatatttccaatttaagagatgatgcttgctcctgaagaggataatttgtcgttgaattcgtcgggccgtgacaattcctttccgccgtgcctttcctcactaaacgattcggaaagtctggcgagcgaagacagtggaggcagtgagtgttaatggataacgtttgccttgtttttagttcctacctctttttttaggtcgtgaattttccacggctttctggcgaagtcgaaatgcggcagccaaagctttgcaaccgccaattgtggagcggcgcaatattttttcgcttttttgggacatggaagtgtgatttgataaaaaatctttttattttaaatcatttttgtaaaagaaaaatttagcctttgccagaaggggagggagaaaagagtacgttgggtgaacaactgagtgaaacagaacagtgcaacgtggagcgaatatcaccaattccgagcagttcagcgacgacgactagtttggtgttacggccaaattttggtggcaaaagaacgacgtcccatgagccatcctcttttgatgaggaaacaaagggacaacttgcagtcagagaggacagccaatgcttggagccatcgaaatctgaatttgcgggtgaaaagccggccattctgttcacggctcagcttagacaattggacattcgaattcgtatggccggaaaagaacacgccgaacag

SEQ ID NO: 65375 - DNA, 3672 bp, Heterodera glycines
  Genomic contig location: Contig_ID=SeqID_978; Location=613..4284; Strand=+
  SCN-specific regions: Sequence locations=1-242,269-1264,1286 -1395,1417-1473,1496-1599,1622-2138,2161-2275,2298-2816,2838 -3015,3055-3112,3136-3206,3228-3672
atcgagcctttcttcgcccgtttgtttctcttcgattccagccttggtgtccgtgtatcggaggaattccatgtcgcttttccgtcacttcactacgatatgcttcaacaaaatggacatgccaaccttgttaaattcgccaactctgctccctcctcttcctttgcacttaacggtgttttggccactgagaaagtcaatggagtcagcttggaacagattcggaatgccaataaagtgatattaatttgtaattatttttacattttggcattgaaatgttcagcttatttgctcaatacacaaccctcgtgctgatttgtttttggtcgttttggtggagcgaatattgtcggacgtgtcagccgacatttacatgaaggctaataatgcaactgacaataaatattcgtctaaaattcaaaaatcgctgtccgcatcaattccgaaacttggccatcttcgaacgttgttcgcatggaccgcgaggcaatttattataaattttttgattttcttggttctttctctaattttaggcctgtctttccgtctttgtgctcaggcagtgtctttgcttctcaacagttggcgatgagcagcaccaacaattgtggtagcctttgcgatggctctaagaagtcctcgttggccacgtgttcgctgtacaaatgcgacagcggtcgactcactgacggcgatttacagaaattgttgatagaaatgcaaaaggccgacaaattggccaaattggtggtcttcccaagcgcctctttggttctcgaaacagacgtcacttccgtcctctgcgaatttccaagtcgtcccaacttacaataatttttgttgcttattcaattggtttaagtgcgtatttcgccctcttttttgccacttcgtccctggaaatgcattccgacttcgcctgataaaccgtccgctttgccttcgtctgagctccaatcatttcttgaccaatcgctttgttctgaaccacaccgtggccgtgttaaccttctctatgtaacttttgtcattttcagaataattatttatgtggaacaatcattgcttaaggtgtacccactttcgttgaattattcaacccaaaagacattctcccgcgcccgcaacatttcctgcacagtacattatgtgccttcgtctctcgtcagaacgacgcaatttgctcacggaagggtcccttgccatgctaacattttccaccgtacacatccaaacggaccttttgttgactcatttgtttgtggtgtccaataccatgagcaaagtccgcaatttaacgcggaagtaaaaatggatctgccggtggcgttgggagaggacgaccatattctgttcacatttcatcatgtttcaatttcgaatgccatcaccaacaaaaataaacctttcactgaggtgggtgggtatttttggatatcgtcaagagtatttttcgctgtcattattatatgccgtatttatagcacaacattgagactccggtgggttatgcatggcttccgatggtcaaaacggattctcgtggccttcctcacttcgtcatgtctgacaaaagtcaggagtttgaacttccagtaactgccaacttgtcttcaaaatactacgaatttaagccattgtcctcttctggcacgagagaggtgagtcatttaacaaatatttgtttcaatttataaccgacaggtgtcccccaattttgatctcaaatttgttgaatatggtcgtcctctattccgcgttcgacttcgactcgtttcgtcagtgttcaccaccgatgaacgccttcaaaacttttttcaattgtgtcacctgatttatccgaacataacccagtccaaccggaaccctttgacgcaactacccaattcttcatcgaatcgtaacttcaaacattcatccaatatgaatttctatgccaacaacgcctccaaaaatggatgctctgcttctgatatccaagacgacagtttgtccccaccgcattttgctattgaacgtgatttggttgaatcaattgaggtagcttcatactttcttacaattatatattcggatagaaatatctcctagttttcaatttagagtgatgatacaaaaaagtttctttgtttagaaactgtcatcaattgaccttgaccagctgattcctttcttggcggttatcttcgaccgtctttttaatttacttaccttttcaaaggccgaagacgtaatgcttagttctttgaagtgggccctaataatttgaaattttcatggaaataaataaatttcagtgccattatttatttggctgatcaactgtttatgcatcgaaaatcgaagagagaacttttacgaaattatgtcctattgttcttcaagtgccaaggtccgcaacgcaaatgcgatgccgacggtgaagaatcgacccatggcgcaatttgcaaatgcattcctctgatggtatacactgaaaagcgagtgagaaaataataattgtttgtcaattttcagatccacagagcacaaagcagcaaagatgggacgataagcatcacaaaattgcttcgtcagctgtggtttttgttggattgtgcggccaaatcgatggcacattggctcatcattcataatttgttgaaagtgccgaggcggaaccgatttcccaccgatttgtatttttcgctggaagagctctttcacacaatcacggaacgaatcattttcatgcaaagggagtgcccccgtgaaagtcggatggccaataatgcacttggcaactttttaaaggtgcaagcaaaacagagaaaagggaaaattcctttggcaataaattgcttaccgtttcatttcagcactgtttaagtttgatggacagataccaaataatgaaggaactgtatacagtggtcaagaaaatggacacaatcgaaaccagggtaagccaagttggaaaggattaaccaattttaaaaggttttaagtcgtttcgtgtttacaaattcgaactgcttcaaattttggctggtcatgaacattggctcccgctttgcttgccattgttgactgacaaatttggcattatattgcgtggagatagctttcgggtggaaggttttctaaaaatgacgaatgcgttaggctcatttaatgacaaattaaggctcctcttcgacccaaacgcaacagcaaacgacgaagcacaatggggggaccagtttattggccaaactgttctctcaaatcttttcaccatttcacggaataatttcagaatcgaatgaagtggagaaatgtgagaacaaacataactctgtttaaagtaattgtttaatcatttacagtttcatcatattccgagcatttctacttgagcaaaacctattgctccgtgcactttcccatcggacttcttctccaagaattgtcgacttctctgcgcgactcgagagactatcgtcgtaaagtgattcagttgctacgcaatttgcttgccaaacacagccaggacgaacgctatggcgacacggtattacttacaaataaaaaaaattattcactgaaagaagtttgaaattctcttttttaagtcagcccgaaatcgaattgcgattttgaccatgccattgttgaggatcgcaattgaaaacatcaaagaaattg

SEQ ID NO: 65376 - DNA, 2434 bp, Heterodera glycines
  Genomic contig location: Contig_ID=SeqID_979; Location=15..2448; Strand=+
  SCN-specific regions: Sequence locations=1-6,28-218,277-607,629 -1153,1179-1386,1409-1668,1690-2193,2228-2434
atggtggaagcattgaacaaagcgaaagccaatcctttcagcaatggctatgtttggacgaatggcaccattaacgcaaataataccggcaaaagtaacaacgagcaacaacaacgctcttcggacaaattcaatcgggccaaacgggagcactcgttacgagttgtactagcaggagagaatggacaaggtccttcccaaaaagaggaattactttgaattattagttaaattatttggattaaatatcataattttaatcattttaataaaatacatcgaataaacgccaaatctgaatggacaacgccaactatttttgattttaatttttacataatttcttatttcttaagaacgaagttcgcgacttgatgctttgcgtcctttacacgctgaacattcttccgaagaaaatattagcagccttttggaatgtccaagaagccattcagccaaccaaaacaatgccaagttgcgacgattcggtcacggaattgcctaagcaaccccaacaaaatgtccttgtcgactttgtccgtattttggaactttcgcttttgctgtttcgctacagagggcgaacgcaccacttaatgttacaagcaaaaaggtaaatatgacataattcgacagaattttcaaactttatttaaagaaacaaagcgacaaacccgaacaaaacgcccgaacttctgctgaagttcgatgggtcgaattcgtacgtaatgagcagcaaattttccacactgactgatataaattttggaggtaagcacttaaatttaatcatttaattctttgccagtagaaagtttcgactcgagaggagtggtggacgaagaaggcaaaggcggcgaggcgacaagttttttgatggactgtaatttggcgcaagaagtcgcgctgattgtgttggagactatccaaacaatagccaaccaaattgccgtatttttttgccattttcaaatttaccctttcattgttcaattcaggcaaagacgcgttacacctccaccagcagtttggatgtcatttttgttcgtcttcttcacttacagctcgaattgctcaacgaatattggcccgaaactgtccgacttcacactctctctgcgctcgctgtgtttgtcaatttggttggtcctcctaatttattttaataaaaaattaaacataccttttttggttccgtacagttttccgcccatttccttaactctggtccattggattgtctgtccactttgatcaaagcgctgcttctccagttgaatagccgtatcgtccgtattcaacatgcaactgccgctttgttacatttaatccttcggtccggatacgatctcgctttaaattcttccgtttgtatgtttttccttattagtatttttaattaaatatgaatttaatgacaaattattcgttttttagccaaattcccctccgacttctcttccatgtccgctcctgatggatcgaagaattcctcgctcactgaacgactcggccgacccggggctcaaatcgcgccggtgttggctcgtcttctgagcgaaaaggccgttttcttgaatagtttccgtttcgagcgaggtctgtccgctttggaatcgcttattggctgtgggtcggcgacaaaaagcggtgccaaaggtgcggcttcttctgcacttgtgctcacctctctctttgacaaggctgtcttggtactactgcttaatgcctaacgcgaacattacaaacaaatgattatgctaattcttacaattaggaattggtgaaacaacttcgtggtgtgctcgaggcaacgcaggcaatttcggacacgattaatgacccggtcagcggtgatcatctttctttttgttttcatttatttcttcagattcaattggccgaccttcatatccaattggcaaatagtttccgtggttcggctgcacttcgggcagaatttttcgacgcattggctgcacaacacattgccggaggttttattatgcgccgacatttcatatttctcactccgtcgtctcctctctcttttagcttggtactcggaagcagctgtgtgtcaagcccattcgctggtgatcatcggaaaggaactgcaaagtcggggactgtttcgacccgattggacactgttgagtgtgctcagtgagagaattactgctactgagggggtcaacgagagcggtctgatgagcagcactcagcaaggcggattcacattggtacaatacctatttggtactgttttggttgaacggacagagaaactcatttcaggaggaatttacccgaaaagttgaagcgttagtccgcgttttattactttccgaacggtatgaagccgttggaccaatatgtcggttggccattcccatctttgagcagaacaatgattttaaagttcaacgtcatg

SEQ ID NO: 65377 - DNA, 683 bp, Heterodera glycines
  Genomic contig location: Contig_ID=SeqID_980; Location=97..779; Strand=+
  SCN-specific regions: Sequence locations=1-683
atgccaacaaagggtggcagagagaaggaacaacgagtcgcttcaatgaacaatggcagagcaagcgagcgaccgatggacgaattgaaagaggacaatgaccctatgggttacaacctgcacaccaacatcagcacgttcattcaagaagagcgactggtggaccatgaagtgcccgaaaatgcgcctgaattggcaaggactgcactccgtcgactgactttgactggtctgactcacagcagccgaaaaacatattcctaacctttttaagtgggaaactctttccctgacacgcgccgacgccaaaggattgtgaagactgaagaagctgtgcttaatccgttggaattggcctgtgaatgtctgctcttcaaaactgctcaaattcggcacattctttcggcagcggaaatcccccgagggttccattgtcacatcggcgctactgtggacaaaaatgcactgaaaagactggacttgaagaagttgcaactgtttttgcagggttcagtcagtccatctgtcagtttgttttagtttttaatacttttaaaatttcattttcccatttttaggtcaatgctggattgttggcttatgccgaaacgtttaccgcctcagcccaaagacatcgctatggaaaagacggcatttgtcgattggcaaccgctctgaagtga

SEQ ID NO: 65378 - DNA, 452 bp, Heterodera glycines
  Genomic contig location: Contig_ID=SeqID_980; Location=1836..2287; Strand=-
  SCN-specific regions: Sequence locations=1-364,386-452
  Gene Ontology: Mol. function=structural constituent of bone; Cellular component=collagen type I; Biological process=reproduction
ttgttgaaaagtgtttttgtttaacacgaccagaagtgtcatagcggcccatcaggccaacccgttcaacctggacagcccggccagggcggtggagcccctcctcccggccctcctggccccggtggtcctcctggaccgcccggtccccccggaggcgacggacagcccggcggagatggacaagccggcacttctggcggagatggcaaatagtaaaacggggagaggggaggcgaacaaaagcatcatccccactattatttgtcagttgcccttgtcctaaccgcggctcgtctggcggtggcgttccaagcgaaagcggaggagtaagcgggggaggcggaggcacaagcggcggctacgggccgggcggaggaccgagcggagggagtgccgcggcggaagtgccacccagcggtggcggcgccactgagagcggcggcgcctcc

SEQ ID NO: 65379 - DNA, 831 bp, Heterodera glycines
  Genomic contig location: Contig_ID=SeqID_981; Location=5..835; Strand=-
  SCN-specific regions: Sequence locations=1-33,55-200,336-438,460-831
  Gene Ontology: Mol. function=structural constituent of cuticle; Cellular component=extracellular; Biological process=cuticle biosynthesis (sensu Nematoda)
atgaatattttgctctttgaggacatcaacaatatgtacgacgagatcatcgaggatttgggcgagttcaaagtgctcgccaacgacgcctggtcccaaatgcaggcggtccaagtccaaatggtcggtggcaaagcacaagccgcggcatttggccgtgacttcgccgagatgatccgtgaacgacgctcttacgctgccgggggaagcggcggcggcggaggcggcgggagcggatacgcgagcgggggaagctcgggaggaggtggcgggagcggatacgcaagcggaggcggcggagcgaaaaaaggaggaggtggcggcggtggtggagggtacgcccgagctggaacttcgggagggggcgctaccgcatgcccggccggtccacctggcccgcctggacagcccggagctgctggaccacccgggtcaccgggtcaaccaggaggacctggagagaacggaggaccaggaactccatgcccagccggcggctcatgtcctgcttgccctggcggaccgcctgggccagcgggtccgcctggaggttctggaccgcccggatcggacggagaaccaggacagaacggcaatggcggaggtggtggacaaccaggtcaattggatggcatggttgtgttaaataattgtaaaatataaattatgcaggcccaccaggtccgcccggagattcgggaccgcccggacccccagggggttccggaccacccggtccgcccggcaacccgggcacgtgcaccggaggcggcggtggagcagtttcgggaggaagtggaggtcaagtcggatatggaggaggtcgtcttc

SEQ ID NO: 65380 - DNA, 646 bp, Heterodera glycines
  Genomic contig location: Contig_ID=SeqID_981; Location=1761..2406; Strand=-
  SCN-specific regions: Sequence locations=1-222,244-646
atgtcctccaaattgtcttccaaatgggtcgtttttggctcgtgtctgctgtttttcgcctcgggctgtgttctgtacgtcttggtaatgacgcggcattttgtcgacgacgaaatcgaaatggccgacgaaggacaaaaagtcgacgaaggcacagccaaatgggagctgccaaatgagtcaaaacaaaacggaaatttggtcggaggcgatgaacagcaaaaagatcagcagaaagaaaagcaacaatcaaaagtgttgctgttggaacagtccatgccgaatggaaatgttaggggcgggggagagaccggggggggggggggagacggatggttgcccatggccatgccgttgatggattgttgatcccgagacagttcagtctcgcctttgtcttattggaggtcgtttctttctacaaaatgcttttgtcttaggaagtttcaagcctggacccgcgcgttcactacgaaaagagtccggacggacggatgaaagcgacgatggacatcactttgcactaccaacgccaaaaggtggtgtcggcggcgcaaggtcaatgaaaggggaaaaagaggagtttggaaggatgaagaagagaagagtttggaaggatgaagaagagaagagtttggaaggatga

SEQ ID NO: 65381 - DNA, 1161 bp, Heterodera glycines
  Genomic contig location: Contig_ID=SeqID_981; Location=2759..3919; Strand=-
  SCN-specific regions: Sequence locations=1-629,651-961,1016-1161
atggaatcggcattttgcaagaaaaaatgcgcaagtggtaataaatgaaaaaacaatttaatttcgaataaaatttgttgtgcatttcggacgatttgatcgttctcgaattggatttggacggcgaattgggcggtgccgtgcccgcccccttggccaatcacattgtgagagagtgcaatggccaacccatggcccaactgtgcctttgttcagtgccttcctttcatgcacggtttccaagacgacttttattggagacaatcgatgcgtgccaatcggactgaggcactccgagtgacgggatggggaagcgcacgtgggaatttaattgggcaattaagggcaattaacgatattcagcggacaaacagaaacccagccaatacggaaaggcctatccgaagctgcaaatgttgaaagtgccgaacatttggaggcacgaaaaatgcgcacggaaaagggccaaactgtcggaggaggacggactgagcctttcggaggacaaactgtgcacggtggaagagaaaagcagggacacgtgtctggtgggagacaaatggactcaaaacaagagccgaaaggcgggggggggggggataaagggagataaaaggggataaattaaaggaagggggcaattaacaggggaagggggattaattaaaaaagaattaaatgttttgcttcccattctcagggggacagtggcgggggtttggtcggcaattttgaggacggaaaagggcgccggcggtggtttattttgggcgttctttcgtcgggtggcgactgtttgcagctccaacaaggcttagagaagcctctgatgcaggcaaaagaggcgaaaatggcaaatggtggtcatttgattgttaaggaattcacaaatgtcactttccacaaaaatgccatcgaaaagtttgtgaacggaaatttaaatgaagagaatccgacgacggaagaaacgaaaaaagaaaaagtcaaagaagacgaggaggacgaagcagaggaaatgtggggcgattgtcaatgaaaaaaggacggagagagggaccaatgccaatccaatgccaaagacaaagaaatgccaaaatgcgcgaaatttctctactcgatcgatctgctttcgtaaagacggcatccccagaaaaaaataaa

SEQ ID NO: 65382 - DNA, 597 bp, Heterodera glycines
  Genomic contig location: Contig_ID=SeqID_35922; Location=225..821; Strand=-
  SCN-specific regions: Sequence locations=1-9,31-140,162-262,285 -301,323-389,419-597
atggtgggatggatgacattcatcaccactaaaaatcccagtgatccgttcgctttatttgccttttattgtcaagaaatctcgaaaataggacgtaatttgggactgattttgtcaattgttatggcacataaaaagcaaatatttgtttggccaaaaagtgaaagtatttaaagagctccaaaatgttttttcggcacattcaaaaaatattcattctgcaaaaagtcaatcattcgctgcttatcattggaaatggcttcttcttcaaccatcaaaatgtaatttgtcactcatttccaattttaaatttaatttttaagcttttccctttttctgcttgtcctttgcattggcttggccgttgaacagtcccaagcttatgtgagaaattttaaaataatttaaatttatatttcgttaagtggggtggctacgcatatgcctatccctacggcggatggtacggcaaaaggcaagccgggttcggcccatccgcaagtgttggcacttttggcggtgacggagacggaaatgccaacggaggaagggcaccgccgccaacaaattgataaagggaaagtgataaaggaataa

SEQ ID NO: 65383 - DNA, 643 bp, Heterodera glycines
  Genomic contig location: Contig_ID=SeqID_35924; Location=44..686; Strand=-
  SCN-specific regions: Sequence locations=1-643
  Gene Ontology: Cellular component=mitochondrion; Biological process =polar body extrusion after meiotic divisions
atggccattttggagccgcgtccggtgtggttcgtctactcgggcatgggcagccaatgggtcggcatgggacggcagctgatgcgcattccgctgtttgatcaatcgctgcgcgagtcgtcgcagacattggccgagtttggcgaggacgtttatggaatgttgacgaacgcggagccgaagcagtacgagaataacacgctgaactgcatgttggcaatcacgtccattcaggtgagcgcccgggaaaagcatggatttaattgcatttcaaattggaaggcattagcaatataattgagcgaggagagtgccattcacaaactctctaaaatgccgtttttcatagattgctttgactgatttgctgttcgctttgggagtgactcccgacggaatcgttggccattccaccggagaaatgggctgcggttatgcggacggagcactgacacgcgcgcagacgatgatgttggcatactatcgcggaaaaacgataatggcacacaaagaacgaatgcgaggagcaatggccgcggttggactcagctgggaagaggcagtcaaacgctgcccagacggagtggtcgccgcttgtcacaacggtgccgactccgtaaccgtttcgggggacacggaaaag

SEQ ID NO: 65384 - DNA, 410 bp, Heterodera glycines
  Genomic contig location: Contig_ID=SeqID_35925; Location=73..482; Strand=+
  SCN-specific regions: Sequence locations=1-410
ggcaccgcgtcgcagaaatcggccgccggaggaactacgtcacagaaatcggcagcggcacctgctggaggagcgtcggcgctgggcaccgtgtcgcagaaatcggccgccggaggaaccgcgtcgcagaagtcagccgctgggggaaccgtgtcgcagaaatcggcagctggaggagccgcgtcccagaaggcctgagcaaccaccggacggcataagaacaagacgctctacaacccgcttcaatgatatttatcgacagtgatcagtaatgatgtttaaaagaccccgtattgttcccccacatacctatgcctaattgctctattgtctgtgatcacgtatatcatttgtaaaaccgttgtgtgatcattatttgtgtatatgtatgtatattgtatgtatgtgtt

SEQ ID NO: 65385 - DNA, 482 bp, Heterodera glycines
  Genomic contig location: Contig_ID=SeqID_35929; Location=137..618; Strand=+
  SCN-specific regions: Sequence locations=1-482
atggacgccgacatcattgagttgaccgggcgagacaacgacgagcactttctgcctcaccacgccgtcatcaatcccaagaaactccgaatcgtcattgacgccagtgctcatgccaagggcactccaagccttaacgactgtctccaccgcgggcccgtactgcttcccgatctttgcgggatcctcattcgcttccgatcggcaacgatgcctgttctggctgacgtccaaggggctttccacgccatcgaagtcgagccggacgacagacgcttctgcaaaatgctctggctgaaagacccctcccggcccgtctcaggcgataatctcctcatttatcgctacaaacggctcgttttcggcgcaacttgctcccctttcatcctcgctgccgttcttctccaccacttcgataggcacgcccacccattcgccaaggaattggccgcgaatatgtacgtcgacaacctcctcatcga

SEQ ID NO: 65386 - DNA, 526 bp, Heterodera glycines
  Genomic contig location: Contig_ID=SeqID_35930; Location=146..671; Strand=+
  SCN-specific regions: Sequence locations=1-121,165-384,406-526
atgacagcagcagatcatccgcaactattttcaacggaattggtggcattgaagcgaatgacggcacttccagcgaagcgacaaaccgccagcagcagaacaacgacgagtgatggaacacagagaaagagagggaggagagagagagtgagaaagacagagagggcgaccgtattcaatgtgaaatgcatactgtaactttgtgtattcaaaaacaataccggagaagcataccgtacaacacaattaatcgagaattttttaatttgggcatttttaaaaaataaccaaaagtctaaagggaccaaaacattatacttctattgcattctttggtttaattgtatatggtattcttataatatcttactgtctcatatattttttaattaatttccctttttacatcacatttcttccatttagacggtgcataatatgtgaatgtgttacagtgaattgaaaacttaccgtaatttacaaaaatgttttttattgttccattttttcttatatttcctcaaca

SEQ ID NO: 65387 - DNA, 1050 bp, Heterodera glycines
  Genomic contig location: Contig_ID=SeqID_7605; Location=1436..2485; Strand=-
  SCN-specific regions: Sequence locations=1-839,861-1050
  Gene Ontology: Mol. function=glucokinase activity; Cellular component= soluble fraction; Biological process=cell glucose homeostasis
atgctgcgcgccattggtgagttgtcatttgatcactttagccattcaacatcccattttaggcatttcgaactcatcggccgccgactgtgcaaatgtcgcctacatcagctcgttgattggcacgcgcgccgctcatctctgcgcctgtgggcttgccgccatcctcaaccgcatgcagaggccccgcgtgactatcggcgtcgacggctccgtgttccgcttccatccaaccttcaaattcaacctcgaccagaagatcaaggcgctgttggccgtcaaatgcgaagtgagttacatagtttctaatatcgtttcggaatgatatgaataaatctcctctaatttcagttcttcatggtgctcagcgaggacggaagtggacgaggcgcagcagtcgcagcagcggtcgcattgcggatgaatcgccttgtgggagcgtgaacagcctgtgacgatgccgtccgatgtcagatgtgtgaatcttaggccccataatgtcatatgtattgtaatgttaggcattttgtcccatgtctgtctgtatataaggttgaattcctaagcacaatgatgttccattattcacaatttgtatcaattgttcatttgtattgtgtggtgtgataaatgagaaaacatttatgtcgttgcaaagaagactggaaaattgattgcctatttcaatttcagaagttggtacttgtttagcgggtttttttttggggtgtactgtagtcaaccccccggaaaaaatgacataaatgatataacaatcgattcgtctcgacgagctatgcacgaaaaagtaagtctccagttgcggaaatgccaaaaaaccggtttttgaaccggtttaaaactcgaaaatttgagtgaaaaggggggctcctgaccttttaaaacgcccaaattcggacaaatttggtatcattcgaaagctcttgatgagctaagtctaaaaaacaaggtataaactcgaaccaatgccatctaagcactgggacaacttagtcccagagaaaatggacacttcagtaccaaaataaa

SEQ ID NO: 65388 - DNA, 219 bp, Heterodera glycines
  Genomic contig location: Contig_ID=SeqID_7605; Location=209..427; Strand=+
  SCN-specific regions: Sequence locations=1-219
acggacgattcactcagagcaccgatgagacgctcgagttccttgtacgacttctttgtatctcaacaacctccagttcattctcttgcgaaaaagaataacgaagccaaatactatgcgaggaattgggaattgtttccgagaagtttcgtttcgtcgtcttcgcatatgatatgcagaccaaaaggaaaagaaaaatatcatattttgccaaactaa

SEQ ID NO: 65389 - DNA, 263 bp, Heterodera glycines
  Genomic contig location: Contig_ID=SeqID_7605; Location=1388..1650; Strand=+
  SCN-specific regions: Sequence locations=1-238,260-263
ccgtcttcgtatgctcccttttgcgaaatttttccttttaaatggttatttattttggtactgaagtgtccattttctctgggactaagttgtcccagtgcttagatggcattggttcgagtttataccttgttttttagacttagctcatcaagagctttcgaatgataccaaatttgtccgaatttgggcgttttaaaaggtcaggagccccccttttcactcaaattttcgagttttaaaccggttcaaaaaccggtttt

SEQ ID NO: 65390 - DNA, 265 bp, Heterodera glycines
  Genomic contig location: Contig_ID=SeqID_7606; Location=1..265; Strand=+
  SCN-specific regions: Sequence locations=1-265
acagttttggcacggttcggaaaaataccttgtaatatttctttcatctttttagtttgtctgttgcgccgaatttgccaaatgtatctgcaattgaaagtgctgggaaaaacgcattttgggtgggtcgtgagaatggcacgatagagagggtattaattttggatttgaatgtttgggccaattagtatattcagtggacttctattaacgaagcgcatggcactggcgggagtgagtctttttccctcctttggtccctctc

SEQ ID NO: 65391 - DNA, 303 bp, Heterodera glycines
  Genomic contig location: Contig_ID=SeqID_35932; Location=566..868; Strand=+
  SCN-specific regions: Sequence locations=1-303
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgatgtataaaatttctcaaaaaaagagatagccatttttctgggatagagtataaatttaaaaatcccctcaaaataaaaggtctattgcgcaccgccctccctatcatg

SEQ ID NO: 65392 - DNA, 1517 bp, Heterodera glycines
  Genomic contig location: Contig_ID=SeqID_35933; Location=161..1677; Strand=-
  SCN-specific regions: Sequence locations=1-496,518-786,810-1108,1150 -1517
  Gene Ontology: Mol. function=ubiquitin-protein ligase activity; Cellular component=nucleus; Biological process=DNA replication initiation
tgcattcaatttttttagaatggcgacatttgcataacctttttgcacccaccggttgatgacccgcacagtggcgaggtaaagatttgcatctccgtcctttttttattggtttgcctttacggaagttcagtgtaatggcgtaattaattctaaaaactagaaaacaaagtcatgttactactttttggttgtatgcaagaacggtcctaaaaggggtagcgggatacgtagaaaaagaggtctatgcccccttcaagccgaattctgggaagcacgtaaatttttatcaacctccccccaaaaaattgcaaaaagaaaattgctcagtcacctttcccttttctcagatgccttccgagcgatggaatccaacacaaagtgtgcgcacagtgttgctgtctgtgatttcgctgctcaacgagccaaacacgtcatctccggccaacgtggacgcatcggtgatgtaccggaaatacaaaggtgaaatttcttcaaaaatgaaacaaatttttcttggacaccgatggctggaaaggtgtaatacgtccaaattacacacacgcacttatttcagaccacggggaccaggagtatgcgactattatcaggttcgttgttggatgtgttttcaaaaagggatgtgctgcacatcggttcgaaaaagagctctcgtctggtctcatgtgggagcagttcgccccccccccccccctctgggtgccttcctcaccgccgggtcagttcccctgtattgtttctccccaaaattaaaaaaaaaccccgaaattttaaaacgttttttaattatcccatccactgtatcttccggtcaaaatcatggtaccatttccaggtttataaatacaaaaaattgctaatttgtttgtttttttatctgaacgctgtgtgattaagaaaacaggtggaaaagtccaaagaggaggccaaaaaggacggcatcaaagtgccggaaaccatcgacgaatacgtggtgaaagcgaagccgagagtgcagggcaacgagtccaacgatgtgattgagctggacgaggattactacgactacgaggacgacgacaccggtgagggcgacagccgaataacttaaaaagcattttaaaacaaattattttctttttaattcagcgaaaggcttagtttacttttcggttttcaaattttttacccgtggttaccgtttcaatttgctggcttttttgtcaagaaaactggtaaattccctctggttttattaggggtcattcattgattatgcatatgtctttcattccagacaataccggacctcgaatctgagttttagcgaaggtttggattttccatcttaaaaaggaattccccactttcccctgattttgggcttgtcccaccccctaaatggtacaaatttctttaccaaaacttcaatttcaatcaaaaatgtgcctccataaaaccccatcccccattttcccccagcagatgaagacgctgaatacggcggcgaagaagag

SEQ ID NO: 65393 - DNA, 999 bp, Heterodera glycines
  Genomic contig location: Contig_ID=SeqID_35938; Location=121..1119; Strand=+
  SCN-specific regions: Sequence locations=1-35,59-118,140-406,446-999
atggcattttttaaagtttgtccaaaaaagcgctgaaaatttttaaaatttttttttacttgtgatatcttataaaaacttttctcagattctttttcttgaaagaattcaaagtttgaaaattttttaaagttttcggcggcgaaattttgggtgcatccgttttccatctgtccaaattagtaaattgtattttttttttcaggtccgtctctttcgtatacccaaattctgcggcctcctcaaaagtgcgctgcgctgaccgaaccaacgaattgtgtgactgcaccacatgaaattcatcgtcttcgatgaacactgtcgtcatcacaaggttttttttctcgtatttttgccctattaatgggtccgtatgccataaatattgtctttggccaaaatactcttttaaattaatttaaaagtaaaaaaaaaaactaaaaaacagttttatatttggtaccattcggtgcaataatgagtttaatcaagctgaagaaaattttaattcaaatagttaaaggctaaaaaaaatttatgggtaaacataattattgattttgaatttttgacatcgggaattgtacctctgatttcctactattttgtttttaatttaaaaaaactaatttagtaaatcttttgtcaaccgtcgtgatcgctatttgctgatcgaagacggttcactgttgaccgactttttcgtcgacctgttccgcattgttggcgacaatccttccggccggcggatgaacatgtcggatttcccgccgtggtaacaatttcgccgatacatccggagacaggtaaaaaaaaatttttcatattgtttgatacaaaacaatttttttttttggaaaaaaacgcagattttcaatacacttttttcaaaaaaatttcttttactttttttcacgtttccagcaaaaaggagacgacgacaatccaccggctggagttcacgctgatgaaaggctatttcaaactgttcgaccctag

SEQ ID NO: 65394 - DNA, 944 bp, Heterodera glycines
  Genomic contig location: Contig_ID=SeqID_7607; Location=496..1439; Strand=-
  SCN-specific regions: Sequence locations=1-881,903-944
atgaatttggataacaaactgttccgtcgtttgcgacaattcgtcccgtcaattctcaacgattgtccgttgttacgcgttgtctccttcagcgaatccaatcttttcaccgaatttccggccgatgacagtgccacggcatcggatggacaagcgatggcaaaatggcttttcactccacttccaaccaatgtgccaaaggtgttgagatgcccgttgaacaaagattatgtgaatttggcgtcaacaattgaagccttcaaatcggtgctttctaattgttttatttggcacttagtttctttgggtttcgctgatctgacaaaaaatgtttttttgcccaatccacttatttagatatggtatgattgttttaagaaaatgaaaaaaattgagttttcgattttttgttcgaaatatggtccgaggttcggaattggatcgcaatggatatcagaatcggattctcagtccctgaaaatccctaaaaaaataaataccattttaaagtgcactttggctttttgtgatgaccccaatatcattaatcattttttcacattttaggcttttgcctcggcttcatctcccgtcaatttcattgtcgtgctttggtttccgaaatcttttgctgcctccgtcatgctctttgatttggccaacgaattgactcacgaacaattggcattgaaaagaactgtctttaacacccgctttttgctaatccgttgtccaattgtgcgagacgcgaacaaatgggcgaaatgggaagaagaagcggctaattggctaatttattatcaatggaacagaattgacattgaaattaatgatgagaaaaatattggggacgggtcagtcagtgttgaatgcttattcaaaaatccaaatttatttatttttaggcttctcggcgcaactcccggcccaagtgatcagcagaa

SEQ ID NO: 65395 - DNA, 1742 bp, Heterodera glycines
  Genomic contig location: Contig_ID=SeqID_7608; Location=1192..2933; Strand=-
  SCN-specific regions: Sequence locations=1-331,361-381,423-620,645 -994,1016-1155,1215-1265,1287-1294,1331-1742
atggcaattgtccggcaaaaagacaaacggcggaacagcggggatcaattagcatcattagtgtcagcagcatcatgtgaaactgtgccgtgccgaaagcccatccctatcagcagaagtgccaattccgttcgtccaaaaaacgccggcggcgccgccagcagtcggctgcttctcctctcatttgcactttcactttttctcactttggcagatgcacgcaaaaacaatcaccactacaaagtaaagggagaatattacaatttttttaaattgattttttccaaaacatttttacaaaaatttgttctcagttccataaaaaatttggatatttttatatagataaatttttaatttcttgaccagtcagctgaaaagaaaaatttaaaaaaatttttttatttttctaatttttaatacttgaaaacttagaaaaagattttgatttttaaaattaagatatacataccagcaatgtttgcagacgccctaaaaaaaattgcaacaatcggaattccgacgactgaaaaaaaatttggcaatcggaaatcgtaattccgatccaaaaaaatgtcggaaattggaaattggcattacaacatttcactgatacataatcctttttcaattttaatttaatttccatttaccgagataattattaaccccgaagagatcaatgtccctgctgatccctaattagtctgtcaaattaattaatgaaaggtaacggctgcagaggacccggttgtggtacaccatgagaaaacagcggcatcacataaacaaagtacagccaaatcagctgcttcaccagcaccggaagcaaaggtactcacttggcgggacagcccattttcagtctcgaatttcggattcatttcagtctcgagcttcgagattaagcttcaatttaaaggattaacttaaaaatttttgatgattttgttggaattttctttcagtcaatacagtttttaaacttccattgaataagaaatgtgcaaaatgttaggcgcctcgggtgggaattgaacccactcatccacatttccgcattttaatcacacagccagcttcttccttacaattataaaatatgcaattaaaaaattttcgaaaaatttttctttgaagggacaacggaccgctcaacgacaacaacaacaacaacaacaacaccagcaacagcacaataagcagcagcaacagatcgattctgagttctccattgaggatgtggacgaggaacaaattgacgaaattcttcgggacactgccaaaaatttggttgtatttttctgtaagagagaatgaatgaatatgtataaatgatgagtgtgatcagtgatcgatcgcttttttagatgacggtcgtgcaaagtgtccccagtgtgggacagcgttgtccgaggtggaagagattgacgacgacatcgaggcgactgggtacattgaggtgcgcgaaccggatacggaaattaaaccaatgagaattggaatagatcgcatccgagtgatttggtcttttttttatccggcattttgggataatcctataactttttatgcaaaattctccccgacaaatgaattactcgccgacattttttttttaaatttctcccgccatccctgagaaattatgttactcatcaatcccaagacttttcttgctccaaggggtcggggaggggggagggaacctaaattaaattgtagaaatttattagaataaa

SEQ ID NO: 65396 - DNA, 546 bp, Heterodera glycines
  Genomic contig location: Contig_ID=SeqID_35942; Location=197..742; Strand=+
  SCN-specific regions: Sequence locations=1-546
atgggaggggggggagctacgccattctttgtccctccacgtgaaaactcgccacaaaacaacgcagggcaaccatgggcgacccccttacctggagaaggtccctcgcatccaaactctccgtacaaccaaccaggacaaaacggatacttccctcctgctccaaatgccatgcccgcagaaccagggtatccaaactactatggtccatcgccgtccaacgcaggtagttcatccggctacggcgcaccaaactctccaccgccattccaacaacaaggagacgcaaagaatccgtacaactatgagcccccaccaccaacgtcgccagcaccgacgtcggcttacatggcagccacgtccgaagtctcgtatacccaaatgtccgacgtgacccagtcgagtagtgggtacaagccgcccatcgacacaaaggcttcacccttttccaagggtgcagtgaacccaaacgccacgcctgtccatcgtgcggatggtccaagtggtggcgcccaggctccgccacaatacgatgcaccattctga

SEQ ID NO: 65397 - DNA, 152 bp, Heterodera glycines
  Genomic contig location: Contig_ID=SeqID_35944; Location=748..899; Strand=+
  SCN-specific regions: Sequence locations=1-152
tgtcgaattggacgacgaagtgcggacactcgacgatcggttgctgtgcatgcgcgtggaaatggggcagaagaggcggaaagtgcatttgaacgcgtgcataaacggcgaatggggccgcgaggcactcatcaaacacaaatggcgaaacg

SEQ ID NO: 65398 - DNA, 803 bp, Heterodera glycines
  Genomic contig location: Contig_ID=SeqID_35945; Location=153..955; Strand=+
  SCN-specific regions: Sequence locations=1-56,98-273,295-660,682-803
atgccaaattgtgtgaaattcgatactcaaagagttttggaagttagttaattctcatattttaaattaaaaaaattaatagtaaatagtaataattctactttcagctattgaatttttgtgttcgaaagaattcgaatgggattgagcagttcgacgtcttttatctgcaccttttgctgaacagcgaaataaattgcataatgaacaccgaaattggacttatcaaaaaggtttgtggatgttcccgaattggctcaccattgaatgaatttgctcctaaggaagcggctgccatcctcgattactgtatgctgcgaaatgcccgcaatttgcttgaaggagcctgtgtccgtctgcttgagggttggctttcggtgatgaatgttctgtccgtgcactgtcccttgcctttcatcgatgcccgtcgctttccctttgcaataaattcaagatttaccctataattcagaaacacaccaatgtcttctggtcgatgcgctttttcttctccgttcctattgcaattgcgtcgaaatgagttccgaattggcctcttctgttgcgttgtgcatttcgcgaactgtgcgggcaatttgtggcattttccatagaatccgcgaggtccagccaaatctttcgcccattcggcgttctctactgcccattctccatctcctacttcaaatcattgttcttcctggtaaaaccaaacattcatgattcaataattgtaaattcaggctacagcaaatcaatcgctttcaaaatggagctttattcaagttgtctacgtgttttag

SEQ ID NO: 65399 - DNA, 685 bp, Heterodera glycines
  Genomic contig location: Contig_ID=SeqID_35946; Location=47..731; Strand=-
  SCN-specific regions: Sequence locations=1-121,202-282,304-344,366 -435,467-519,541-575,598-685
atggacgaaataaataggaaaaatagggacaaggtcatcagcaaacaaaccatcagcagaagtggaaaggcaaagcattcattcgcaattcaattgtaacaaaaaaattaattcgttcgtcggagaaaaaaagggaagagaaaaaagagaaggaaaaaacttggaaaaagagacggaacggaaaaatgagaaaggaagggacattggcacaattcggaaaaagtgccaacatccgatggagctgttgcaaaaatgttgacaactgtgaatgagattaaagggttgacatttttcaaaagatgatctcttattaaatggattttataattcatttatttagaaggaattttataaatttttaacatgacctctcatttcatgaaaataattaattttaagaaactaaaaactcaagtaatttggagaaatcttttgaaattttaaaaatttatttttttaattttttgtgtcttttgagttttttcaaaaaatattacttgattttatattaatctatcgaaaatatttattttaataattgtaaagcacaaattctttcgtgaattttttttcaaaatttgaatattttttcaggacccggttgaccttgttgaaaaacttggacccggatccggcttttgtgggcccggaaacacccggacccgtgcaaattgctgttttctga

SEQ ID NO: 65400 - DNA, 222 bp, Heterodera glycines
  Genomic contig location: Contig_ID=SeqID_35948; Location=51..272; Strand=+
  SCN-specific regions: Sequence locations=1-182,221-222
aaattaaccaaagtgttagccgaagcaagcaaaggttagccaatttaacacttcttttttaatagctcaaataattttaaagggagtcactcaatcgcctcattattcggttcaaacaaaacggacaaaaagtgatcggtggctcgaaaactaaccaacgattgttactatcttttggcccctttttattttgtttttttttaaatattctatttttaaaca

SEQ ID NO: 65401 - DNA, 335 bp, Heterodera glycines
  Genomic contig location: Contig_ID=SeqID_7609; Location=53..387; Strand=-
  SCN-specific regions: Sequence locations=1-220,242-335
atggcaattaatggaatattaagcgaagaaaagaccaaacaaattatgcaagaaattggcacaattaagcagcaaaatgatgctaaattggaagcaattaaaaatgttgaattgcgcaaaaaaattcagcaaaaaaatcactcggaatttgaagcgcatttgataaatttgctattttcatttgctgttcgacttgaggcgttaataaatggcaaaaacgaagaaggaaacattgtggaagaaaatgggcaaaattcaaaggacaaaattcgtgcatttttggctgttttaaaatgccttactgtggttaaagagtggcgaaataacgaactcag

SEQ ID NO: 65402 - DNA, 706 bp, Heterodera glycines
  Genomic contig location: Contig_ID=SeqID_7609; Location=847..1552; Strand=+
  SCN-specific regions: Sequence locations=1-209,231-294,352-506,536-706
atgaaagaattaatagggtcatatttttatggtcatccaaaaaatgtaaggacatttaaatgcataaaaattgttcaaacttaaattaattcactccgtgcttgatacgaaaagatagcccaagctcaccacggttcaattttgactgttgtcgaaaaactttgagagagatgttaaaagtcgcacactttacaaataatgaattgatacagtagattttaatgatatgaaataaaaacccaagacaaaagcatgataatctttattaagaattaattgcaatactatattaccaaatttaaattaaatcactaaaatgtatatataaataaaataattaagataatatttgtcaagtgtaaattcttacgccttctaaggtttcaacaacggtagatgctgatctgaagaatagactgattaccaaaaggacttatctgacatcgttattgggtttgggaaaataccctggggcggcggaaaatcaaaacagaattaaatataccaaaaaattatttaattatttctttaaatagagttgacatcgttttcaatgagatgtcaatctcaaccagcactgtgttcatataatattgtattaaaagttaaatttttttgaattttaggccttccaataaaatattacgtcatctaaagtgtgatgaaaatactatattaaaaatacgaaaatccttaattatctata

SEQ ID NO: 65403 - DNA, 2933 bp, Heterodera glycines
  misc_feature (188)..(188): n is a, c, g, or t
  Genomic contig location: Contig_ID=SeqID_7610; Location=128..3060; Strand=-
  SCN-specific regions: Sequence locations=1-200,222-247,269-509,566 -772,867-868,890-1124,1171-1213,1235-1398,1420-1629,1676-1774,1797 -1837,1859-2075,2097-2113,2136-2284,2309-2665,2687-2933
atgtcaccagggtcgccggcccagcacagtccagtgcgataccggaagctgaccaccgccggtgagttggcacggcccatgttcacagaagcggcaccaaatacggttagtgtacggtgcggacgtggaacggagacggagcatttccgaagtgtttgaggtgaattttgaaatcattcgcggatatntaaaaaatgtcgaaaaatttttgtttatttttgagtcgaaaatttaacgaatatgtaaaaatcgtatttttcctagcattttatccgtacagggtgccgcgcgccgcttcattgtcgcggctgcgcttaaaaaggtgtccgggcgtgcgtttgcctccaatgctgccgcgtcgtcggcagagagtgctgccatttccacgggtggcattacttcggcaccgatcagtaaaatggcacaaagcaaaagcatgcaatccctggcggcactacatcaaaggccgatccaggtgagcatatgccttttaaacggcggactttcccatttatttcaaaaaaacatttaaatttataaaattgaataaaaataaattttattactgattaatatagcaatggcttattcaattttcatttttaaattcatttttatgcattttttattgaatgtacaaaaaaggataattttggatccggcaatgtcgaagggttgcattacgttccactcagtttagaaattttaacttaacatttttcgagaaaaaatcttagaaaatgagaaaaaaaatcttgaaaaattttctagcttttttttcaaatttttttcttgaaattttcttataaaaattttttttctttaattttttcttaaaaatttcattttgaaatttaaaaaattttcaggggaaacaaaatgccggcagagcaaaaaaaaattatgaaaatcattattattttactataaattctcagctgtcggcacacgaactgctgccagatttggccgagtcggccaacgaggaatggggcagcggccgagccacaattgcctcaagtcaggcatcaaatgtgggccgacagcaggtgggcaaaccaattataggcaattaaatctgaggtatcaacgaagaagacccacagacaaaagacccccacaactttttttaaataaattcttaattaattgattttaatttcttaatttgagtttaatgtgagaataaaaagacccacgaatcatttttgagaaaattttctttaaattattattaggggccggatttatatggacaaaaaaaattccaaaatatagattattaatatagactaaacatttgtaatatggacgaaatatggtcaaaacgctgaaagatgtacaaaaaatacgaaaaatattgacaaaaattcccaaaattttttggtttgagggacgtattttccaaaaaatttccatatttagggatgtatttttcgaacttttgtgaaaatgccgatagaaatatggacaaaagtctcaaatacagaaaatattgaaaaggtaaattagaagcatcaaagcaagcttaaaatactatttacgtgaaaattttcctagtttcaacgtaatactttgcaattattagtttcgcttgtcaattgatattttttctcacagattaaactcaaattaagaaattaaaaattaattaattaagaattatttttaaaaagttgtggggggtcttttgtctgtgggtcttctgtcactacgccaaatcaaacatgtcattaaaattcactaataggctttgatgggcaaacaaagtgccgctgctgtcgctgttgtcggcgaacaacaaagggcggctggacaattggcggaacaacaaaagcaacaggtggactcatctgtcaataatagcatatccttatttgatagggccaggcatacaaaaatcgccaaaaaaaggcgactttattttcaagaattaataatttacacaaataaaaatgcggaaaaaaattttttagagtgcttttttaaattttaaagtctcattttctgaaaacccagaaatatactagagatagatatttgattttagaattttcgccacagctaaagtaattatgccattgttttggtgtttgatccctattatcacacctattttggcatttttgagacagttcgtaatagttaatggctgttcatactgattttaatttattttcatagagaaaagcacggattttaaaatttcgtaaatttttttggtatttttggtcactatttagttaattattttgagatattatttgacaagcatttgacacacaaaaagtgaaatttgttaaagattaaaattcatctggggcaaaattcggcaaagatattagtggtaaaaaattggataattatgtccgtccgcctctgatcggtttacttcacaccacgtttgggcccccccagtcatgttttttgactataaattttttctttgccaccaaatccaacattgttggtatcattcgatagccttaaatgtcctctatttgcctgcaaaattccaaaatttggtcaattttgaacaaatttatggccaaaactacatcagaaaccaggtttcagcagtcatttttgtcataacttttttgaacctgatcgaaatttttcgaaattttgcaggctaatagaggcctcttggtccatgccaatgattttaaaaaaaattaattttgttgatccaacagcagcaggtggccatggttagcagcggtgccgaaacggcgtccactgctgcgaatggcactggagatgaggacagagtgaatttggagccaacggaagagaaagtggatgacattatgggatggtgggaggacgaaggaagcgaagacaatgagagaggaggaggagaggaagagaagaataatgggatgatgaagatgagcgatgggggaggacgaagtttggacgaaatgtga

SEQ ID NO: 65404 - DNA, 2691 bp, Heterodera glycines
  Genomic contig location: Contig_ID=SeqID_7611; Location=278..2968; Strand=-
  SCN-specific regions: Sequence locations=1-62,85-118,140-226,277 -374,396-432,462-942,964-1221,1243-1397,1429-1502,1535-2009,2035 -2228,2250-2294,2317-2375,2397-2599,2629-2691
  Gene Ontology: Mol. function=dihydropyridine-sensitive calcium channel activity; Cellular component=voltage-gated calcium channel complex; Biological process=adult locomotory behavior
tttcatttatttcaggccgtaacagcactttgaaaatgctaatgctcactgttgtgatgtaagaagcattaaaaaagaaatacagaaattgtgatgctaaaataaaggtccatgctccgctccttcttcatcataatggccatggttttgcttgtgctgttctacgcctacactggtgtgattctgttcggcatggtcaaatatgggcaggcggtgtcaaagtgccataaaaaaatttaaaaaaaaattaaatctcaaaatttaaaatttaattttcaggcacgtgaacttccgatcagggttcgaagcattggttgtgctgtttcgcagtgtcacgggcgaagattggaacgacataatgcatgacacatccgtaaaattattatgtttatttgggcactgactttttaggtgccaggaaatttattgcccaaaatatttttaattttaaaatttaatttgaatgcgttagaaaacataaggggaggagtgcagacgtggtagaaaaaagtgtgccgcccgctaatgacttgtttccacccatgaaaatttttgcacttatttttttgaactgcttaagaagctcggtctcgggtcccgactcgatgaaaatttcgaatttttactatcttaggaattttcggtctcgagtagcactagagttttattccatatatgcacatatgttgctattaaagcggagtgcaccgttttgctattggttgccgggcgctaattactggcagacggactgtggcaattactacggtgccctaatttacttctgctccttctacctgatcatcacgtacattgtgcgcaacctgctggtggcaattatcatcgaaaacttctcgctgttttactcttctgaagaggacgcattgctcagttatgcggacatccgcaacttccaacaggtggttgtcagccagggcgtttgagtatggcatttttgaggaacagtctcaattctttttttggccaaatgattcttgggccaattagtagtgtgcctaatctcggcgggtgacgttcgacccccccccccgccgccttaccgttgcagttttcgacttttttcgggaatatgaatcccagttctgcatttcatacttcctaatccgggttttcgaatttttggggtcctagctgacacccctaatttgggcaaattagtagtaatctcgataatgagattgttgcaattagttttaatgagacaaaacaaaaatgaaaatttgacattcaagaaaacgaaatttgaacaaaattttgcctaggtttggaacattgtggacgtggagcagaagggccaaattccgattggccgtgtaaaatttttgttgcgacttttgcgcggtcggttggaagtggacccgaacaaggaccggctgctgttcaagcacatgtgctacgaaatggagaagctgcacgggggtgacgacgtgtcattccacgacgtgctttagtaagtggacaaaaaatgtgccaaaatttggtaaaattaaaaaatactttaatttatttaaatcaagatttgattctattgccttttcaatccatgatcataaacctcgaaaattggcgtgattcacttgatccgtgttgtgctggccaaaattatctaaactttgagattttagagtcatttttaaggaattacggaatttttagtccggcggtgccggtaattctatgaaattttttttgaaaaatttgtcattgtaaaaatcataaagaacgcgcagcctaggagggataaaccagaaaaaccgttaacaaaacctaaaaccgaacggcattttttgcacttttaaggaaaatccaattaatttttcttttctcgttaaataaattgttaaaattacattctcacaatcagaaaataacaatgtacatttaaacgaagagaacttttctaattcgcaaaaaatccacctgtttaggtattactaattaggcataaaaacatccctacttaaaaatttatgtcacaatgtaacggcatttataaaattttatttttataaactccattcattaaaatttctttcgataatttagatgttattttaatttcttaccacggttactgtaattccacatagacccttgttttactgtaatttcttaaaatttaaccccttttcttcgtgctgggtcatttcttaaaaactgccaagttgaaggaatataaaaaatctaagacatataaaaaaatttcattgattttgaaaaaagttctggacaaaaaattccgtcttaatatttggtgaatattggctccataacttttttagaatttcatataaaaattttctaaattaatattctgatagagaacactcaaagctattgaatgataccaagaattattaatttggttgaaattggaccaagatacgaatttatatgtcttacattttttgttttcctacaacttggcagtatttaagaaacgacctagcacccttttcttcagcatgctctcttatcgaagcgtggacatacgaaaatcgttgcaactcgaagagctgctccaacgggaagagctcgagtacatcattgaggaggaggtggccaagcaaacgtaagcaatttaaaaaataaattttcaaaaaaaaacgagatttttccagcatcaaaacttggctcgagttctgcttgcgccgtcttcgttcccccggc

SEQ ID NO: 65405 - DNA, 526 bp, Heterodera glycines
  Genomic contig location: Contig_ID=SeqID_7611; Location=2016..2541; Strand=+
  SCN-specific regions: Sequence locations=1-492,522-526
atgccatactcaaacgccctggctgacaaccacctgttggaagttgcggatgtccgcataactgagcaatgcgtcctcttcagaagagtaaaacagcgagaagttttcgatgataattgccaccagcaggttgcgcacaatgtacgtgatgatcaggtagaaggagcagaagtaaattagggcaccgtagtaattgccacagtccgtctgccagtaattagcgcccggcaaccaatagcaaaacggtgcactccgctttaatagcaacatatgtgcatatatggaataaaactctagtgctactcgagaccgaaaattcctaagatagtaaaaattcgaaattttcatcgagtcgggacccgagaccgagcttcttaagcagttcaaaaaaataagtgcaaaaattttcatgggtggaaacaagtcattagcgggcggcacacttttttctaccacgtctgcactcctccccttatgttttctaacgcattcaaattaaattttaaaattaaaaatattttgggca

SEQ ID NO: 65406 - DNA, 609 bp, Heterodera glycines
  Genomic contig location: Contig_ID=SeqID_35952; Location=333..941; Strand=+
  SCN-specific regions: Sequence locations=1-503,525-609
atggcaaatcaacctttttattgctttttgcggggtatcaatttaaatgtgcgtgtatgctgactgatcatttttccaggtacattgaccattccgtgatcacatttctccgttccaacaagcaaatttttgaccgaaatgtcacctatttggggttggatatatttacagacataattgaaaatgatgaccatccgatttggccaattttggcccgtcaaatttggccaatttttgcgacaaacattcacattttggactgtgccgatgacaatcatttggacattttggcgtaccaaatttcaccgacaattctcaccgatgttgatcaattgaatgtaatcgcttttgatattatgttccttgatggaattgatgatgaaatttctactggccaattgttgtccgaatggttgcacattccgagaaaaaatggtaaaccgaagaaattgtattgcggcaaaggatttaatgttgaacgacacttagattggatcaacagtttcaaggaggtgcgtttggtcacattctcataaaatttgggttaccgtacttacttactgcattagtacccccctctgtattaaaaccgccctttcgagagaggga

SEQ ID NO: 65407 - DNA, 528 bp, Heterodera glycines
  Genomic contig location: Contig_ID=SeqID_35954; Location=70..597; Strand=-
  SCN-specific regions: Sequence locations=1-528
aaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaggtgtccgtttggggtactcaaacaattatggggagcaaaaatccaacgcagaattaaagtacaggctatagggaagctattcccgaaggattcggtctccccataaatctgggcgcatcggttcagggggactgcccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgcccc

SEQ ID NO: 65408 - DNA, 1026 bp, Heterodera glycines
  misc_feature (31)..(31): n is a, c, g, or t
  misc_feature (911)..(911): n is a, c, g, or t
  Genomic contig location: Contig_ID=SeqID_35955; Location=8..1033; Strand=-
  SCN-specific regions: Sequence locations=1-198,363-563,585-659,681 -791,813-1026
atgtataatcagggaggacgcacttttcgcncaatatgtgaatggagaagagcatgccgacaatgtggagccataacctatgcgaattatccacataaatgtccagcccaaattggccaaacggaatgggtgcgctgtgcacgatgctctggaccccatcaaagtggagacccttgttttattcagcctctcaaagatgaaccaatgaggaggagaaggagaagaagagggcaacagcaacaacaacaacaaaataataataacgatgacgaagacgatgatgatgataatgatggtaacgaggagggagacgacgatcacggtcatgatgctgataatgaggaagaagaagaagttggaacaaatcggtcggtcagactttgctttttcgacgctgaaacgtcccaagatttaccacttcaactgcgtacaaaggttgtacagaaacatgttccaatgctcattattgccgaaattatctgcgaagcgtgtataaatgaaggaatttcggttcattctggtgttggacaatacgcaaatgggtgtgtgtgtggtcctcctgcgggaccaagggggcgtcgctggtgttctcctccgtttctgaatgcacctggggatgacaatgctctatcagccaatgtccactacaacccacgaagactgtttttccatagttttgacgacgctaccaacaatgacccggtggacgattttatcaactttctcaccggaagtggtccacatggtgtgaaaacaatttgtttatcacacaatggcggaaaatacgacattcatttaatactggaggcacttcaccggcgcaatttgccaccaaagcgtatttgcacaacgggactaaaaattttttcgatgactttgaaagggaaccatcaacgacacgtgatctttanagactcgctgaactactttttctgtgaattggatgcactgccacgcacatttggattgaacgctgaaagtgcaacagcaaaaccttttctttccttatctgttcatccggcgtga

SEQ ID NO: 65409 - DNA, 564 bp, Heterodera glycines
  Genomic contig location: Contig_ID=SeqID_35957; Location=567..1130; Strand=+
  SCN-specific regions: Sequence locations=1-281,310-564
atggctcgacttctgcttttagtttttggcttggccttcgttttcgccgttttggcctttggcactgcgcagcccccgccgcccttccaagggagcggttcgttcagagaaggtgaagccatcaatttaaatatttaatttgttatttttggcattttaaggccaattcggcgcccctccgtttggtggcaattcggcggacgtttcagtctcggcgagtgattcgtcggaatgcagcggagaaggaggaaatggagtgcaaggaggtgaaaaaaacgcgcatttttactttataatttatttttaattcaggtggggaatacggtaatggcaatggcggctttggcggaggcggtgccgaaggtggccaagggatggacatcgatgtggatgttgaacaatcatccgagaagtgaatgattttaaccacggttttttattgaatgtgatttgttttcttggtgtatttagaattcggaaatggacattcagcaacgataaaattattaccaaattttatggctttaagttccgcattagagccgtgaaaaattatcatttaca

SEQ ID NO: 65410 - DNA, 1716 bp, Heterodera glycines
  Genomic contig location: Contig_ID=SeqID_7612; Location=262..1977; Strand=-
  SCN-specific regions: Sequence locations=1-724,746-1716
atggaaagcggagttaaggaaaaccctattctaacagctaaagataggccagtgaatgagatttcgagggtaccactaacaaaaagatggccgtctcctgaagaaatggaacttaataaaacggtcgcaccaaaggggccaagtaagaaaaatgtgatccaaacaaggagactaaaagaagaacggtgtgctgtacgtacaaccgcaagacaggatgtcggacagatgcaaaacgagacagttttagctctaattgaaactgagaattgggttccgaattttaaaaagaagggaagggtcaatcatcatgacgcggtgtttctcgtcgatacgggagcacacatcactttatgtagtgtccaaacagcaagaaaattgggcataaaattgctgcataattcggaaatcccaggagtggttggtattgacgggaaaattgttccaataatgggacaaacagaaattttgattgaattgatgggccacgaagtcaaaagcataatctcggtcgttgatagaaatattggaaaggggtcgtatgacattattttaggacgaaatacttttcaaaagttgtcttttttgttggacttacaaagtgggaaattgatggagaaaacaaaaaaagtaatggtagccgaggaaaaggagacgaagactcaaattttggaagaaatgctcaaggaagtgggaacaaaaaatgaagatgagatagacagattaagagaatgtctcaaagaaaattgtaaagctttttcggaaaatgattatgatttgggaacatgtaaaattattgctcctactcttttaacttcgacggaaatgcctgaacgagttaggccttatccaattcccgaaaaatatgaatcggagttaaaggctcatattggaaaaatgcttgaagttggagtgataaaagagagcacaactccttgggtacataacattgtgctagttaaaaaggctaatggccagctgcgtccatgtgctgactttcgcccattaaataaagtgacaatcgcagacccataccctctcccgcgtatggacaaagtcatttttagagcagcagggaaaagatggtactcaactctagacttagcctcaggattttggcaaatcccattggatgcagaaagttcgtataaatgtggcttgattacgccttgggggttataccaaatgttaaagttgcccttcggactaagaaatgctccaagcatttttcagagaacaatggaccaaatacttaagggggtaccgaacgtaatggtttatatagatgacatattaatttattcggaggaattggacgaacacattgagagtttgaggaatgtgtttagatgtctctgtgaaaatggtttgaaattaaaaggccaaaaatgccgtttccttcaaaaggaatgtgtatatttgggccatattttatctgcatccggttatcagccgtcgctgtctaatcgtgaagtgattgagaatttcccacccccaactaatgtcaaagaaataaaaagattccttggaatggtttcattttttagaaaatttatcccaaactttgcacaaatagcatacccattaaacaaattaacccgaggaggagcatttgaatttgaatggggagagaacgaggagaaagcaatgaatttgttaaaaaatcacttacttaagtcgccgagtcttcgggcgccaaattatgcactaccgttttaa

SEQ ID NO: 65411 - DNA, 455 bp, Heterodera glycines
  Genomic contig location: Contig_ID=SeqID_7613; Location=273..727; Strand=-
  SCN-specific regions: Sequence locations=1-271,293-371,393-455
atggtttcgagaagtcaatcaccgattgatcaacaacgaaataatggctctgattttgattcctccctgttcaccctggaagaaaacgaattcttccaaaatttgttaccgagactccgttcctttgaagctgccgtgtgcagccaatttcgtcagatggaaaacgaaatgagaattgagtcggagaggaaaggtgaacaaatcagagaattggagagaatggtgaatgagcaaattacagttgaagaaaggagtaattttgacttcgcggaaaggattgtgaaattggaggatcaggcagaagagaatgccaacactctcaaggggtacaaacaagcggccaagataggtctgaaacgaattgttgaacgcatagaaagtgaattaaaaaatgtcaagaccaccatcgggaaactccaagaaaagattgaaactgtggaaaatgattttcaaga

SEQ ID NO: 65412 - DNA, 939 bp, Heterodera glycines
  Genomic contig location: Contig_ID=SeqID_7614; Location=896..1834; Strand=+
  SCN-specific regions: Sequence locations=1-243,266-440,462-939
cacaattttaaatccatggcaacatcggctaaccatcggccaatcttcgaatttattgtcgaattgggtaggtaaatttttactatttttgggcttttctgcaattttcaaactattatgttccatctttttaattccaaaattacctttccatttaaatattcgagaaatgtccgattttgccgggaccctcaaatttcggcattttgtccaatacgaaccccgttccgaatcgaatttcccccatttatttcccctcatttgggcaggcattcgtctccaggccgattcgctgaccgtcgcctttgcctcggtgtattgccatcgcgtgttgcgccaaaaggcttttccgggcgaccaaatttgtccctttgtgagcttttttttaggttatacgcaaattttatggctttagtgagttttaggcgtccaatcattactttcttttgcacatttttcttatttggtcaactctatgtttttggcatcaaatgaaagcaaaaaactctatagaatttttttgtggacctaaattcttgactaaaagcaacaaacaaaaaaggtattcttggatatgctcgaaaaagcaacttttcgtgttttaccgttgcaattttttcgtaatgtcagatttgcttttttctttttatttttaaattcccgggactttaagctttcatttggtaccaaaaagataggcatttgccaagtaagaaaaaacgtatggccaaagaaactaaagattggacgcctaaagtggcactagagccaatttttgaatcaattttggccgtttggctctttttttgttgaaaatgcttaaaattttccggttttgtcaaatcccccccttcagacaatggcttccgcctgtgttttggtggccggcaaagtgacgaacgacgcgcgcattaacacgcgcgacgtgatgaacatggc

SEQ ID NO: 65413 - DNA, 526 bp, Heterodera glycines
  Genomic contig location: Contig_ID=SeqID_35962; Location=71..596; Strand=-
  SCN-specific regions: Sequence locations=1-248,271-496,518-526
  Gene Ontology: Mol. function=protein binding; Cellular component =nucleus; Biological process=positive regulation of growth rate
atgagcggatgttggagtgcgaaattggttagaccaaactgggaatcttgaaaagcatccaatgggatttacccggagtaatttcagcaacaccacaaatcgtgataaattatgcactgtttttggaggacaaccaatactttgaggatgctttcaaggcgttcgagaagggaattgggcttttccggtggccgctcgtatttgacatttggaacgtttatctgaccaaattcatccaacgatatgtgctgtgtttttggtctatttaaactataaattttcaatttatagggtggcaaaaagctggaaagagctcgcgatttgtttgagcaatgcttggacaaatgcccacccaaatatgccaaaagtaaatgttgttacttaatactacattgattgtaaatttccaattttagatatttatctgctttacgcaaaactggaggaagagcatggattggcacggcactcaatggatatttacaatcgggcaaccggagcagtcgaaaaggaagaaatgcatctg

SEQ ID NO: 65414 - DNA, 163 bp, Heterodera glycines
  Genomic contig location: Contig_ID=SeqID_35964; Location=115..277; Strand=-
  SCN-specific regions: Sequence locations=1-55,78-85,108-116,138-163
atgttcgatgctggtgggttgagtcccagtgattggaatgctgttgggttgagtcccagtgattggaatgctggtgggttgagtcccagtgattggaatgctggtgggttgaatcacagtgattggaatgctggtgggttgagtcccagtgattggaatgctg

SEQ ID NO: 65415 - DNA, 243 bp, Heterodera glycines
  Genomic contig location: Contig_ID=SeqID_35969; Location=44..286; Strand=-
  SCN-specific regions: Sequence locations=1-158,180-184,224-243
atgccctgcagatcagcaagaattcaactggtgagtgttttagttacattttattttaaccttatttgaaataactttttatagaatttttattttcagattattttgatcgacgaagtgttatctttgcgaacaaaaatccacgaaattgagaaacaaaatgggcaataacaatgtgagaaaaaatgtttaagggtcttttttaaatattttatacttaattaagcaatttttggaattaaa

SEQ ID NO: 65416 - DNA, 692 bp, Heterodera glycines
  Genomic contig location: Contig_ID=SeqID_35969; Location=362..1053; Strand=-
  SCN-specific regions: Sequence locations=1-102,127-199,225-500,522 -600,622-692
tcgtcgtcaaaaaatgtcgaattagagaaaaaagaacagcagcgactggcgaagaaattgaaccatacgcaagccatgggacatcatgataaagtgcagcactttaattacataatttaaaaacgattggatatttttcagccaacaaatatcagcgtcgccaataattcaagcagtgattttatgaataaaaattgcgtattttaatttaaaaaaatatttatcagaaaataatgttacatcgcgcaccaatgtccttgtaactagcaaaaatacaactgatggtgagtgttatacctatttacgttttattttttttatcaattggtgggcaatctttttaatccgatgagcttttcaaatccttgtcaaatattttaaacattgtagtcagtgtttgatcgacaaaaacaaaaaaaattaattagactttttaatgaacaggtgattacttgcacgtgcttttcccgcccttaccaattgctgtagtggtaattatgaatatttcctcatccttgaaattgtaatacattaaaatttaatttacagcagcagcgatcggcaacgaaattgaacaatacgcaaccaatgagccatcattatcaagtgcagcacattaaattacttaatttaaaaacgattgaatattttcagccaacaaatactcgcgtcgccaaaaaatcaagcagtga

SEQ ID NO: 65417 - DNA, 443 bp, Heterodera glycines
  Genomic contig location: Contig_ID=SeqID_35970; Location=142..584; Strand=-
  SCN-specific regions: Sequence locations=1-350,372-443
atggagcggcataaacagcaaccagtaaagattggagagctgataaaagagaatcgcggttggctctgtgccttggtcaggacaaaatccggaaaaaaatgcaggaaacttatacgaaatgcaaacactgaacaactactatcgctggtcgaaatttgtttgaatctcgtcgcttcgcgcttccaactgacaaccagacagaagaagcgactaatgccttatgtggatactgtacgccgaatcagcagagcgagaagtgaacggggtgccaagcgagtgcttgtccagaaagacgcaggatttggcggattgtacgctgccctattgacacccgttctaatggaagtggcaaaaatcctttgtgaacaaaaacgcataaatacctctcatcattgttgaattttgtgaattccattattcatttaacagagatggcaaataaa

SEQ ID NO: 65418 - DNA, 418 bp, Heterodera glycines; identical to SEQ ID NO: 53014
  Genomic contig location: Contig_ID=SeqID_35971; Location=173..590; Strand=+
  SCN-specific regions: Sequence locations=1-2,30-32,155-206,236 -236,320-325,358-418

SEQ ID NO: 65419 - DNA, 838 bp, Heterodera glycines
  Genomic contig location: Contig_ID=SeqID_35971; Location=1..838; Strand=-
  SCN-specific regions: Sequence locations=1-17,50-95,117-309,342 -347,431-431,461-512,635-637,665-672,748-838
caaaatgcatagaattattgctgcggttaaaaagctcgtagtgggatctgtgctagccgtccggtgcacacttggtgtgttactggtttggttggcttttctgccggtctctccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggatgttcggtgttcagccgcacgaaattgaccaataacag

SEQ ID NO: 65420 - DNA, 785 bp, Heterodera glycines
  Genomic contig location: Contig_ID=SeqID_7616; Location=723..1507; Strand=+
  SCN-specific regions: Sequence locations=1-578,600-702,724-785
  Gene Ontology: Mol. function=t-SNARE activity; Cellular component =integral to membrane; Biological process=synaptic vesicle docking
cgaaatgccatttcgcgaccgaacggcggaattcagaacagtggcaaagtcatgtcaggttggtttgttggatttttttaacaataaatatgaaattacattaattggcagcttcgacagcagccaaatggatatatgggaaagagcgaacgagaaaaaatcgttaattcttcaattcagttcaaccaattggccaagttgttttgtagcattttctgtggtagtaatcggttttaaggcgcattggtcgggatttaagtatgacatgtgccaaaatggagaaattggcacaattggccaagaaaaaatcattgttcgatgacagagctggggaagttgaagaactttcacaaattatcaaacaggtttttgaaaattttatggaggtggcatttgaccaaacaattttcaggacatcacgggcctcaacaaacaaatcgccaatttgcagcaattggccactcaccgcacttccggcggctcttccgtttcgttgcggcaggagcaacaaagccaaaaccactccaagttggttgtgggtggggttgcagtcgaagctcgccaacattagcaaaaacttccaaaatgtgctggagattcgaacagaggtaaaaccgaggaacggattttaggaggaaattttcgtattgacagtcctttaattacgacaccaagtttgtaaatttttagaatttgaagttcaaaagagagagacgagaaaagttcagtcagtcgggggcaattccttcgaatttgcccccttccacaagaagtggaccaagcga

SEQ ID NO: 65421 - DNA, 845 bp, Heterodera glycines
  Genomic contig location: Contig_ID=SeqID_7617; Location=423..1267; Strand=-
  SCN-specific regions: Sequence locations=1-590,612-680,702-845
atgatccccagaatcctggcatggaaaagcaaagtgagcatgggactcctctccttaaggtatgtaaaaataaataaaaatgtgaaagggtgtaaaaggaattgaaaattaccatataatcgacgcggtcctcagcgagccaatgaaatgcttttatgaaaaaaagaacaacaaactgaacaacgaacaccggcgaaaagtcatcgcgaaaaacggctgaataaaatcaatgaattcgagtcggacagaacacgcacttactgaatgccaaacacgtctccatcagcgtgtgccaaacgcgttcctgggcacgttcgacctcggccactctcagctggccgaagaaaaggcatcgaagcaacgaaaagaccaggtaactgaggacggctgcttggaagtaaaggacctaaaataagcaaacgcaaatggaaatgaataggggagagacgaactcacggccatggaagtggaactcttggaaagatacacaacggacgggtagaactgcttcttgaggaagaaagcattcaaaatggtcaagacggtagagacaaagcttgccaggaccacaaatgacaccgaaattcggaccattctctttctttcttcttaaaggaactgatggaacgaaggaacagacagacaataagacagaaatatgagaatctttctaagaaacgaacaaatacataaaataatttattcagaagcggaagagtcgcaaagctatcacatggactaaagaggagtggaagagtttaaacagaagaaggaacgggcgaatggaaccgtcacaaagcgattttcagaaagacctaatgatgaccaacaattaacacaataaa

SEQ ID NO: 65422 - DNA, 2480 bp, Heterodera glycines
  Genomic contig location: Contig_ID=SeqID_7617; Location=674..3153; Strand=+
  SCN-specific regions: Sequence locations=1-1020,1042-1063,1127 -1764,1786-1889,1913-2480
atggtccgaatttcggtgtcatttgtggtcctggcaagctttgtctctaccgtcttgaccattttgaatgctttcttcctcaagaagcagttctacccgtccgttgtgtatctttccaagagttccacttccatggccgtgagttcgtctctcccctattcatttccatttgcgtttgcttattttaggtcctttacttccaagcagccgtcctcagttacctggtcttttcgttgcttcgatgccttttcttcggccagctgagagtggccgaggtcgaacgtgcccaggaacgcgtttggcacacgctgatggagacgtgtttggcattcagtaagtgcgtgttctgtccgactcgaattcattgattttattcagccgtttttcgcgatgacttttcgccggtgttcgttgttcagtttgttgttctttttttcataaaagcatttcattggctcgctgaggaccgcgtcgattatatggtaattttcaattccttttacaccctttcacatttttatttatttttacataccttaaggagaggagtcccatgctcactttgcttttccatgccaggattctggggatcatttcccttctcagtgccattgactcttacttcatttctcacgctttcttcacaactttgatgcggggggccggcgctcaaattgtgtttggatttgaggtcctaatttggaatcatttatcaaaataggattatgattataataataattgcaaaagaggctttgcacgttaattacttccctcctcaattagtacgccgttcttctcacaatggttgcgcatatgaccatcaattacattttgcatttgcacgatttgcgttcgccgcacccctgggaaaacaaagctgtgtacatgttatatgccgagctgctgacaagttgtgtttgtttctcctttcctgaaatctgcaagttttctaggctttcttcgttgtgccctttacctcgcttttgctgctgttatgatgaaggttcgttgtgacacagagaattcaaactttaatttaaaaaaatctttcaacatgtacaatttttattaattttcttacgaaattttttatttggaatatttttaaactttttttattatagtgttggtttggaaaatttgctttattaaagtttgtaaaaaaatttatacatttctttctcaccgctcttccagatgcacactttccctctgttcgccatccgtcccttttatttgaccgttcgtgccttccgaaaggctgtcaacgacgtcattctgtcaaggagggccataaatgccatgaacaatttgttccctctggcaacagcgcaggattggcagaaagtgggagaagaaaagtatcagtcagttgtgccattgcctttttcactcttcagatgacaacacatgcattatttgtcgtgaggaaatgaccgtcgaaagtggtgccaagaagttgccatgcaatcacatcttccacccgaactgtctccgctcgtggttccagcggcaacagacttgtccgacctgtcgaaccgacgtcttgagttgtttgctcgttcagtttggaaatgtttgccctttcgttcagtccaacggcgtccgtctaccgctgccccggcacaaaatgcgccgccaccccaggcccagcgtctcttcgccgctcctcttccgccgtttgcccacccatttcagtttcaattccaatttggagcggcccaacaacagaacaacttcccgccacaacatccgccgccctttttggcgccgccttttgcctttgcgcctccgccacaatttggggcgccacaaccccaacaggtggccacttctcaactgtggcatgaataatcagaatggaatttaaggcgcagcagaatccccaacagcaacagcaggcggcggcatcgcttgcgaatggttccgtcggtgaacagcctcaaacacttgaccaggaaagggtgcagccgcaacagtcagcaacggatgggacgcagcagccaagccagcaacaagcgcagcacttcccgtggtctccgcagcagcctttctttatggttgtacattcggtgccattgtctctcattctttcccctcttttagcctttcgggggtttgcctccgccccctccgtttctgcctttcccacaacctccgctggtgcgttttctgtttccgttttcactgggccattgccattttcagtttgccggtctcagtgatgctgaaattgccgcaatggaagggacggaaagacgggcggtcgaggcgcgcattcagtccctgcggaacatttcgacccttttggacgctgcactgctgcagttccagcaatatttgagcgtctctcccgggatagcccctcaacaaacgcaaagggacgaaaactttgcgcaaaacctttcgacatcggccgacagcgcaacggatgcggaaacaaacggcagggaaagtcagcggaatgagacggagac

SEQ ID NO: 65423 - DNA, 371 bp, Heterodera glycines
  Genomic contig location: Contig_ID=SeqID_35973; Location=96..466; Strand=+
  SCN-specific regions: Sequence locations=1-163,198-205,227-317,339-371
atgttcaaatataacacacggcagtttaatttttatccaattataaagagtacgagttttggaccggccttgggttgagaggcctatattgctttggcgactgctgtacttttgtatctaacataaagagtcttaaatttaaagttttgtcacttatttccactttatttttatatattaaatttttaataaataatcattttgtttcattaccttttgggtaattaaatctttcaggtaattttttgtgttggatatttgtgaccttttcattatttaaattagtttggcgttttgttggcgtctttcctttattgttttgttaatttattttccctcagttcgtaattattgttagttttattgtctta

SEQ ID NO: 65424 - DNA, 759 bp, Heterodera glycines
  Genomic contig location: Contig_ID=SeqID_35975; Location=94..852; Strand=+
  SCN-specific regions: Sequence locations=1-310,332-342,366-469,494 -587,610-657,683-759
atggcaagtgccacaacaaactgtacgccaacatatgccacaagcactccaacgagtgccacaacagtcggcacgacaccgagcgtcacaacgactggcacaccggtacttaccaccaccacgagaccaccaacaaatggcgtactgtgcagatgcacacgaaaagagtaccgtatgctcaccgcagacgaacggacaagatatgtaagtggcggaggaagaaaaaaatagagatagaaaagaattcaaaatttaacaatgatagtatttttatttttgtgggattttaggagaaacgctaaaatggaacaaaatatttttaattttttttcttgtttaggaccaaaaataaattataaaaatggatttaatacccgaaaaatagcataacaaaagcatatgaatgtgcttttttcgtatattttaaccaagggaagctcagtaagtcctattgtagaattaaccgatataaattataatgacaaaaaatacttaaattcacagaaaattgattatttcttctgtccatggttaatttgtcgtgtgggtttttgtctgtggctcttttgtcacaacgctaattggaccatgtcaatttttcttggcaattaaattatagaattttggcgtaatattcataatgtttcattgtttattatttaatggtaattagtagggcttccttttttaggcacaaaaaatcgcgaaataggcattaaataggcacaaaaatcctcaaatgggcactaaaataggcaa

SEQ ID NO: 65425 - DNA, 287 bp, Heterodera glycines
  Genomic contig location: Contig_ID=SeqID_35977; Location=46..332; Strand=+
  SCN-specific regions: Sequence locations=1-287
atggtgccaagccccgtggtggtgcccgatgttgaggcggatgcattcaggacgatgttgggcttcatttacacggacgatttgagtgggatggacggagacaatttgttcgacgttctttacgcgggtaaaactttatttttgggttttcccgttcagtttaatccccaattttagctaaaaagtacaacattgtcggcctggtcaacgcctgcttggactttcccatcccttcgctgcccaacgttttcttcgcctttgcccaggcgcgttttctcgaagaaaag

SEQ ID NO: 65426 - DNA, 555 bp, Heterodera glycines
  Genomic contig location: Contig_ID=SeqID_35978; Location=239..793; Strand=-
  SCN-specific regions: Sequence locations=1-347,369-555
catttgacaaagaagtcgtgttgatggatcattatttgattgctttgcttattggagaaacggaaatcagtcgaatgaccaacaaattggctgctgatctgtccgttttcgtccattggtccgactcggaaccaaagggggcaaaaatggacaaattttggcagaaaaagcggacaatcgaaatgcatagaatgtacgacggactgtttgacgtggaattggaagtcgaaatgacgaaaatcgcattggcattcgaagaaacgatcaaagggatgaaggaatttttagcggctaacagaaacgccggcatagaaaagaaattggcagaggaatgggacaaaatggcgaaaaaagcagacaaagaaacgaaacggagggcggacgaaatgccaaaacggacgaattggaataatttgatggacgcaacgccaaaatgggtgaaggaattacacgcggcaaaattcaaaaaatatgctgataaacggctgggaagagaaacagaaaacgcgttctttgttcacccgggagaaagtcttattaatgaattaaaaaagg

SEQ ID NO: 65427 - DNA, 310 bp, Heterodera glycines
  Genomic contig location: Contig_ID=SeqID_35981; Location=472..781; Strand=-
  SCN-specific regions: Sequence locations=1-310
gaatttgagaagggcatatgcgacgatcatcagcagatcgggaattgggacattccaaaatttgacaaaatggaagcaatgcaaatttatgagtcaattatggcacaaggagaaaggggcaaaacaattaatttatattgtattggcatgctaattgaaaggttcattaatatgcgaatatttttctgcaaaatggatagcgatcggctggtacaaagcaaagagaagctaattacgttaattggggagatgggactgattcagttggagcaaatgtatccggaagtgatgaatttctgtgggttcaatg

SEQ ID NO: 65428 - DNA, 623 bp, Heterodera glycines
  Genomic contig location: Contig_ID=SeqID_7619; Location=194..816; Strand=+
  SCN-specific regions: Sequence locations=1-407,436-623
ttgaaattcttagaaatttttttgtacgagttgccctgtgtacgagttgcctattgtacgagttgccaattgtacgagttgccctgtgtacgagttgcctattgtacgagttgccaattgtacgagttgccaattgtacgagttgcctattgtacgagttgccaattgtacgagttgccctgtgtacgagttgcctatgtacgagttgccaattgtacgagttgccaattgtacgagttgccctgtgtacgagttgccctgtgtacgagttgccaattgtacgagttgccctgtgtacgagttgcttattgtacgagttgccaattgtacgagttgcctgtgtacgagttgccatgacaccatgaaattcgtatttttctgttttaatcaatcgcgcggaatcccgtccctaaaatattttttaaaattctgcaactctcagcgggatacacagattagaaatttctggtctttaataatgagatagtctctaattgagaaattctcggttattatgtgtttcggctcgaatctctagctaaattatcggttcgcaagccaagggataaattattaatcactcgagtctcggaaatactcatcaaaagcaacaatataaatca

SEQ ID NO: 65429 - DNA, 684 bp, Heterodera glycines
  Genomic contig location: Contig_ID=SeqID_7620; Location=32..715; Strand=-
  SCN-specific regions: Sequence locations=1-157,186-215,274-301,430-684
atggcaaaaagcaaatcgttgggcaaacaaaatgatgtaaaaacaaaaaatgatttaaaacattctgatgcaaacgatggtgattctgatgatgaacatgtccaacttttgtccaccagcgtgagggatttggccgggaactttgatttattggttgaaaataattcataaaaaaaatatattttcaaagagtgctaaaaattcatataaatgggaataataattttaaatggaaaaaaaaatttaagtaataagaattaattaattttattagctgggttaatttgcaaaactttcattgaattataaatatattttttatttaattgaggtaaataaagtttttctaaaaagaaatttattttatattttaataaaatactttttttaaactcaaaaaatgtttttcaatttaaaattttatttattctctcaatcggattaaaaaataattcattaatgagataaaaaagaaattatgaaaaaatttattcagttttttgttcttaatattcatttctatttttagaattcaatgattttataagaaaaatctttcaaatttgcagagacttggcaagatcacggataacatcatcaacaaaaagcatgacgtacagcttcgtcccgttgttgacaccagcagaaaaagtcgaaatctgcagcggaacaatacggcgggaa

SEQ ID NO: 65430 - DNA, 582 bp, Heterodera glycines
  Genomic contig location: Contig_ID=SeqID_7620; Location=1300..1881; Strand=-
  SCN-specific regions: Sequence locations=1-179,232-376
atgggttggatttggttgacaaagaaaaaagttactgcccggagcccaaacgtgccggggctctattgagcgagtccgaactgaatactgacaattatgtaaatattcagaaaaaagtgatcagaaaagagatccgacaacatggatggacactgccagggaatggtctggttggatggtaaaaaaaatgataaattaatttaatggcaattaaaataataatttaaaattcaggcgaataaattgggaaatatatatagttggagcaaagctgaaaccccggctgctgaacaatcatcaccaaatcaaaaaacaaaatcgctaaaaatggtcaaacaaaattcttcaccaaaacgggaagaaattgtataaaacgattttatttttaattaattatagttttatgtataaaaaaacatttttaaagctaacaacaaaaaaaaaattaattttttactatattattttttattaaatttaatttaagaattatgatttaatattaatattaaatatatctctcattattctttctatatataagtgatacaaaaatttattttattttttttatataataaa

SEQ ID NO: 65431 - DNA, 1889 bp, Heterodera glycines
  Genomic contig location: Contig_ID=SeqID_7621; Location=137..2025; Strand=-
  SCN-specific regions: Sequence locations=1-325,355-373,395-507,534 -588,610-622,702-747,799-1144,1166-1366,1391-1756,1779-1889
aaacttgctcaaagagttggatgatttgattaatttgattaaaaatgctcgggacaatttcacacatgccgaggtcgaattgggtgtggcttcggcatttaaacacaaaacaaatgacattgattgttggattaatgatgccaaattcaaacaatttttggatggccaaccgattgcaattgatttgttgccaagaggcgatgcaaataatatgcaatacattttggacagtttactgcaaaggcgtgaacattttataaatgaaaatttggggaaaggaaaggtatattttcaaagaaatttagatcatttggccaatttttaaaacaattctttctttttatttctttattaatatttgatgaatatctataagaaatcaaaattctaaaattttcccgacgtcactcggcaccgccgcacagtatattttctcatttaaaaataaaaaattcatatttttggcactttttggtaaaaatctgttaaaatgaaatgtagaagaaagttcctttaaaattttcaaattttatagtaaaaataccgtacttttatatatattttagcaatatttgggtcgcttataaattttcttaaactgagtgatgatactgcaaaagtcattatttaattatcattataaattaacccaaaaattgattattaaattaatttaattgtattaatataattaataattatagaatatacaattattagactaccataaaagagcatgttaaaaccaattaaaaataattttaatataaaaataaatctatttaaatgaaaatttttcagttagaaaataagaatgaccataacctcatcaaacgcatggattcagtgataagacatgtgaacaaagcaagaaaatttctaaaaaaagcagaaggtggtagtagcgaaaaaactcgtgcccattcctatattacggagaaaaagatgaatcaaatatttaaaaaaattttgaatggtgaaaacgtaatgccaattttgttgccaaaaggtggctcgtcatgtttagaaggatatttagacaacctgataaaacggcgtgaactgatggtaaagggttcattaaacgagggcaattaaatgggcctaatttgtagaattgaaaaatgggtaattaaaatttcaatttgtaaaattattcataaaaataggatagggagggcccccaactcagcctccgagcccgaaaacttgttgcattttacggggtataaccaacacctgatttagcatttagctaatataaatttatcaaattcaaaattaatttatcattttgctaatttgcgataaaaaaaatctgaatgaaactgtcgaatagtaattagattagctaattacagttatcaaatttaaaaataaaataattaaagcgcattaattagccttcgtgcatgagaatctgatcgagactatataacttctgaatggattttgaactcattaaaatataataaacaaagaatagtgatccccgataaaagtattcattaaaaataattatgttccagcggtatggtggggaaggtttgttagaaggacaacaacagcagcagaatgaagaaaatagtgatgacaatgcgcaaaaacatttgcaaaatggtgacaattattacagtaaaccctatgacaaatacagtaattcgcatggaaagtacggtaaatcaaaaagtttgccaacaaatggtgacggcaaaaagcaggcaattgaaaatgaaaatgaatatagcaaatcgagaagcatgccaaccaccggggcggaatatgaagaaaaaggtacaaaaaagcatacggtaacatccaaatcatccatatacccaattcatccaaccgtgacacatttcataatgcccatttcatccttgtcctaa

SEQ ID NO: 65432 - DNA, 2623 bp, Heterodera glycines
  Genomic contig location: Contig_ID=SeqID_7622; Location=23..2645; Strand=-
  SCN-specific regions: Sequence locations=1-92,135-240,275-599,646 -788,857-942,984-1039,1074-1088,1140-1157,1197-1456,1478-1655,1711 -1718,1766-2557,2580-2591,2614-2623
atagaagaacaaccgcataatgaagatgaaacagaaaatgatgaacaaagcgaagatgggcaggaggaggtgaaattttgttaaatgaaggcttttattaaattattttaattaaaaataataattgtaaaattcaaagctattttgatcttataggaattggaaaatattagctcaaaacctcttgttgatcgacataatttcgaaaaggtcaagttaaatattttctcaaatgaatgcttttattaaattatattatttaaaatatttaattcgtaaatttaaatcctacaggaattccagaatactagctcaaaacctattattgatcaacataataccaaactggtcaacttatcaactttcattattagggcacggatttttaaaatattttaactattttttctgcagcaattttttttgcagagatagcacaaaaacactcgttttttagatttataagaaattgtcttaacacaaaagcaatacaaacaaaatacgcacctaagaatggatttaaaaactcaaaatttgaatttttgctaggctgctattacaaattcgataatcttttgaaaaagtgccagaaaaatagctttaaattatataaaattttcagtttaataaaaaaaaaatttatttcattactttaacgagtcttcttcaactagtgataaaacttttttttattcatttttccttgaattatttaatattttgatactttttcatcattttttttgccattttttcattactattttcgtaactaagaatccgcgccctattatatatatatattaaatttttaaattgtgttttaaattaaaattaattaagttatttaaattttgtttcattttcagagtccacctgaaagcagtagaaaacgctaccaattgctgcttgatgagaaggtttttggcatcgttttagtgattttggaaatttaattttccaaaaatacaaaaattaatatcccctccccgtactctaacagacgccaatttaaaaaaaaaatatacacctaaaatggaaaatttttttctttttttttattaaaataaaatgttcctccctttttcataattattaaataagcatttagaaaaataatttaatattcttttttttaactgatgacttagaaaaacattttaaaaattattaaaaatgaattattttaaaaatttcaccttttaggggcctcaaatattggaacgattaaacaatttaatggaggcaattaagcggcgaaaaacggagttaattagggatcaagagaatggcttaatgccagaagatcatggcaaagcattgctccaaaattgtgaagtggacgacgaattgttcaacaaatttttgtatggcactgacattgaacatgaattgttgtccaagggtgggccaaactgtttgcacacaatttataacagtttggaaaaacgtcgcaataaaatggtattttttgttgatattttttaagagaccctaatttatttcaattagttgtaattaaacactaattttagcaaattttaatccaataaatcttctaaaaagcatcatttttctataacatatggaaatttttttgctctaattttactttttgtcattacatgccaggcgcttctaaaaccagtaaattgtaaatttttaatttaaaaaacttaattttgttcattttttatatttatattttttgaaaacttagtgaacaaaaaattatttaaacaagtttttattaaaaacaaaaatttccttagagggggtattgaatgttttgcaacccgaaaaagaggtgctaaaaagctcactaaatatcttaataattgaaactgataagtgtgattttgatgatttttttctttaaatcccatcatacatagaatagtctcgaaaaaatataggaaaatctaagaattttcattcaatttttgtaatttcaatttagattgagaaaagaccgtcattggtaaagatgaaaccaaatgtcagcataaaaattaatggatcagaacaggatagcgatttaatgcatattgcaaaaaatttacggccaataaaaacatcaaaaaatttgccaaatgaaaaaacaaaaaaagtggacaaaccgcataaaaaggacaattcgcctaaccgtggcatcaatagcccgacaaaaatgccaaagattgaccattacatttcgccaaaattggtcagcagcccatccaaaaagctcatcaatagcccatcaaaggttaaaataaagcaaactgacaaattaccgaaatgggacacttggccaaacaatggtatcattagttcacccaagacgacagtaattaacaatgtcaaattgccaaaatggaacacatggccagaaactgacagtaatggtccaagaaatgcagtacccaacgtcgacaatgtgcctaaattggacaattcacctaaacaaggcattaataatccactaatgacaagggcaattaacagtgataatgtgcctaaattggacaattcaattaaacaaggcattaatagcccaccaaaagaagggacagtgaaaaatgataatgcacagaaattgaacagttcgccagataagggcaaaaatgtgcaaattcgagtg

SEQ ID NO: 65433 - DNA, 277 bp, Heterodera glycines
  Genomic contig location: Contig_ID=SeqID_35985; Location=339..615; Strand=+
  SCN-specific regions: Sequence locations=1-170,192-277
ttcatttgccgtctcattgtatgggcgtgacgatggatttgagcacaaacggttgcgcaaacaagcggccaaaacgctgaaacaatttgagtctgatccggcacgtacagccgatgaccaggagaagatgaagcacatggtgatggccaatttgccatcggaccaagaaatgtccatgtacaaagacagcattgggctgtacgcggattattatgcggcaaaaagtggcaattttgttggcatcgcggaatgccaagcattgtccatacatttaaat

SEQ ID NO: 65434 - DNA, 300 bp, Heterodera glycines
  Genomic contig location: Contig_ID=SeqID_35989; Location=79..378; Strand=-
  SCN-specific regions: Sequence locations=1-300
atgtccgacaattcccaaattgctatccagcttcaacgaatggcttttttgctggacgaaaaagaagccggattggaaacaatccaaaaacttttggtcgccaaaaatgaatttttggaaaaaatcgcagctgatctgttggagcgacagaagattcagcatgcaatcgaatcccagcaaaatgcgcgtgctcagctactgaacgaaatggcgaacaatcttttgaccgctgcgagcgatttccaatttcatttggatttgcatattattggggaaaatcccccatcagaaagtccttaa

SEQ ID NO: 65435 - DNA, 3738 bp, Heterodera glycines
  Genomic contig location: Contig_ID=SeqID_7623; Location=1085..4822; Strand=+
  SCN-specific regions: Sequence locations=1-1020,1067-1075,1098 -1175,1215-1331,1406-1478,1500-2430,2452-2599,2627-3182,3204 -3256,3278-3534,3557-3738
  Gene Ontology: Mol. function=nucleotide binding; Cellular component =extracellular space; Biological process=peroxisomal long-chain fatty acid import
ctcctttttatggtggcaattgctctcagtttgatgctgcgcacttacgccgacgtttggatgtgcaaaatgatttttgattcttttttaaaaatttctttccctttttttcaggattcaaacgtccacaaaaattgaggcgtaagtttgggttttccctttttttgtttaaattttttttacaattaaatttgagtgcaatcatttcgcggcataagccccgtttttggaggtcgcttaccgaatatttgttgtgtatgccactcgtttcggtgatcaactcatttttgaaggtcgaataattttttgaaatttttttcgaaaaatttgtcccgttccctaaaattttcagtccaaattctcgaaaattctcatttaaattaccataattcccgacccttttagctgagtctttgcgagttgaaattgtgcttccgcgaacggctgactcaccacttttacgcgcagtatttggacgggttcaccttctacaaaatgaccaatttggacaatcgcattgccaatgcggaccaattgctgacacaggacgtggaccgcttctgcgagggcatcgtcgagctgtactccaacctttccaaggtgacttttcaattcacataaattcaaaaaaaacatattcccactcggtgcacttcgaaaggtcgcggaaggctatattttttgggtacgccccaaaaccttgccgcagaaatttaaaaaaaaacaaaaactttttattttttggattcacatgaatttttattttattttaatgggttgttatattgctatagtttttttaatctgattgttcatgccctcaggcaaggcactgtgctgtttgacatttgttgaagcagcgatctgaagttgcgcattgctattggctgacgtcgcagttgcagcagcgcactgttggcggcggcggcggcaccaatttgtttttcataaaaatcgtaattggatttttcttcgcgcgcaaaatcggagtcaaccggatttaggcgattggcaatagtgaaattattagaaataaacattttaaattcatataatttttatataactccgcaactttttatttttttttattaattgaatgaaacaattcaagtattagtagtaagagatttgtaatttttggtgagtcagctgtctcacttacaaaaagaaacatttttttttagatttaatgtaaataattttaatattatggctcaaatgtttatttaatttagtgcttgagcgtattcggaagtgtgcacgcattttggaccacgaccaatgatgtgccaaattgatgcgaaagacaaagatggtcgaaaatgatcaaaaaaaaattttttttttaatttttacatttttgtattattattttttctactattttattgttaaatattttcaggccctcaagcgtggaattaaataaattgaaattttatattgaacttgcaattgatgtcttctttttaggcaagacattaaaaataaaaatatgttggaaatgttagacaatttgtgaaatttctaaaacgtagagagtcggcaacttacatatagtgtttctgataagctcagaagtataaaaataattattgacttgtagaaaattgtgattacgtcccgtcctaacccaaaatgattgaagtgttcgatttttggtgtcgattaaacttttatgctgaactgttggcctacctccgcgacaagaacaactggaaaaaggtttcggctgtgggtggtttagccataaagctgcgccatgaacaatggcggccaaatgcacccggagcaagacaatggcgcactctcttacctgatgtatggtaatggagttgaccgaaaggtcacaaccatctttcggaagggcaaggaggtgctgccgttcaccgacgagactgatgccggccttgagcggttttttttgtttttttttgtaaaatggttcaaaaataaggttttttaacgaaattgtgaatggcccattgccgcaagagtggcgatatggcacacgctggtttgtgccagacgctaagaccaccgaaagctatcggctgattagtgaactgttcaattcctgtaatggggcatatgggaaaatggtttgagctgaagattttggtattttgagtggtaaaaaaattagggactcgacaaggatgccacgctcattcgtgggatctgcgcaccgcccgagaccagcctgttcgccctccaccgtgaggacgagcatgtccaccatttgaattacaactaaggaccgggtttaaaggttttttggttctttagttaaataaaaaaaaattttgaaaatccatgaaaaattcagttgtggctcttcattggcggggaattcgaacagcaggtttcccaattgggccaggtgctgttcaccgatcgttggcccaattgttcaaatccgcttggacacaatagtttctttttctcccctgcgcaactgcgtcaggcgggaattacctttgaattccacatccagcggcccggtgatgttgtgctcaccgttggcctgcattgcgggatcaatatcggagcttcggtttgccttgtgaaggagttgtgtagcccgagggcagcaaaacaatttaaaagtaaaaaatgggctccgacaatgacttttcaacaattttaatgatttagaagtgggggaacacactcgttgtgactgcaaagagcgggaagcctataaattcaccgaaaagcaaaccaaggagtatcttggtggaattaagtgagatgaattgtctcattcacaactaagtcaaattttaaagagccatggaaagcgaggccagggtcaaggattatcgcctgaaatatgagcaaagcggaaagcgcgtgcgggcggacaacgaagtgttgccagcccagcgccgtgctcagagggagaaacagaaggcggaggggcgagtgcccatcccgaaaaagaagggcacctcttcggtcatcaatttagacgagatcgatctcgaataatttcattgatttggttaaataaattttgatgttaatggttactgtgctactaattcacaagatctttccaagttctcgtcctcttcctaaggtcatactttcttggttccgtatccgttttttcattgacatttttctcctcatcggcttcaatttctggtcttgtttccggctctcgggcgtggatttcctctaaattttcgccttcccgggattcggggtccatttcatttcggattcacggacctttccgaactgacttcttccacattttgtgtcttttcaaggcactttttctcttcaactggttgtgttggcatagtgcagggagggcccaaaatttcgaaacactttttaatttggtttaagtgaagtctttttgggttcgaatttggcgaagtgcaactaatcacagtaacataaatgccatcaattttgatgacccgaaaaattcctcgccacggtaaatggaattttttggatgtgcctacccgtccgtcgtagtttctgatcagcactcgatcaccaattgtgatttgttgtggccttgcctttctgtcatattgttccttcatttttcgctgagcttttgcatattcatcagctgcggcgtgccacgcgtgtcttatggcaacgccaacttctgtttaaattcatttcggtccgaaattgctatcggatcacgaacctttgggtcaattatttggtctacacaaaaaattgggtcacgcccaaacataa

SEQ ID NO: 65436 - DNA, 486 bp, Heterodera glycines
  Genomic contig location: Contig_ID=SeqID_7623; Location=3135..3620; Strand=-
  SCN-specific regions: Sequence locations=1-85,107-486
atgcaggccaacggtgagcacaacatcaccgggccgctggatgtggaattcaaaggtaattcccgcctgacgcagttgcgcaggggagaaaaagaaactattgtgtccaagcggatttgaacaattgggccaacgatcggtgaacagcacctggcccaattgggaaacctgctgttcgaattccccgccaatgaagagccacaactgaatttttcatggattttcaaaatttttttttatttaactaaagaaccaaaaaacctttaaacccggtccttagttgtaattcaaatggtggacatgctcgtcctcacggtggagggcgaacaggctggtctcgggcggtgcgcagatcccacgaatgagcgtggcatccttgtcgagtccctaatttttttaccactcaaaataccaaaatcttcagctcaaaccattttcccatatgccccattacaggaattgaacagttcactaatcagccgatag

SEQ ID NO: 65437 - DNA, 1971 bp, Heterodera glycines
  Genomic contig location: Contig_ID=SeqID_7623; Location=4197..6167; Strand=-
  SCN-specific regions: Sequence locations=1-43,65-200,222-489,518 -826,851-852,880-880,902-1527,1550-1806,1828-1880,1902-1971
ataatgcctctgccttcacttccgaatttttcagagaattttgctccatgctttacattgacaaaaagtatgcctgtggcaaatgcggggtcacgggagcggatcccgatttgcagcacaagggtggggatgggtctaacggcaccaccactcagttttggagtgagtgaacctccttctcgtgcgccgggatcggtcccgattccaatcaccaaaatggggaggcgaagggaggggatgggcttcggatcagaggagttgatccgaccccgtacgaatttggctgctcttgacgacgcggaccctggggcgaggaatgcccccaaacaacgaaaattggcgatttccccaaagagaggggctcgtcccttaggcaaaaaggaacagcaaaccaaacaaccaaatttatttgccaaaggggaaagaaaatggcgataagagtaaataggtcaacagaaggcaaaattggggatcaacaaaaaaatggacgcagaaaaagagaaggagaagaaggaagcaggggggccctgtgattaaatagcccccgagcaaaatatgcaaaaacacgtgaataaggagaaaagtgggcatttttgagagacaaagggaaaaaggcatcgctgaatatgttggggggatcagagtacagaaaatggatgaaaagaggggatggcgggcagaaagataatggtaaacattttgagaaaaggatgcccaatcgggccgaacaaaaggaatttgaaaatgtgaatggatggaaaaaatgcaaatggggcgaagaaaagatggagaaaaatgcagatgtgaaatggtagacaaattagataatgagaaatgaaatggaaaatgatgatttaaataatagggagaaaaaagaaggggacgaaaaggaagggaaaagccagattggcgggggtttcgtcatctctccgatcttctgctccgaccgactgaccaacgggaatgttcccgatcatcaatggtaccacggcttcttcttcttcgggcccgagactcgtgggggtgcagtaaaccatgcgcctggggtggcccatcggttctcctcctcctcatcgattttacgggcattgtagtgcccgcccgagccccgggtaaaggacaattggcccgatccttcaccccaactctcgtcgcggtttcgcgacaatgcctgtcctcattggagtcaaggcaatgcgtcaactgaacgcacttttcggacatttcacaacatcttggccaaatatttcgaagactcagcccgacttcgatgaatttttggatgctgctaatttttgttacaacacgtcagtgcatgcttcaacgggtgagactccattttttcttatgtttgggcgtgacccaattttttgtgtagaccaaataattgacccaaaggttcgtgatccgatagcaatttcggaccgaaatgaatttaaacagaagttggcgttgccataagacacgcgtggcacgccgcagctgatgaatatgcaaaagctcagcgaaaaatgaaggaacaatatgacagaaaggcaaggccacaacaaatcacaattggtgatcgagtgctgatcagaaactacgacggacgggtaggcacatccaaaaaattccatttaccgtggcgaggaatttttcgggtcatcaaaattgatggcatttatgttactgtgattagttgcacttcgccaaattcgaacccaaaaagacttcacttaaaccaaattaaaaagtgtttcgaaattttgggccctccctgcactatgccaacacaaccagttgaagagaaaaagtgccttgaaaagacacaaaatgtggaagaagtcagttcggaaaggtccgtgaatccgaaatgaaatggaccccgaatcccgggaaggcgaaaatttagaggaaatccacgcccgagagccggaaacaagaccagaaattgaagccgatgaggagaaaaatgtcaatgaaaaaacg

SEQ ID NO: 65438 - DNA, 101 bp, Heterodera glycines
  Genomic contig location: Contig_ID=SeqID_35993; Location=510..610; Strand=-
  SCN-specific regions: Sequence locations=1-101
aaaattccctcaaaaataaaaggtcgattgcgcaccgccctccctatcatgctcgagagcatttgtatgtgtataaaatttatcaaaaaaagagatagcca

SEQ ID NO: 65439 - DNA, 379 bp, Heterodera glycines
  misc_feature (249)..(249): n is a, c, g, or t
  misc_feature (261)..(261): n is a, c, g, or t
  Genomic contig location: Contig_ID=SeqID_35994; Location=129..507; Strand=+
  SCN-specific regions: Sequence locations=1-83,117-140,169-292,314 -319,341-379
atgtcatcatccatcggttcgccagatacatttttccgttcagaaactgatcagggtaatagaaaaattttaaaagaattacgaaaaataaaaaaataattatttaaaataaaatacaaaatctctaaattttatcacaatcagaagcagcagcaggagcagaagaagtgggcaaatacgaagtgttcagttggcacggaaatttgagtgatcaattgtcagccgaattgttcgtcactgatcagcagntgctgaaggtgngcccttttgaatggacaaatgatcaaacagcgggaggggaggggaggccaaaaacagagaaagatttatggaaaatttagttcgaaatttccaatccgttttaaaagttttggaatga

SEQ ID NO: 65440 - DNA, 243 bp, Heterodera glycines
  Genomic contig location: Contig_ID=SeqID_35997; Location=1..243; Strand=-
  SCN-specific regions: Sequence locations=1-243
ccttaaaaaatcgatttttttcaaaaaatgatatatcaaaaattaatttgtaaaatattcaaatgtgattctaagcctattttggtcatttttatggcattttgtgcctatttcactttttacgaagaatttttttccaaaaaataaccattaaaaaaattttatttacatattttcctacatattttgaggatttttgtacatatttcatacatatttttagcattttttattacatatttt

SEQ ID NO: 65441 - DNA, 2355 bp, Heterodera glycines
  Genomic contig location: Contig_ID=SeqID_7624; Location=1..2355; Strand=+
  SCN-specific regions: Sequence locations=1-168,191-202,224-711,734 -794,817-966,988-1129,1152-1467,1489-1650,1673-1699,1723-1853,1876 -2105,2127-2355
  Gene Ontology: Mol. function=mRNA binding; Cellular component =nucleus; Biological process=mRNA splicing
cgatgcgcaattaaaagaacgactcgggctgccgtgtgcaaatgtcaaagaacttggaagtgtaccatgggacatcggagcgcatttgtttggtcaaggggaaacttgctgctacaatgattgtgtgagttggggagggagggtaattgttgttttatgattaccgaaaattaaattattttgtttagaatgggcgcaattttggaaaaaatccaggaaaaaattgacgccaaccacgcttctgaccatttcgacctgaagggattggaccggaccaaagaggttggatgacgagggcatttccaatgcgacttttaatttgttgcagatgaaatttgttgtgccaaacacttccgccggaatggtcataggaaagaacggcacgagcatcaaagagattcgggacacaacaacgggttggttcagcttgacatttgaccagcgcaggaattcaaatgttgtaattttgggttttcagcaaacatccaaatctaccccaaggcgggctctgaggaggccaaaatttcggccgagagagtgattacggttggccacgaatcgaacgaagttttactgagcgcagtgcaacgcgttctggaaaaagtggtggctgatccgatgcatgcgcagccagtcccagcggagagtcaggcgagcaacaaagggaccaaaacaatttcggaatttagttttattagggatattattaataaccaaattcattttttaaaaagataattcaataagaaagcatttaaatgcaggacataaaaagggcgtttcattatattaaatgttttctcctcactttgtcagttggcttcgggctttgaattcggcggatcgcggctcagtgccgggagcaatcagtttgggggaatttcaaacatgggcaacaattcgggtgagcagaaaccaaatgtgacattcgtgtgtcttctaaaacgcctttattttcagaagcaatgcatgggaaatcatttggagggccttccttcaaattcaatcccctccaggggacgggaaacaacgaggcgagtcattgttttgaatgacttctccattcagtgtatatttttctaaaccattcccgttcagctgttggcttttctcgacaatttgcagtccactttgcgctcttccggattcaacgaccaatcggtgtcagaggtgatgcaggcgatgcaagtgctggccaaatacaacataatggtcaattccatcaaattcctcgctgtgattcccctcatttaacgtgtgactttagggtcttggcctgggcctcggtgttgcggcgatggcccaaatgcgtaacactgagagtgcgatggcccagcagaatgtgctgcttggtgctgccgcatcgaatacgccgttgcaacagcaacagcagcgctacgatatcatgtcacagtcgaacatcaccgggtcactgttggactcgtcgcagaacattgaccaggtacaggagaaatttggcatttgatttttgcctttgcattcagtcaatcgttggaggatcgggcggtgttctgatcgatgtgatgagccaaaagaagtcgggcacaaatggaacgaatactttcgccaactccgtgatcaaagaacgcgttgtggaggatggacacactgaacttgaggtggacaggcgtttttcctatttctttggaatttgagcacttttgcataaaatgtgttgtttttaaattatttttattttttgcttgaatttttgacaataaatataagacagtttgttgcttctttgaattcaacaaaaacgtgtttttgggccacaattaaatcaaattatagaagttgattattacaacccaccccacccatctctttgatttttaatttagattgagtttcttgtattaattttcctaattttatttatttttattcctgctggcgttttcatattttttgtgttatgaatttatttattatttttcaggttcccgataacattgtcggcgccgttttggggcccagggcgaagacactgatcgaaattcagcagctgagcggctgcaaaattgaggtgcacaagcgtggcgcgaacaccgccagcccgggcggacgcgttgtgaggtcggttttggccaaatgtttgttccccgccggtgtttccctccgtgttgatcattttgacttggccattcgtctgatcaacgccgctttctttcatttatttgtcatgcactttccgatcatcacgctcctctctctcttcagtttaactggagacaacaatagcattctgaatggacgcatcatgatcgagaaagttattaaccaggaacagcaacgtcgttctatgatgggcaccgctcgctgagtgtgcct

SEQ ID NO: 65442 - DNA, 1183 bp, Heterodera glycines
  Genomic contig location: Contig_ID=SeqID_7624; Location=4466..5648; Strand=-
  SCN-specific regions: Sequence locations=1-652,674-1135,1157-1162
atgagacggaagagcatcgttggggagcaaaaggacgaggagagcgcaggctcaagcaaaggaagcggaaggaaaaaggtggggagaggggggggggggaatcacaaacagatggacggagcagtggaatccttcccaaaagaagtcaccccgtgcttcaactcatccaagacaaattatgaggagacagcctcatgtttataatagacgacctttgcaaaggattcggctgtgacgacaatcttatcatagaactatttaatacgaaagaaaaaaatcaagtaaatcaaatattgaatttaaatttcagggacgattcagcaatttggcccgtaagctcaacattcggaggaagccaagcattggccttcactccaaacgcctctctccggcgctcgcgccacagccaacgcctcgcgcattgcaaagcaaagtaaacgaattggtcgagcagaacaaattgctgacaggcatcaacgaagcgcatgtgctgactttccaagaattggccgcaaaaattaaggcaattttctcgatgcatttgcttaccatttattcccctaaacaccacacttttcagcaattggagatggaaatgtctgatcgtcaggctcaggaccgacaactgcgttcactgctcatcccaaccccaataaatatcacctgcaaaagacacgaaaacggcgagaagggtaatgatgcgttggacattatgtgggagaatgccattccgctgatgaattccgtggactgtgagtttttcagtttattagcggtttattgaaatttacaaaagcgtccctctgcttgtactttcagcttatgaactgttcctaaacggaaagcaatgcgactcggtcaaagccaaagctcggcgactgcgcattacggacttgaacccggccgaagacattaagtaaaagccgtttttttgacacagttcttgattttcccaagggtggcaattcgctctgtgtcttcgtcaatggatggtgttaaatcggcaacctccgaagttgtggtcgttaagcggtgcacggacgaggagggaaaggaaaacagtgcttcagtgattggccggccttttccgatcattaaatgataggctatctatctattgactcgcttaatgtgaaatattattctcacttagttttatcattgtttaaaaatgtaaaataaa

SEQ ID NO: 65443 - DNA, 194 bp, Heterodera glycines
  Genomic contig location: Contig_ID=SeqID_7624; Location=6105..6298; Strand=-
  SCN-specific regions: Sequence locations=1-194
aggaaaagccaaaagaacggagtcattcggcgatggacgggtgaggacggaatgaatggacaaataaggggtttaccattttgtagttgtgacacgaatcggacagtctcaacgcttgtcctaccgcctgtttcgcccacccgcaccgttattttgtccggcagcagtttcgacaccgtccgattgaatttctc

SEQ ID NO: 65444 - DNA, 260 bp, Heterodera glycines
  Genomic contig location: Contig_ID=SeqID_36002; Location=878..1137; Strand=-
  SCN-specific regions: Sequence locations=1-260
gtctcccccataaatctgggcgcatcgggtcgggggggactcctccaaaacaaaaaaaacaattttttcaagtgtccgtttggggtactcaaacacttatggggagcaaaaatcccccgcagaattaaagtacaggctatagggaagctattcccgaagggattcggtctccccataaatctgggcgcatcggttcggggggactgccccgaaaacaaaaaaatcgattttttcaagtgtccgtttggggtactcaaaca

SEQ ID NO: 65445 - DNA, 156 bp, Heterodera glycines
  Genomic contig location: Contig_ID=SeqID_36006; Location=358..513; Strand=-
  SCN-specific regions: Sequence locations=1-32,59-156
taagcctaaactttttggcttgtttaaaaaggaattaaaaatttttaaaaattttattcatatcccttttgatagaaaaagcatcagagagccttatttaacttttaattaacatttggtgcgtttcagagcactttctgaaaaaatatttatgaa

SEQ ID NO: 65446 - DNA, 200 bp, Heterodera glycines
  Genomic contig location: Contig_ID=SeqID_36006; Location=656..855; Strand=-
  SCN-specific regions: Sequence locations=1-39,66-172,194-200
aaaaagttacgcctaaactttttggcctgtttaaaaaggaattaaaaatttttaaaaattttattcatctccctttttgatagaaaaagcatcagagtgccttatttaacttttaattaaagttttgtgtgtttcagagcacgttctgaaaaaatacttatgaattaattttgcaaaaaataaataattaatgaaaaagt

SEQ ID NO: 65447 - DNA, 372 bp, Heterodera glycines
  Genomic contig location: Contig_ID=SeqID_36007; Location=967..1338; Strand=-
  SCN-specific regions: Sequence locations=1-372
cagtccgagcgctggacacgcgaaaggacaaatccgtccgacagaatacgctggacggtcttggggaggcgatgaaggtgtggtttttggcattcacaacacattttaatgcccaccaaaatttaaggaagcagcatcgaaagcggtgggcgccgagtcgaccttcggaggtgagagaatttgaatcggaaatgctcaatttaattaaccccactaattgcattttctgttcttttcagctattctgctgaaggtgtcacagacggagtccaaaatggcagcaggggaacgccaactcatccaatcggtcaccacgcaaaccttggcaagcctccggcacctcctggagaacgaactgcgcaccgtccaggc

SEQ ID NO: 65448 - DNA, 195 bp, Heterodera glycines
  Genomic contig location: Contig_ID=SeqID_36008; Location=735..929; Strand=-
  SCN-specific regions: Sequence locations=1-89,112-195
atgccatggcatgagtttgtccgttacttcaccgacatttgcgtttgccaactgctcacaatgggcacattgaccgaatgcaaacagccgcaacagaaacaggcacagagaggggtcagcttgaggaggaaacagctgagcatgcaactttcgaacgtcacaattgggctaacggagaagcggtggagagaatgg

SEQ ID NO: 65449 - DNA, 562 bp, Heterodera glycines
  Genomic contig location: Contig_ID=SeqID_36009; Location=330..891; Strand=-
  SCN-specific regions: Sequence locations=1-70,99-132,154-562
  Gene Ontology: Mol. function=structural constituent of cytoskeleton; Cellular component=spectrin; Biological process=neuromuscular synaptic transmission
catcatcagtgttttgtaattgattaatatttcatcatcagaaatgaatcaaataatttttatagacttgttaaaaaatatttttttaaattaattttccatgccaacagataatcaaagagcgcgagttggagctgcaaaaggagcacaggcgccaggaggacaacgacaaactgagacgagaatttgcacgacaggccaatgaattccaccaatggttggcggacacacgtggcgaaatgatggaagcaagcggatcattgggtgagtatggcaaaccaattatcccgagtggatgcctaattttgtagggccgtcgtaacgataaaagatttggaggggtaatcaatcgtttttttattccgcccaaaatttaaagcacataaatttttcaattctgatgaatgccttccgctgggaaaatagaatgtttaagagcaacaattggacacaatacgtcgcaatgcgcaggacatcaaagcacagcgggccaagctgaagaaagtggaggatttgggcgcactgctggaggagcatctgatcctggacaacagatacaccg

SEQ ID NO: 65450 - DNA, 93 bp, Heterodera glycines
  Genomic contig location: Contig_ID=SeqID_36010; Location=69..161; Strand=+
  SCN-specific regions: Sequence locations=1-93
atggggagcaaaatcccaacccagattaaagtacaggctatagggaagctattcccgaagggattcggtctccccataaatctgggcgcatcg

SEQ ID NO: 65451 - DNA, 125 bp, Heterodera glycines
  misc_feature (47)..(48): n is a, c, g, or t
  misc_feature (69)..(69): n is a, c, g, or t
  misc_feature (71)..(71): n is a, c, g, or t
  misc_feature (98)..(98): n is a, c, g, or t
  Genomic contig location: Contig_ID=SeqID_36011; Location=1069..1193; Strand=+
  SCN-specific regions: Sequence locations=1-125
atgcaagtgccgccgttgctgtacgctttagcgttgctgtgcaatgnnacgaaatttgcaaatcagaananacccaatattatcaggaatacactctnccatctcacccgtagacaaaccgaatg

SEQ ID NO: 65452 - DNA, 2687 bp, Heterodera glycines
  Genomic contig location: Contig_ID=SeqID_7626; Location=155..2841; Strand=+
  SCN-specific regions: Sequence locations=1-108,130-331,354-397,419 -443,465-586,609-635,692-851,874-927,972-1191,1213-1370,1392 -1519,1549-1686,1708-1759,1781-1881,1903-2412,2434-2657,2679-2687
atgatgatgatcgccagagatgccgcctactgtagcaagagggcggggccaggtacggtagtgccgaaatgggcgacactgcacaaaggagccgtaatgggaaatgataggagcggaagggacgaagagggcacgggagcaggcgatgccattggagggcaacagttcgagtgcaattcaaaaagtcgaatgcaattcggcacaacggctttgaaaagtgcgccgatttgccaacacttggccaagtgagaaaagttaatgggcaattcaaaaatggtaatgacaaaagtggaatgattcaccaaaactgagttagcatcaaaaattagtgccaaaaaagaaaaggttttaaggaattggttctggaatcccgacattttcactcaatattcgtgacaaaattttcccaaaaggttttaccaacagttcggcattcggcactttgttttggtgggagttttggcattttatgccgtgtttggcggtcttttgtttcaagtgataaatttttaaacaaattaattccctctttaaatgattccctaattaaggcgattgagaaggaaaatgaatacatcagcctaaataaaaacaaagaagctttggacgcaatgatcgaacaattggctaaggtcaatataagatttaaattaatttataatttttgattttttcgaaataaaattaattacagacggttaaactataaattaggactaattaactctctccccaacaaattagaatctcactgtgctgctaaatgttcagccatcggccgacaaaatgatcgcgatgcaacagctgatcacgtcagttactgtatcagtcacagtattccctgttacagcaatcaaaaattaaaatactgtaaatttcatttcagaaaagactatcaaatattgcttaaggtaaattaacgaagtttttatttatttatttatttattttgattttattttcaaagattgaaggcaaatacgtcggctcagtgttccacaaatatgagcacatcgtattccatctgaattggtgttttggaagctccatattctacggtaatgaaaaatccatacaattgtttacagtattattggttttcttcggtcatttaaattttcaaattcaaactttgtagcaatgacactcttcacgacaattggtaattagttttcaattaattgctaattatttatacaattaataatatgtaaaggttacggtaccatcgcttgccaaacgcctttgggcagaattgtgagttgaatcaaaaactttttcaaaaagatatttcccattaaattaagttatccatcttttatgcactgttcggtaattattaattaattagcatttattggccaacccaattaaatttatttgtttaattgccaatcccttttatgtattcctcttatgcttgtcgttctcagcgatattggccaattgatgttgtgctttttgacctgttgttacaatcgtctctgtgatataattaggtgaagcggaaaagtcggacaatttaaaattaattaattattaaattttgtcagtttttggctccgttcattggcttttcgcattttggaaattgacgaggaagcggcacaagtggccaaggagaagaaggcggagcagcaactgcataaactgcagctgaacatcaacactaaaaataccggagaagaagcagcgcaacaacaaaaacaacggcacaacgcgtggggtgccgccagagacacggcgcaaacgcaaaaaacagaagcagcagcaggtgaccaagcagggcacaatcacaataagctaattatgacgcactttagcagcatatttaaattttgtaacgaatttttcacaaaataaaatgaattttatttgtaggttttggggggcaacaaaaggcacggatgcacactaattatcatatgtttatctcttattaactcaaaagcttaattataccccaaaaattattctgctggtttctcgatgccaatttttgcctaaattggcagatttttactacgcgaccgactcggaaaatatgctgatcagtagcaacgatcaagaggaggacaacggcatcgatgccgaccgttcttcgtcgtcctctgccaccgctttcgatggcactttcgctgccggccaatccgccgccgatggtttgccattgttcgtttccgtgccgcttgtgctcctctacctgtgcttcatcgcgtttgtggtcagctgcttcgattggcccgaccaacggacgggcgacgacggaccgccactgtccttcggcgaagcgttttattttgcgtacggggcgacataatggcaaacaatgagatcgaaaaaagggacaagcatttttctgaacagcttaaatcctccgaaatccatggacttaatttagttttgtggtttttggaaaggtcgtagagatttattaaaagtgagtttttttgggggttttaaatccaaaaattggcagctaagtcaaaatctgttaagaattttcagctaattttaaaaaaattaacaaatagcactgaacagattaaaagtcttgtgcttatccctccaccgattagtgaatttgttgtttaaatgaaatgacttattaatcttttgtcattatttaaagatttaattgcgaccaaagctctaattaaattaaaataattagaatgattttttaa

SEQ ID NO: 65453 - DNA, 1202 bp, Heterodera glycines
  Genomic contig location: Contig_ID=SeqID_7627; Location=773..1974; Strand=+
  SCN-specific regions: Sequence locations=1-111,133-423,447-495,521 -726,769-1009,1062-1202
atgacaattggatgcgattttgattatgccaaaaatgcgcacgacgcaggaggcggtgacaataatgccaatgttgacactcgccaaaaattgagccggcataagtcaacttcaaacgtttggtggaggacagcaaaaagcctagaggccatttcgaacaattttggaatgaaaatgtcacgaaatttggctgaaaatgaagcaaaaaatgatgacattgaaatgcaacgagacgaaaacgaaattggcacaatggcaaaaagggaatacgaagcgaaggcaccgaccgaacggagaatatatttcaaaaaaggtggtcaaattaggcaagaaaaaagaaaatcaaagtttgtgaaaattgtagtaaaaattgtcaaaaaagagcaccagcagctgatcagagtcccaaatcatcctctccaacaccaacaatcagatcatttaaagtatccaaggaaccatgttttcagacatttttggccgtaactttgttcaaacttgacaaattttttaaaatttacgtgagctcatagaggactctagataatgaatcaaccccgattaatccagcaattccaaaattcgggtttgtggactgggatcccgactgcgcggggtaattaattgagtcccgggggcatttattaggaagaaacaaagctattttgtctaaaacccttgtgctatttttcaagtttgaagatgtacattttgtacaaattgcccttaaaaaattaaattaaaaaataataattattattattttaacagaaattgccgaaagtgcggcttcgagcagtacagcagcagcaaccactaattacaagcagatccgccgcacgcacagtgaacgcgtgtcgcaacgacggcgccacgcacacggcggcgcccagctgtacgtgatcaatgagggggagtcgcaccagcagacagtcgccgggggcgagcgactgttgcgcctgcggcgactgcgtcggcaacgctcgcgccaaaacgtgtcgccgttagtgcagcagcagcagcagcaacatggagacagcagtggcacggcatcagtggcacaaatggaaagcggcgatgagcggacacagcgatgttgcgacgaaagtgtagcatcaagtccgagcagttcaagacggttgcagatgcacgccgggccccaaccgccgatgggcgcggacaattcgacgaacggcgaatga

SEQ ID NO: 65454 - DNA, 389 bp, Heterodera glycines
  Genomic contig location: Contig_ID=SeqID_7628; Location=288..676; Strand=-
  SCN-specific regions: Sequence locations=1-64,86-90,112-153,343-389
  Gene Ontology: Mol. function=transcription factor activity; Biological process=synaptogenesis
atgggttcctttccgctgctgacaatttgctctatgattggcgttgtgcttttcgtcgtgtcaccaattcaaacacaaagttatgggtttgaccaaaatcaacagcagcaggggggcccaccaatgggaatgggcggaaacggaggaatgtccggaggaggaggaatgcccggaggaggaggaatgcccggaggaggaggaatgcccggaggaggaggaatgtccggaggaggaggaatgcccggaggaggaggaatgcccggaggaggaggaatgcccggaggaggaggaatgcccggaggaggaggaatgcccggaggaatgggaggtggcggaggaggacctggaggaatgcccggggggatgggaggcgatgccatgccattcgg

SEQ ID NO: 65455 - DNA, 841 bp, Heterodera glycines
  Genomic contig location: Contig_ID=SeqID_36013; Location=54..894; Strand=+
  SCN-specific regions: Sequence locations=1-205,227-438,462-657,679 -714,738-775
aacgattcctaaaaacgccagcaatttacccaaatcaattaaatgcattgaaacattacggaacaacattgcttgattaccttctcacgaatggtgaaagcaatttgtcgcaaaaattggtccaaatcgatggcatgccaaatttagtcaaacatttttgccaatttttgggctatggtttaatgaaagatgcagacccaagcgaaaatgatatcaaaattgagctgccagcagaatggaaaatattctgcaaaaaatacatggaaaagattagcaggaaaatcagtggttattccgaacaactcaaatccaattgtaactgatcagtgatcactagtgatgcaaattatatggaaattattccatttttcctggactgatgcaaggcatgaaacgaacgaaaaacattttttaagcttggtttgaagcttctagcatgggtttctgtaaacatatttttccatatttcgcgatttatttcgtaaaatttggtaaatttagaaaaagttgtatgaaataagtactatttctgccatagcttatgttaaatttgatagttttattaagttttctaggctaatagagaaaaggcttgcttattgaatggtaccaagaatgtaaaatttaattgcctttaagcaaagttatataccatgttttgccgaaaaattcgctaaaatggcggatttcacgaacgacccagcacggttataaactcttttgtggtttgtctatactattatgggttctatcctccattgtccatgtttttcgcttttttaaaatttattttttatctacaattaatttattttaattcaaaaatatataaattaaaaaa

SEQ ID NO: 65456 - DNA, 158 bp, Heterodera glycines
  Genomic contig location: Contig_ID=SeqID_36015; Location=1..158; Strand=+
  SCN-specific regions: Sequence locations=1-9,32-42,79-101,124-158
taaaaaatatttatgaaaatgtttaattacattgcttttaagtttaaaatacaaattttcttaataatttttatttatgaaagcccaaaacatttgacgttaaaatgaatgggtaaaaatggtctttttttgtgcatttctcatcaaaataaagctgc

SEQ ID NO: 65457 - DNA, 48 bp, Heterodera glycines
  Genomic contig location: Contig_ID=SeqID_36016; Location=702..749; Strand=+
  SCN-specific regions: Sequence locations=1-48
atggcgattgtgcacagccctccgtctctacgcaagcgcttttgtgag

SEQ ID NO: 65458 - DNA, 676 bp, Heterodera glycines
  Genomic contig location: Contig_ID=SeqID_36017; Location=56..731; Strand=-
  SCN-specific regions: Sequence locations=1-366,399-536,622-676
atgtcgtcaacgcgttcgcgacgttcgggaattgtggattcgggtgggctgaacccatcaacgattcatttactcccaatggcaagagtcaagaaagaattagaagctcgcggtgcgcattctttctgttattaattagttaatggaccttaccattaaactttcagggctggatacaaaaggcagtgcagctgatttggcttttcgtctccaagaatatgttagacttgcaggaggatttgtgtcaaaattcgatccatcgcccgcctcagaaccaacaacacctctcaaaaagcgaaagaggaaggttcgtttatctgcttctttgcgcaggcaatttaacatttatagttacatatttacaacaatttttgtctttcttttcttattttgacacaatttttagcaactcgatgttgaagttgatgagaatgttgctggctttgatagacaagaagcatcttcgccagttgccgccaaaacatttcgacacttttcttgggcaattgcacccccaacggcgccacaccccgcgaaagaggcgaaaaaagaagaaataatagaaagcggaaatgaggaggaaagggacgaagaggaagaagcagaaaaagagcaaaatgatcaaattcaaattggacgaaaaattgaggaaaccgaacggcagcaaaagacgaaa

SEQ ID NO: 65459 - DNA, 690 bp, Heterodera glycines
  Genomic contig location: Contig_ID=SeqID_36018; Location=232..921; Strand=-
  SCN-specific regions: Sequence locations=1-635,657-690
  Gene Ontology: Mol. function=RNA binding; Cellular component=polar granule; Biological process=pole plasm RNA localization
aggaaaaataacaccgaacagacgcatcagacaaacatttgtccttgccgaaagtgccgagaaacggcacacactcgtccgactgttgcaactcgagaaggaacagaacgaacaattggaccgtatgtggattttgaaacagtacatgttaaaaaggccgatttttcaggttcaaaaaaacttctcagcacgatggttttcgtcaacacacgcaacgatgctgaaattgtgtgtaattttttgaattctcgcggattctcagcgacgacaattaatgggtgcgttctctcattctctgaagttcgctgcaaatacttttagtcgacgtgaccaaccaacgcgtgagaaggcggtgtgggacttccgaacgggcgaattccaaattatcgtcacgacggacgtttgtgcccgtggccacgacatcaaaaatttggagcgcgtctgttaatctaccatttattaagagggtggagggggagagtccaagactaaacgaattatcggatggtcaatcatttgtgcaaaccatttcaggtgatcaatttggatttgccttgtgctgacagtgcggaggatgcctactacaaatatgtgcagcgtatcggacgtaccgggcgaatccaacagggaatgtccaccacattcttcgacccggccactgacatggatcttgctgcacttctcgtcgag

SEQ ID NO: 65460 - DNA, 535 bp, Heterodera glycines
  Genomic contig location: Contig_ID=SeqID_36019; Location=264..798; Strand=+
  SCN-specific regions: Sequence locations=1-454,476-479,501-502,531-535
atgtccaaaactgcgaaaagaacgatttcaaaaaatgggacggacgaagaaaaactcaaatggacatggctattttcaaggataaaggtattaaagctgggatgaatgtactttaaataaattccaattacgatcaacctatttcgtatttaccgaggtctttaaaaataccgtaacaaaatccgtcgtggtatccaaaaaaccccacttaatttccgtgtttcagcttgacgacgagctgtttcttacttttatcaaagaacaaacaaaatttgaggaaatttgtagagaagaaggagaagaattatggacgaaaattggcttgttatcaaagcgaaaaggcaagggcacatacgatattggggatacggtagaatatttgacgaaacagtacgaaggttatcttggtattttgtatttattgaaagagaaatggcaatgtgacggaatcacggagaagcaaaaaagagagaaatgtgaaaagtttcagaaatatgttgagattatttttattattaataaaattattagctaa

SEQ ID NO: 65461 - DNA, 199 bp, Heterodera glycines
  Genomic contig location: Contig_ID=SeqID_982; Location=1191..1389; Strand=+
  SCN-specific regions: Sequence locations=1-99,121-199
atggtgtcagtgggatttccgaatttgaaacttggtgggtgtgtaaagcacccatggattcttaataaaaaaaaatatccgagaaattatattattccaaaatataaaaagacaaatttgcaattataattttattttttcaggtttttagtacgaatatttgacaagaattctcataactaataccgtatataattta

SEQ ID NO: 65462 - DNA, 408 bp, Heterodera glycines
  Genomic contig location: Contig_ID=SeqID_982; Location=1506..1913; Strand=-
  SCN-specific regions: Sequence locations=1-95,118-121,165-310,333-408
atgcgccgttttggagctggtggtccaagaaatcggtttgaagctgatgctgttccgatgacagatgcgattgagctaaaccaaaagaattatggtttatttatatgaataaacgtaggggaataaaataaattaaaattatattaatttattttttttaaattgcgatttaatgttatagagagttttaatctttttttggcatgtgatggttttgtttattttgcatgccgtatttgccctaatactaacatttattattctacatttgcagatcgacttttgcggattaaattgttaaataagatagtttattaatgaattttcaaaaaatttcaatactccaaagaaaagtgtttaacactaaaaaatcttttccatgtgtcgacattaacgtatcttaataaa

SEQ ID NO: 65463 - DNA, 1190 bp, Heterodera glycines
  Genomic contig location: Contig_ID=SeqID_982; Location=1964..3153; Strand=+
  SCN-specific regions: Sequence locations=1-143,166-578,600-804,846 -869,904-992,1014-1105,1130-1190
atgattaaggacagcagccagcaacaaaatgtcaagctgtacattcacagcggctgtaattgctccatggtaaggaatttcaatcacttttattaatttggatgtttttacaatgattaatttgtatgacattagttaattagctgtttcgttccattattttttaattggtgcacctttcagttcatcaaatcgcttaatcctcatgggccattcactatggtgattgtggaaaagcaatgcccatcattaccgattgatcaggctttttcggttggccccactgatcgcccatcattaccaattgaccagactttttcgattggccacactgatcgcgtgccaatttccgtctcattcacagcattgactgatgccaacatcaatagcatggcggtggaactgctaattgcctccgatggtggggcacatgaggatttatggaaatagtgattaatttggaatgattttattatttccttagatggaaataatcggcaaataattagatttgacattggcacggacagcgatttgacagttcatttggcatcaggggtaattaaaattgcaaagctaatgctgttaatttgggaatttaattgattttttagatgaaaaatgagtttatcagcaaacacacgcgactggccaagggatcatatgaattgaaagtggaaattgagctccatccgtattattatgtgatcataatgaacggcaccaaaatgggcataaagtattggcccaaacaatggtggaacgaattccaatggctcggtgtcaatcagattaaggtgttgcttatttttaaaatattctatttttatttaactaaattttttgatttgcatttgatgaagaaccactttttttgttttaaatttttttattattttttttcactaatgctaatgcgagaattatttgctgttattaatttgtcaatactttctggtgtatatcagggatggcacggaattccgacttaaaaaagcccggaaatttcggaatttctttttcaggtcggagttccatttgtggaaaaattttgggcctcggaatcccgaaagtttttggggcctcagaatgccataccgaatatgcgtggaaccaaaggcattttccaatccgtgcaaatttcgactgagctttgggcaaaatcactggaacaattctttacattttaa

SEQ ID NO: 65464 - DNA, 743 bp, Heterodera glycines
  Genomic contig location: Contig_ID=SeqID_983; Location=85..827; Strand=-
  SCN-specific regions: Sequence locations=1-49,71-107,131-383,426 -570,592-743
  Gene Ontology: Mol. function=glycoprotein 3-alpha-L -fucosyltransferase activity; Cellular component=Golgi trans cisterna; Biological process=protein amino acid glycosylation
atgccaatccggtccggtccggcagaattggaaatctcggtctctaataaaaagattaaaattggttttttacattaaaatgggacattacttattttgtcaccatgtaaaaaaataatttaatttatttgtttttacaaaactttgtcagtcacataactcggcattcatgcttatttagaagaaataaaaaacacttttcttatgaatccataggtactgtatctacccaccaaattttcattcggaaaccccacggacacccggggaccttcctttgttagtacctcgatagctttgtggtttcctttgttaactcataaattttaaattcattaagttataaaaagctattgtcttaaaatctgaaattctcgatttagaattttttattgtaacattaatttttaaaattatatttttttctagagaaacttaaagctatctccttgtatccaaggattaattacgcacacaataaaatttgatcgattgccctccccccattttcagagtcccactttttttatttggctttcgaaaatgccgtctgcacggaatatgtgactgaaaaattttggaaggcattacgaaatttgatggtgccaattgtgttgagtcgaaaagtgatggaagaagtgggcattccgaacggcacttttattgcggtggacgactttaacagtgtgaaagcattggcagattatttgaagattaaccaaagagaagaaaatgcattataa

SEQ ID NO: 65465 - DNA, 1596 bp, Heterodera glycines
  misc_feature (1585)..(1585): n is a, c, g, or t
  Genomic contig location: Contig_ID=SeqID_985; Location=1002..2597; Strand=+
  SCN-specific regions: Sequence locations=1-264,286-426,448-645,669 -972,1000-1018,1073-1206,1236-1329,1373-1562,1585-1596
atggtgccaattgtgttgagtcgaaaagtgatggaagaagtgggcattccgaatggcacttttattgcggtggacgactttaacagtgtgaaagcattggcggattatttgaaggaattgcaaagggacacggacaaatacatgaggtaattaggtggaaaattagggaaatgattgccaataagggttaattagagagaaatgattataaatgagtgtaattaattaggatgaggaaagtcgtgtaaatttgtgacattcttagctatttcaaatggacgaaaacgtaccaaaagcttcggagtgggaatggcattcagccgccgttgtgccaattgtgcgaaattgcgcacaaacaacgacacaaggacacattcaaaacatacgccgtacaattggacaaattttggcctaaaacacaatgcgaaccaaattttgtgcaaaaaagattcaaggatctctgacaaataggcgaaagagacgaagaagaagaagaagaagcggataaacagatgaaattggataacaattaattaaccaaaatttaaatatttttttctttgataattacaatttttcttaatgctttttgttatcatataatttttgagctttttaaatgcaacattgctgtttaatcccgtcattaattatttatatattaaaatccagtaaaacagataaattttatatttgaaagttttttacgcaaatcgcaaaaacttggattttaaatcccaatctcctgggttttcatccccgatccaagtcttacgaatcccaatttccagttttgtcatcccgctttccctgctaatcacaaattctatttctgacttatattgttcgtgataaaatttgatactaataatttattagtaataaaaatgggctgccgagtgagtctctttcagtcagcaggctatacaaagcttggtttagcactcggagtcgaagctcgaactttttcgcatatttttttaaataaatttaaattatgcctttcaaaaaagtaacgaaaatattttaaattattattataaaattctataaaataaatgaaattttttaagcaaatgaattaattgtaagtttaggaaaattgataaatatagggtgtgcaaccagcagcagaagaggagccgtgatagaataagcacgcggtgtgaaattgtttagaagattagcaaaaattacctttttctcaaaataatttaattacttatttattttttctcacattttgagacaacaaataaatgttaacaaatgaagaaaaatagatttttatacagtaaaaaaatttataaaaacatcagaaaattcaacaaaaaaattaattatttttctttacaataaaaatttaaaaaaacttacaacatcttcgattcccaggacgaaaggcccaacgttgcttaacttgacagatcggacgggatggcatgctttcaacgtgatatgtcgtaagcgaaagtgctccatttgaaagcaattaaatagtcaattttataatgcattttcttctctttggttaacctaatgattaatctaaacatggatagttaaagaatttaaattcacttanataaggtaaaa

SEQ ID NO: 65466 - DNA, 434 bp, Heterodera glycines
  Genomic contig location: Contig_ID=SeqID_987; Location=333..766; Strand=-
  SCN-specific regions: Sequence locations=1-434
atggaaaagccattcaaccgacgcttcggagcaaaaccgagatttttctcagtcggagaaaaggtttatgctcgtcaccggctgtcccaacaatggagagctggacatgtcacgacttgcaaaggagtgatgtacgacgtggagttcgtgaacggatcaacatcccgtttccacgccaaccagctgatcaagagggaaaccgatcaaatggacactgatccactggacgtgtttaatgaagaatttggtttgccaaacgtggcacaacaaccaaaccagcgcccaaacgtggccgtgcttcaactaaatattgtggacaatgctgagccagcaaatgatccaccacctgtcgaacaacagccattttcgccaattcgtcctcgacgacagtaccctcaacggaaccgtcgtccgcccgatcgctactcaccgaa

SEQ ID NO: 65467 - DNA, 1229 bp, Heterodera glycines
  Genomic contig location: Contig_ID=SeqID_988; Location=1276..2504; Strand=-
  SCN-specific regions: Sequence locations=1-26,49-482,509-654,677-1229
atgtgcgagaagcaccaggcctgggtcaagaaatatttggcaaagaatgccaaccaacggaaacaagtcaattatgttaggcttggagggttgaagattaacttagttaatcaacccaaacgcctgatcgaagcgcccgtcaacgtcgatgggaacgcaatcgaattcgtgatggacccgggtgccgaaatcaccgtgctgaacaaggaatcgcatcgattagttggcactcggctgagctcctgcagtgagcaggcattctatcacgacggatcccaatgccgtttgtttggcaagggaacagcaactttttcgatcggagggcgtatgacaaaaggaacattttatgtatccgacgaaggatcattaaaccttttggggatcgatatgctggatgctttgggtctcatggactcatttcggacgaatctgacagatgttttgaagctcaacaatgtccaattttcggaacaggattcgactttggaaatttttaaagaaaaattttctcatattgccgacctcgtcctgtgccatacaacaccaaattggtggttgaggccgaattggaccggctaacggaactcggagtcattcgtccggtggaacacactcgttgggccgcacccattgttgtggtcaaaaaggccaacggttccacgcgcgtttgggccgacttttcaactgggttgaacagtgcacttctgttgcatcagcaccccttaccagtgcccgaggacatattcgcgacactgaacggaggacaagtgttctcacaaatcgatctcaaagatgcgtatttgcagattgaattggacgacaattcaatagaattgtgcaccatcgcaacgcatcgtggtaactttgagtaccaacgacttccttttggggttaagtccgcccctggaatttttcaatccattatggattcgatgttggctggctgtaattgcgcaatcgcatatttggacgatgtcatcgtggtgagcagatccgccgatgaacaccaacagcatttggcaaatgttttccaacgaatggaaaacttcggatttcggatcaagccagaaaagtgctccttcttccaaagccaaatcaagtatttgggctttattgtcgacaaagacggaagaaggccggacccagcgaaaatccaagccattgctgaaatgccagtgccaacaaatgtttcggaattgcgttcgttccttggaatgatcaatcactag

SEQ ID NO: 65468 - DNA, 384 bp, Heterodera glycines
  Genomic contig location: Contig_ID=SeqID_7629; Location=461..844; Strand=+
  SCN-specific regions: Sequence locations=1-42,65-285,309-384
atgaaccgacggtaaaagaattttaaaagtctaaattcagcattatttagctaaactgttttcctatttcagttggatttgtaacgacgtttggatggacattttcccatcctttgaccatgctcaactcggcctcaaattggcacttctttcgccacgtttcaatgcgttggtggacaaacatttcaatggcaaaagcgaattgacaatttggagaccaatcgaaattagcaaggacaaaggaccagaaccgaagctgattgtacaaatggatgacaaatataacaaatttatggaatttccattgccggaccgtccgttgcccagcaaaatccgatttaagcgccttcgaatttagtaattaaaaatcagagagctatgaca

SEQ ID NO: 65469 - DNA, 1021 bp, Heterodera glycines
  Genomic contig location: Contig_ID=SeqID_7630; Location=2365..3385; Strand=-
  SCN-specific regions: Sequence locations=1-28,55-505,527-621,730 -740,809-824,847-851,1004-1021
  Gene Ontology: Biological process=N-linked glycosylation
atgatcgacttcatgcggcacaaaaaggaaagcacaacaacagcaacaacgaaaatggaggacggcggcggcagcaggggaagggtactgtagcttgggatgggtttttgtaacaataatatactgtagctagttggcatacagtaagcggtgggccttttggaaaaagttgctactggatgtgcgccagtgggaatgcaggataatctgttgtaagacaatccgccgtcggttatggacaatctgtcagtggacaatccgtcaacaaattttttttttaattctctgacgaaatgtcctttgacggaacgtcagtctactgacgaattgtccttcactgatgaattgtccgtcactgatagaattgtcttccgaaagattatccactgacggattgtccggaatccggataccgtcagtggtgggaccgcattccgggagctttttgcgacggaattacacattccggcatttatggcttgccgaacacctccatggcatacacatttaaaaatggcattttaaggcgaaatcaaaacattcaactggctccactgctggtggtggactatcagtgtcggcgccaaacaatcggaagaaaacaccaaatcaacaacagcaaaaaggaaacagcgaagggggaggagaaggaagagaaaatggggggaaaagagaggaaaagggaggagaaaaaggagcagcagcggaagcagaggaaaaggaaaagaaagttgcagttgaacatcatcaaaaacaacaacaacaaaagcaagaagttcaagcagtacagcagcaacaacaaaagcaaattttggtgggaatggagatgaagatggataacagcaaaaatggagaaacaagggaagaggtggaaaaggaaggaaatagcactggggaaggaggagagacggaagagaaagagaggaaagggaaaaggaaaaattcggcggaaggaagagaagaaagaggagagaatgaagcagaaaagagagaggaacagcagcaaattgacactttttaa

SEQ ID NO: 65470 - DNA, 863 bp, Heterodera glycines
  Genomic contig location: Contig_ID=SeqID_36022; Location=145..1007; Strand=+
  SCN-specific regions: Sequence locations=1-796,839-863
gtaacaattgacgatgaaatggctaatcaacgaggaatgggcgatttttacgattcggatgatgaaactccgcccgaaaataaatcggaattgaatgacagacagcacaattttggagatgaattgggcggagggcagtgggacggcaattccgaagggaatggcgaaagggaaacccgcgcgcacgaagcggccaatggttacgcatggactgtggtgcgactggcgattgtgcgacatatccaacacaaattgcgcaattttgtcgagatggtcggcttcgacttacagggcaagcaaataaccgaccgaaaaaaaaaatatttcggaaaacgcacttaccgcacaacttattgttagtgttgcagcaccaaaatgactcttgataatgttacaagtggaaataactgtgtattttcagaacaaagtcaaatggcacaaaaatttaaagaattccttgggtaataaacacaaataaaagcgctaaaacagcttcaaattgccaaatggctttcgtggttttttttttgtttgcttacaactagaaaacagccaattccgttctctattgcggtcatttcaaaccccaatttataatttgcgtttcagagattgcgcacctttcccctaaacttaacctcacaatgaagcggttcaattcatgggcctcccaattggagaacgaactcgagggatggaaggacggatgtccctgcgactttcttccgaatatgtcgccaatttcggttttccgcagggcctttatgctaatgtccaatgtcttaaggatgcaaatgactcctcttccctctcctcttcttcctcctggtcttcgccactccttcacaaatatcgcttgctaa

SEQ ID NO: 65471 - DNA, 399 bp, Heterodera glycines
  misc_feature (16)..(16): n is a, c, g, or t
  Genomic contig location: Contig_ID=SeqID_36023; Location=162..560; Strand=-
  SCN-specific regions: Sequence locations=1-201,264-377
tacgtaaatgatttcnaatcggtacatgacgtccttgtggttactgtacttcccggcatctatttgctttttgcattgattctgttcatgaagagtcgcataatcaaggacggaccaccaccaatggttcacagaaaaaggcgtgtaaaatgaattaaaattgaaattttaagtaaaggatacctcctaaactttttatccaattaaaaatttttaatttaaaattaattaaaaaaaaattcagatttttgtccaagttgttttgatcagcagcgtaaatgcaattgcttcaggaatttatgtggtcatgcaatttgtcccgttaagcgaatttctgttggtcgctggccaattttattggattttggcgcatggtaaaagaaattaaattttaataaa

SEQ ID NO: 65472 - DNA, 240 bp, Heterodera glycines
  Genomic contig location: Contig_ID=SeqID_36025; Location=76..315; Strand=-
  SCN-specific regions: Sequence locations=1-240
gaacaattgctgaagttattcaacgtcgtccaaaggataattttctccgcaaaaaacggacgcctcgcgggcgaagtgacagcaaaagcattgcgagcacttttgggagtttcccttttccaacggatggcactcgtgccggaaagcgctctgaggtggtttttcaacgggtaccatccctgaaaatcgaaattggggcagggaaggcaatggcatccgatgaagatgccacggcactta

SEQ ID NO: 65473 - DNA, 660 bp, Heterodera glycines
  Genomic contig location: Contig_ID=SeqID_36028; Location=174..833; Strand=+
  SCN-specific regions: Sequence locations=1-596,618-660
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggagtagcttccctatagcctgtactttaattctgcgttggatttttgctccccataaatgtttgagtaccccaaacggacacttgaaaaaatcgatttttttgttt

SEQ ID NO: 65474 - DNA, 59 bp, Heterodera glycines
  Genomic contig location: Contig_ID=SeqID_36029; Location=187..245; Strand=+
  SCN-specific regions: Sequence locations=1-59
cacggcaccgaaccttttggctagtcagcaatcgttgcttaacttgccagatcggacgg

SEQ ID NO: 65475 - DNA, 386 bp, Heterodera glycines
  Genomic contig location: Contig_ID=SeqID_7631; Location=440..825; Strand=-
  SCN-specific regions: Sequence locations=1-386
cttgttaggccgctttgcagcctcagtcgggcgcttcgccggtttttcaatttttgttggccttggacgggcgcttcgcgcccgttttttaaattcgttgaactcatacgggcgcttcgcgcccgttttttagcttgttaggccgcttcgcggccttggacgggcgcttcgcgcccgttattcaaattttgttggccttacagagattagaagagatacaacagtgattaaaagaggtacaacagtgattagaagttagctcttgttgtggagatttggaatttttttaaaattatctgggacttttaggccgcttcgcggcctcgaacgggcgcttcgcgcccgttttttaaattttgttgggcttatacgggcgcttcgcgccc

SEQ ID NO: 65476 - DNA, 209 bp, Heterodera glycines
  Genomic contig location: Contig_ID=SeqID_7631; Location=914..1122; Strand=+
  SCN-specific regions: Sequence locations=1-209
aaacgggcgcgaagcgcccgtctgaggccgcgaagcagccttaatagcccaacaaatttagaaacgggcgcgaagcgcccgtctgaggcctcgaagctgccttaatagcccaacaaatttagaaacgggcgcgaagcgcccgtataagcccaacaaaatttaaaaaacgggcgcgaagcgcccgttcgaggccgcgaagcggcctaaaa

SEQ ID NO: 65477 - DNA, 393 bp, Heterodera glycines
  Genomic contig location: Contig_ID=SeqID_7632; Location=1608..2000; Strand=+
  SCN-specific regions: Sequence locations=1-393
atgattgtactctttttaaccattgttgtaccattccaacaatttttgtacctctccaacaattattgtaccttttcgacagtggttgtacctcttctaatcacttttgtagctcttttaatcacttttgtacctcttctaatcaccgttgtacctcttctaatcacttttgtagctcttttaatcacttttgtacctcttctaatcaccgttgtacctcttctaatcacttttgtagctcttttaatcacttttgtacctcttctaatcaccgttgtacctcttctaatcacttttgtagctcttttaatcacttttgtaatttttttttacttaaaaattttcattatgtattttttgaatttgcaaaaaaattaatttcatttcaaatta

SEQ ID NO: 65478 - DNA, 841 bp, Heterodera glycines
  Genomic contig location: Contig_ID=SeqID_36033; Location=487..1327; Strand=+
  SCN-specific regions: Sequence locations=1-11,77-91,113-120,142 -195,245-340,362-464,490-806
atgaaaagaagtatattaatttttttaattgtgaaaaactaaacaaaatcaatttttttaaaattactaaataataggaaaggtgtgaatatttgaatttttagaatttgtcggaacactaaataaaattcacttaaaaataagtacccaattaataggaaagttttgcttattttttttaatttacaaaaaccgattaaaaaataattactcaaattaatttaaaaaaaaatacttattaaatcaaatgaacaattttgcaattaatatattagtgtatatatagcgcgagaattaaatggtgtgattgggttggtggaacaaacgttcaaacacttcgtcattatcattatcattatcaccgaaatcgccggcagtgggacgactaatgagtgagtgcacgacgacctcgtacagcactcactctccaatcggcgtaacaaaaatttgttggttattgaaggaatcaattaattaactaattaattagcagcagcaacagcgccgctcattaattttgtgtcgtcactaattagtgcggggaaatgggacgatttgcccgcaaaaccatttaccaatcaccccttctgtttggtgctactactcgccaaattctgtaatcacgaaaatgtcttcttctttttgggtaacacgatgggggtacaccacaagaattagttaaatattataaaagaattattaatgtgaaaaatgcagggcagatgacattcactagccacaaacaaggagcaattaaaaatagttggaggttggaaaatgatattttttgttttcagatccccctgaaaaatatatttttgaaatgtataataatttataa

SEQ ID NO: 65479 - DNA, 823 bp, Heterodera glycines
  Genomic contig location: Contig_ID=SeqID_36034; Location=116..938; Strand=-
  SCN-specific regions: Sequence locations=1-141,164-382,404-552,574-823
atgcctgttccgacaaacgtgtccgagcttcgatttttgggcatgatcaaccattaccaacgattcgtgaagaacataaggttcatccaacagccgttggacgaattgttgaagcaggacaaagtgtggcaatggtcggctgattgtcaaaatgcctttgagaaggtgattaaaattttgaaatctgatcaattgctgacaaactacgacccggcacaagagatcagtgtatcggctggtgcttctgagcatggaataggagccgtgatctctcatcgcttttcggatggaagtctaaaagccatcgcacaacagcatcgtcattgtccatagcaaacgaattattctcaaatcgagaaggaaggcttagcgattgtctttgccgttcagaaataccacaagtatcttcttcgggagatatttcattctgcatacgaaccacaaaccactgttgtccatttttggcaacaaaaagggaattaaggcatgcactgcgaatcaattgcagagatgggcaatcacattgctgggctatgacttcgaaatcgaataccaaaatactgctgattttggtcaagcggatattttgtctcgccttatcgcgaagactccagtgctggacaacgaagtaatcattgcaaacattcgtgaaagcaatgaaacaggagttctgaactttgtttcaaagactcttccgttgggcacaatgatttggccaaggccgcggcaaacgataggtgatcaaaagtttcatcgaattccgccactacgatggacaatttgcgctcactttgtgccagttacggccttcccgaaattttag

SEQ ID NO: 65480 - DNA, 535 bp, Heterodera glycines
  Genomic contig location: Contig_ID=SeqID_36036; Location=241..775; Strand=+
  SCN-specific regions: Sequence locations=1-219,241-343,365-535
atgacaaaaattaaggaagacattggtgaagcatttgtctggatttcagtggacgagactacggataaaatggggcgaatgatcgccaatttgttgttaggcaaattgtatggcaaaaaatggcaccccccgcatttaatttctgtgaaagcgcttgaaaaggtggacagtggagcaatggcgcgttttgttaatgaaggccttggtagtcgtttagcttttattcctagatattttttaattttagacagttttctgctaatattaagaaagagcgagtgctgtttttggttacggacggggctgcgtacatgaaaaaggccggaagacaattaaaagttagaaaaaagaaaattcaaataaattttttctctttttcaggttttttacaccaatttgttgcatgtgacatgtttgtgtcacgcattgcaccgcgtggccgaaaaagttcgtgacgagtttgcgcaagtggacaaattgataagcaaaacaaagcaaatatttctgaaagcaccgcatcgcctttctgtatatc

SEQ ID NO: 65481 - DNA, 562 bp, Heterodera glycines
  Genomic contig location: Contig_ID=SeqID_36038; Location=461..1022; Strand=-
  SCN-specific regions: Sequence locations=87-128,163-197,271-384,408 -439,496-496
cgaaggatcaaaaagcgacgtcgctatggacgcttggcctccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 65482 - DNA, 466 bp, Heterodera glycines
  Genomic contig location: Contig_ID=SeqID_36045; Location=25..490; Strand=-
  SCN-specific regions: Sequence locations=1-357,379-466
gttgtgccacctcattcatttctgaatctttcgcgcggaaggccaaccttttgggcaacattgaccgttccaattgcgagacaatttatgtgccgatttttggaggtgccaaagtgcttggctggtgagtggtggacaaaaaacaccatcatttgttttttttttatgagggggtcgtccgtttcagggatttcttgaattttttgaaaaacagtagttcgtcataaaaaaaattcataagattttttttagaatttgttggaagaaagactttgttttaaaaattactatttcttctaaacgtgtttaaattagaaaaaaatttttttcgaaggcatggcttaaaaatatacacttgatttcttttcacgtttttcagggctaacgatgttcaaattcgaattgatgagctggattatcaatttgtgtaccgtttgggggtgatggaggacaaacatttgccgat

SEQ ID NO: 65483 - DNA, 692 bp, Heterodera glycines
  Genomic contig location: Contig_ID=SeqID_36047; Location=17..708; Strand=+
  SCN-specific regions: Sequence locations=1-85,107-110,132-242,264 -346,368-692
cgcaactaaaaagtccgacagcatttcaactcaaacctcaacagccttctaaacctcaagctccgccgtcaggctctccaccccgttttgaagaaacagaacatcaacagccaccaccaccaccaccaccaacatcagcagctcaaatagatccatcgcgtttgattcacacgctcgacccaccaaaaatattttttagaactcctccagctaatcaaaaccctctgacatatgtgcccaattcagtgtttattctgtatgaaaccaatatggaacgattcaaggtggtgttcaatgaggagatcatcagccatttgtccttctcaccacagctcgggtatgtgcttggctttgaaaaccctcagcatgtggtgtcaaatgaagttgccaaatatgggtttgatctacgaggtggcatatcaagttttgcagtctactcaaaaggactaactgaaaatatgataattggcaattcattgagctccttgctccgggttgtgtctatcagcggtgctatccccggggagtataatgagaagatttacgactcgccaatatttgcgcgagtgttgccacgtgagatcaacgagattgagattgaactgcgcacaatggacaaaggtcgtctcgtgccattcgcctatgggacaacgatggctgtgttgatatttaagaaagtgataaatttttga

SEQ ID NO: 65484 - DNA, 1041 bp, Heterodera glycines; identical to SEQ ID NO: 36048
  Genomic contig location: Contig_ID=SeqID_36048; Location=1..1041; Strand=+
  SCN-specific regions: Sequence locations=1-148,207-466,497-647,702 -740,772-804,869-914,943-1041
  Gene Ontology: Mol. function=catalytic activity; Cellular component =brush border; Biological process=glycogen catabolism

SEQ ID NO: 65485 - DNA, 220 bp, Heterodera glycines
  Genomic contig location: Contig_ID=SeqID_36049; Location=605..824; Strand=-
  SCN-specific regions: Sequence locations=1-220
ggcccttttcccgaatttggccccaattattcctcgccatatttcactcgcaccggcacttattccttcccgaatcattaccatttgcaaaacgaccgtttctacagtgccttctttcgcgcgtcttaccgtagttccgactacagtcccgagagtctctacagtagtcggatcgcttaaagctgaatgaaaataattctgctgctggtggatgcgcaaa

SEQ ID NO: 65486 - DNA, 1371 bp, Heterodera glycines
  Genomic contig location: Contig_ID=SeqID_36050; Location=16..1386; Strand=+
  SCN-specific regions: Sequence locations=1-609,631-657,679-712,735 -809,831-909,980-980,1003-1119,1141-1258,1285-1371
atgttcacgccacaatatccaatgtgggttatggaaaagcatcatttctatgacaattaagcttctattattggaattttttaccgattttccggaaaaaatgttttttcgaaaatttttgacataaatgatccaactttcggtgatttttaggaccaaattacgagtttcacttatcgaaagaatttttttgtaggcgacgcattacaaaaattgccattttttttggcgaagatttttttataccattagcaagatttttggtactttataagttcatgggaatgaacttttatttgtggtttttgcgaattttttaggaaattctgtgcacaaaatttttaaattcaaattgattttgccttaagaggaaagaaaatgttttccatttttaaggtatacggaatcgccatcacggctgcctcagcaattggaagcgaccaaagagacagtggccgaattggcgccagccgaccatcaattaccgccaaatgggacagcaattgtcagcgatgatggtggcggcattgtggtgccaaccgtgtccgaactcaccgaaacaacagtcacaacaaccaccgtacaccacacgcaacaacggcatgcggtagagacgacggaacaacaacagcaattagtgcccaacggtgcaaagccgtaccagcaccaacagcagcatcaacaggaggaaaacgaacaaaatcacgatgagcgtcaacagcaacaacaacagcctactgtattgacagatggtgagtgaatttgcatttaatgcatggtactgtaaagccataaattttgagatgttctaattgagaaattttaaattatacaattttgcgacctgaattttttttattttattttgtcaaatacaattttgcttgaatttcatttgaaatttttccgataatttttttcttaaatttaactgttaaatgtaattagaataatttttttttaatttaaatatattatacaaaaaactttttgtagaaatgcctcaacacaatgcgatcactcaaaatgggcatgcagaaccagcattaaatggagaactaaatggcgacatgcatcatccaaatgaacaggcacaaatatttttaaaaacccatacatattaaccaaaagtttaaattttctcgcaggaacatcacattctcgaggaaacgtatgagattgtcgagaatgaggacggcacaaagacaacaattcacaagagcatagaacggaattttcccataaatgacggaccaacagcggaggatgaggaggaggacaagacggatcagcaacaacagttgctgcacaatcaacagatggacgcatcaatgagtggataaacatgacatatttaatgatcattttcta

SEQ ID NO: 65487 - DNA, 365 bp, Heterodera glycines
  Genomic contig location: Contig_ID=SeqID_36051; Location=86..450; Strand=+
  SCN-specific regions: Sequence locations=1-143,165-365
atgacggagaaaatgatggtggtaccacccgaagctgatcgttttcttgctgattttgttgatgaggtgtatcatgttgatgaccatttacagatacagtagcagttgtacggccaaacactgtcaaatttgacggataaggtcaaataaaaaacttgttcattcttagccaatttatcttttttttgcctccaaactgatatttctagattaacctggattcaaaccaaggttttttttttgatcgagagattatagtaaaaccatttcctggtttcgaatattccttttcaaattcataattcgaaactttttctgtctttcgatttccaataccttccagcacttttttgacaattagccaa

SEQ ID NO: 65488 - DNA, 833 bp, Heterodera glycines
  Genomic contig location: Contig_ID=SeqID_7637; Location=451..1283; Strand=+
  SCN-specific regions: Sequence locations=1-769,808-833
atggcccctctcttccatcgcttctcatctctctttgtctttctgatgccgttcctttccgttgtgcttctcccgtcaactgtttgtaccggctctgacagtgccgccgcgccgttcgaccgaaagaattatccgaaaatcgatttgcgagtaattaaacgcctaattagcatattaaaaacaatccaaaatcccctttttagctgttcgagtggcccattgcttcacattcgggctcgtccgctgaggtctcttttatcgccgtcgactgctacacccaattggaccgttctttcatctcgaccgatgccgtgctccgtctcaacaattcgttagcacttcggcaccgcgcctgtctcttgcgcattccgacggggacgcggctgacagtgaccgaaatgcaaacgaccaacagaaaggtaaataagtgattggagagaaattggatgggagggggagcagtgatcgaaataaactttgcttttccaatttagagttatgccaccgttttggccggcgcttcgcactacgaattgccgttgcgcactgagtacatccgcaaaggtgggaaaaatgcattgcaattcaatatctaaacagttttccctccaaatttaggacaaaaccaaaacttcggcccatggcacgtgccgtgccaacaggcgtatgtgctgttcaactcgcgcgggcgcaaaatggaatgggtcgaatttcgtctggacgacgaaacggaggcggacaaagagatggcgagcgcggacgaatgtttggcggacgaagaggaggacgaagaggaagaggagaagggataccgcaaaaagcgagctcattga

SEQ ID NO: 65489 - DNA, 117 bp, Heterodera glycines
  Genomic contig location: Contig_ID=SeqID_7637; Location=1381..1497; Strand=+
  SCN-specific regions: Sequence locations=1-117
atgggcaattacggacaatcggagccaaaagaatgccgccgcgtgttaatgatgccaaatggatcaatttcaatgatattcccatctcccacaacgatcaaaacccattcatttcgg

SEQ ID NO: 65490 - DNA, 1135 bp, Heterodera glycines
  misc_feature (1091)..(1091): n is a, c, g, or t
  Genomic contig location: Contig_ID=SeqID_7638; Location=773..1907; Strand=+
  SCN-specific regions: Sequence locations=1-5,27-247,269-269,291 -456,478-978,1001-1017,1039-1135
atgttaacaatttatatttcgaatttcttctcagtttccgccaaaattcggacgcttagcgatttccattcgcgcatcgtttgccaacaacagccgccgagcagtgccgaaattgtgacgacactgcgctattttcagcaaacactcgtcgggcaagtggccgatgaatttttaggaacaatcgaacacatttaaatgatccattaatgctaatatttgagttttaattattttcgaaaatagaaacttataatttttataattttaagttttttgaaagaactcccggctaagcgcagcgaattgttcgaagagttcagtgccgagaacacgacagttcggaccgggctgtacccgaacctgaactattcgggactgttctacggcattaccaatttgttggacgccttcccaatgctcagttcggcacacaatggtccttttgtgatggtcaacactcagagatgaaaaatgaatggccaacaattcagatattgctgaggccattttggacactttgaaggcgctgtactttttcgttgatcgggactgtgttggtcggttggggtattatcttccgcattgtccaccgtatattaccttcccatattaccgtatattaccttcccatattaccgtatattacctcccgacgttaccgtatataacttaccgtattctattataagtttgcattatgtataatcagatattaaggtttattttactatccaatattaccgtatatcatttccctttattaccgtatatcacagtctgatccgccaccccgcccagatcaaatgccgcttctgctggctgctcaacttggcgttttccctgcagagatggaccgtcggcttgtccacttgctctgcgattgcattttgccgtactctttcggcgaaggtgccaacggtcgcgtgtcagttccccgcggtgcttatgctcatccttcaccacccgaccgatccgagtgtctttcaaaattaaatattttggataattacattcatttaggcattcacacaatggcagtcgaaagtctaatgcgaactttgcccgacatttacaatggtgaaaaacccttnaatatcgtctgaacaaataaatttaggcaatcggacaaataagg

SEQ ID NO: 65491 - DNA, 1866 bp, Heterodera glycines; identical to SEQ ID NO: 7639
  Genomic contig location: Contig_ID=SeqID_7639; Location=1..1866; Strand=+
  SCN-specific regions: Sequence locations=1-223,245-305,328-601,624 -640,662-1079,1101-1121,1144-1866

SEQ ID NO: 65492 - DNA, 715 bp, Heterodera glycines
  Genomic contig location: Contig_ID=SeqID_36052; Location=3..717; Strand=-
  SCN-specific regions: Sequence locations=1-31,53-715
atgaaccgacgtttaaggaaaaaaatgtgagaaattttaaaatgaaatgtttttcggcacttttgcattttcatgagcccttacgagaaaaaaaaatcacaaggggtgaaggagggcttttttttggtaaaaacccaactcgtactgttacaccaactcttactaatttttccaactcgtaatgtcaaaaaatcagagatttgtctctacgagtcgagttattcggcttttgatttgaaaatttttaaaaatttgctccctccccattttgttttgtttttataattagttttacgttcgcatttcagttggatttgtagcgacgtgtggatggacattctgccatcttttgaccatgctcagctcggcctcaaaatggcattgctttccgaccgtttcgatgttttggtggacgcgcatttcgatggaaaaacggaattgacaatttggaaagaaatatcaattaaaaaggacgaaggaccaacaccgaaactgtctgaacggatcgatggcaattttgtggaatttccgttgccggaccgtccgctgcccaccaaaattcgttttagggatctttggattgagtaatttaaaacttttgggcgctagtttaaagaagccctcttttgaaaattttttcacttttttttgcataatttttttttatgcagaattgattttttaacatggaacgtattgcatactatttaataaa

SEQ ID NO: 65493 - DNA, 150 bp, Heterodera glycines
  Genomic contig location: Contig_ID=SeqID_36057; Location=465..614; Strand=-
  SCN-specific regions: Sequence locations=1-78,101-150
atgaaaggaaaagcatttgaattggctcaaaagtgggtgtccgccaattacaaactttaccagaacaacaaaaattgtgggaagaaaatgtgggaaaagatttcagcggatgcagccaggccgggcagaggcggagaatacaatgttcaa

SEQ ID NO: 65494 - DNA, 304 bp, Heterodera glycines; identical to SEQ ID NO: 51570
  Genomic contig location: Contig_ID=SeqID_36058; Location=351..654; Strand=-
  SCN-specific regions: Sequence locations=1-304

SEQ ID NO: 65495 - DNA, 405 bp, Heterodera glycines
  Genomic contig location: Contig_ID=SeqID_36059; Location=164..568; Strand=+
  SCN-specific regions: Sequence locations=1-405
atgcagacaaatcttcgacctgcccgtctcaatttccatccttcccgaccttttgccggcacttcttcggctgatggagcagcgtttctcgggccctctgaatttgatcagtccggaaccgatcagtctggccaaaatcctccgcctctacaaagaagtgatgattcattcatatttgatatgctccttaattcattcatttgtccttatttttgccagcatttcgacccgaatctgtcggattttgaggcgattacagccgaatcggagaagggaaaacagctgatggccaccaaagggaactgcgcactgagcaccgatctgttgacgaaactgtgccccgaggtgaagcgaagcagcgacgatttggtggccaatttcaaacggatgaaagagacgaaatga

SEQ ID NO: 65496 - DNA, 1137 bp, Heterodera glycines
  Genomic contig location: Contig_ID=SeqID_7640; Location=557..1693; Strand=+
  SCN-specific regions: Sequence locations=1-343,375-386,424-487,509 -646,670-711,754-774,846-1067,1094-1137
atgggaaagaaatattcaaacaaagaatggtataaaattgaaaaaaaaattgcacaaaaattgggaacaaatcaaagggaaatttacaaatggaaaagagaatttggattgatcaaagatagttattcagaagaggaaaaactcaaaatattagaacgatttgatcaaatatatgaccaaattaaaatcaaattaaaaggaaaattggatggaaaaggaacaaaatgccaaaaaataatagcaaaacaattgggcataagtttaatgagcatttataaatggaagaaacaattaaataatgtaaattcggtggacatccaaaaaactgatgatgaaaaaagagaaattatagaaaaatattttaaaataaaaaacgaatttatgcaaaatggaaaacattcacagaaggaatggaaagaatttagagcaaatattaaacaaatgattggtgtgaatttttggacgattgaaagatgggcaaagaaattaaatattaaacaaaattttcaaaaggttgaatttattttgaagggttttataaatatcaaaaaaggttatccaatttttaaaagattatgaaaaatatttgttttgttgaataatcaaaaagggaatgtgccgtatcatttaattaaatccaattgactaataatattttaatttattttagctccttccgcttcggctgacagaaaagagaaaagtacaaccaaaatattacttaaaataattacatttttaataattaaaaatgcaaaacagtagaaagaacagataaataataatttaaacaaaaattatcgaaaatttaaaaaaaaaaatttaattttttaaaataattattaccattttcaggaaaagaacaaattatcaaccaatttaataaaatgaaaaacgaattcttgaaagcaaatctaaaggctaataacagaaaagcagaatttaaaaattgccaagtaaatgggccgacgattcaaaacaattaatcggcggcgcaaggagctgaaacagaattctaactgacaaagagcaattggcactgtttttaaaaaaaccggcacgtcgccaaggaaaattttaaaaattttgatgaaattacagatttatttaaaaagcatcaaaaataagtaaatcaaa

SEQ ID NO: 65497 - DNA, 1227 bp, Heterodera glycines
  Genomic contig location: Contig_ID=SeqID_7640; Location=1855..3081; Strand=-
  SCN-specific regions: Sequence locations=1-146,217-236,270-276,317 -374,397-633,658-739,761-797,840-975,1000-1007,1030-1123,1145 -1180,1202-1227
atgtgcgctccgcatgagtgcatttgggattgggcaagcaatcagaattacgcattgaatacactcatcacgggcaccaccgttgccacatacattggcatatggattatacttttataccgaaatcagaatgcccaaaatacgagtaataaatatacaaaaatattgaataattatataaacaaaaaacataattagttaaagaaaataatttttcagatttttttgaagactcattaaaaattggatttcaaaaagtagcaaatgaatacaatcaaaaataaattaaaaaactatttttaaattatcaaattaagtatggcgctaacatataaaaacaaaggcattgttatgggtgttaaaaatggaattccattaattatttaattaaattttcaaaattgccagacaattcatcggatgcttggacccgtcgaattctgaaggcattggcatttttggtggcacttcagctcgccgggcacacattgtcaagcattggccggctgaccattccgcaactccaattgtctgtgaccagtaaagctgtctcgacatttttgctcagctgcttgacaaacattgtgctggctgtgaatgggccagtgctttacaaaatgaagtaaattttaggggaaaaatgattttaatttttaatgctacgtcttatagatcaaaattttgaaaagtataaatatggatctgggttcatgtttggcctagaaccgtatgttctggacaaaaaactcataaaaacccagaaatagaacctgctctggataaatccaaaaaatcactaaaaaaacataaaataaatttattaatatacttttaattatgactaactataataaaaaactcatttttcttcaaatggagataaatttaattcgaacgaaaaaacacataaatttgtaatttgaaaaaaattgtaaattaatgaaatttaatcgtttaataattccaaaaaatcagataatttaattattaaaaatatttcagcatggaatatcggaaagcatttcaaaaagtgttcaagtttcttcaaccaaccaattacgcaacaagcataggaacgcagcaacaacaatgggcaattcgcgtagcaacagcgaatgttcggaattgaatttttacgaattatttcgaattttcaaaatctccaatttcaaaattgttcattataaaattattattatttgccagttaaaaaattatgcgaataaa

SEQ ID NO: 65498 - DNA, 951 bp, Heterodera glycines
  Genomic contig location: Contig_ID=SeqID_7640; Location=3512..4462; Strand=-
  SCN-specific regions: Sequence locations=1-19,61-210,358-454,478 -511,533-671,694-951
atgaatcaaaacgaaacggtatttaaaataaatatataatataaaaataataaaaattttggtgtttagctttttgagctttatgcggaagacggtttgccatgggcacttatcgctttaacagcggtacgaacatttatctccacaattgggataatatgtaacttagcgctagtatacgtcaccatcaaaaccaagtaataacaaatgataaaataaattaaatcatttttatttgttagaattaattatttttcatttttcattttttagaattttttttaattcgaaattttttaaaaatccgctattttaattttaattttgtgaaaaaatagaaaaaatttattttttaatgaatttccgaatatttttcaattattttacaaagtgccgaaatcaaaaattaaaatatcattaatttagctcattgaatggcccctgcaacattctgatcgcttttgatgcagctgcttgtgcctggtttgaaattggctcatggattggcatgttccaaattttggtgggccaacaatttgtgccaattcgtttgtgctgtgtttacctgttgctaccattcattacgggagtttatgcttcaatgtccgccaatttgttgatcgcttttgatcgacttctcagcatttgcttcccaatttggtgtcttatttaaaattgccaaaaaatttttattatctatcattaaatttatctttttgaaatttttgactaattacctaattaatataaatttgaaaggtatgccatgcgtaaaccatcacgtctctattcgttttttctcgttttgctgagttcgttgttatttcccggtttcattgttcaagcaattcttcgtttagtgctaaacataccggaacaaaagtaaaaaaatatattttcttggcattatttagttttgagtccaaagaattaaattttcgaaaaaataaa

SEQ ID NO: 65499 - DNA, 732 bp, Heterodera glycines
  Genomic contig location: Contig_ID=SeqID_7641; Location=1148..1879; Strand=+
  SCN-specific regions: Sequence locations=1-282,341-668,731-732
atgtctacgcggcggacgaaacggcggtttggcttgacccgggtggcgggacatccgtaccaaacatcatcgaccgcttcaaaaaaacacttgttttgtcatggttggcagaacatggatggacaacgaattgacgacggagtacttggaaaaggtgcagaacaatgacaataattcattaatagaaacttcttaaattaagattttcgggaatttccatttcggcgcccgtctcttggtttgtaaaaaccgaaaaattttctttttgtaagaaacttttggaaaattttttttatttaacttataaaaaatttttaaaatttagaaattcaatatttttgcaattgtataaaaaatgctccttagcccttgttgtggtgatttcaaagtcaattcttaatgtacacacaatttttggcatttttttgaaagataaaagccattttttggcagtttttaaggcatattttagtgcatatttgggtatttttcgggattttagtacatatttgggagatttttagtgcatatttatgcgcatatttggcattttttagtgcatacaacttcgaccctagccataagaaaagggtccactgcgtttgggcgctggcgtttgagcgcggccgtttggccccagctcgtttgagcgctggcgtttgggcgccaaaaaatatataaaaattcaaataatttggtaaaacaaaaactttttattaaatataaaaaaca

SEQ ID NO: 65500 - DNA, 535 bp, Heterodera glycines
  Genomic contig location: Contig_ID=SeqID_7641; Location=665..1199; Strand=-
  SCN-specific regions: Sequence locations=1-535
gtcccgccacccgggtcaagccaaaccgccgtttcgtccgccgcgtagacatgtgtgtagctgaaaattagtcgtttgaaaaaaaatttctcatttacctacttctttttgtgtatgagttgttgaatatataatatgaagttgatgatgatgtttttgtatgcatcgggttctttttgcgctactgttgtcggtcgacgtaaggaaaatttatgacggtgcatgaatttttccagccatccattactagcctaagtgaaaaatgttcaaaaatttttcgaaatgttaccgcaaaacattccatgtcttcgtaggcggcgctcattttgattgcttgcgcagcaatcatatttcgtgtcacccgcactttcttttgtcgcaattcagacacccactggaacacagcttcttcgaagttcctgtttggaactttccttccgcccccttccaaacgttttcgttttgacgattcggccctaaattaaacgaattaaaacattgtgacattacaggcatcttactctttcctcaaatt

SEQ ID NO: 65501 - DNA, 1308 bp, Heterodera glycines
  Genomic contig location: Contig_ID=SeqID_7642; Location=452..1759; Strand=-
  SCN-specific regions: Sequence locations=1-1133,1155-1308
atggagtttggcgccatggtcaacgctcgcagtgaacgcgccgacatgacgctgtcaaaggaggaagtcaaatgcttgattttcatcacaggtctgagcgacgcgcacaaagaactccgacaagagtgtctccgccaaatggaaaaagcgcgaaagtcaacgccaccgaggtccatgactttggaagcacttatggaagagtgccgctccatccaatcgcttcaaaattcggccgccgctttgtctggtcccgggcaaattcattcggtgcaggtttcggccaggtttgggcgtgtgcacgaagatgaaagcaacgcttcatttgaaacctggtgctcagcccgttttttgtcgagctaggcccgttccgcatggagtttcggaggccgtcaacagcgaattggaccgtcttgttgaaattggagcgatccaccccgtcgatttttcgcgttgggcggcacctgtcctcgctgtgcgcaaaaagtctggtgaaattcgtgtttgcgtcgacttcaggaccggactaaatgatgcgttggaactcaaccgtcatccattgccacgaaccgacgacattttccatgcacttcgtgggtcaaaagttttctcacaacttgatctgcgcgatgcatatctccaattggaattggatgaaaagtccaaatcgttagtggggattaacacgcataaagggctttttcagtaccaacggttgccctttggtgttaagtctgccccttcgatttttcagaagattatggatcaaatgacgtccggtattcctggtgtttttgcgtacctggacgacattatcatcgcttcagcaaacattacggatcacattgaatctttgtccaaattattttcaaaaattcaggattttggattccgcattcgtttggaaaaatggcattttttgcaaactgaattaaaatttcttggccacattgtttcagccaaaggaatccaacccgacccggctcgatctgcagcgattcgcgaaatgccgccgccaaatgatctgagcactttgcgttcgtttcttggcgcactgaattattatggtcggtttatcaaagagatgcgtgtaattcgcgctcctttggacattcttttgcgtaaagacgttccttgggcttggggaaatgatcaacaaaatgcttttgaaaaggctaagcagattctccagtccgacttgcttttgacgcactacacgaccccgcaaaaccaattatcgttgctgcggatgctagtcagtcaggaattggcgcaaccatcagtcacaagttccctgatggctctgaacgc

SEQ ID NO: 65502 - DNA, 93 bp, Heterodera glycines
  Genomic contig location: Contig_ID=SeqID_36074; Location=53..145; Strand=-
  SCN-specific regions: Sequence locations=1-93
agaccaaagagttggaacagaaccttcgcgatttgcccacttgcaaattgattttcccctcaacgtcggcgctgcaacgaaatggagctgacg

SEQ ID NO: 65503 - DNA, 775 bp, Heterodera glycines
  Genomic contig location: Contig_ID=SeqID_36078; Location=32..806; Strand=-
  SCN-specific regions: Sequence locations=1-89,112-117,139-369,405 -476,502-674,702-754
atggcgactaaaactttgccaaaatgcattttggatggaaatggcatggcaaaatgggacggaatcccatcggaagggattaaatgccaatgtgagattttacaaatgaaagcccaaaaataaattaaacgaattatataaattatagttgaaaacttatgcgaacaatttgacgaaaatccgtgcggaagcaatggaatttgtattccgctgaatggaacttacacatgcaattgtacaacgccaacatatcggttcaacagaaaagccatttttggccaacaatgcgaaggtccaacttttaaataagaaaaaatggcaaaaataaaatttatgacaaaaaagcgaattaaatgaaaagggaacgtcaaaaaataaataataataaatattaattttattttcaattagaaattgacttatgctccgctgacctttggccttgttcggctggcacttgcaaaagaacggcccatcccccgggggcttttcccccttttgagtgcctttgccccgagggcactcacactttgtacgacgacaaaaaagcaacagaaagtgtaaaaaggaagctaaattactaaactgtttgcctctggttaattaagcaattggtcattccctcccgccaatcgcttctctccgcatattcctgcataagtaaactctttcttttgaattatttaaaattcatttaattttagctcaacgatgtcaaaaaccaacgtcagctgaagagcaattcgtcatccaatcatccgacccactgcatctc

SEQ ID NO: 65504 - DNA, 668 bp, Heterodera glycines
  Genomic contig location: Contig_ID=SeqID_36079; Location=136..803; Strand=+
  SCN-specific regions: Sequence locations=1-354,395-472,495-567,589 -632,654-668
ggtgcgaatacagcgaaaaattattaatcgcaacactgcttgaccctgcgtacaagggagcgtttttcaaagatgctgtcatttttgagcgtgccaaagacatgttgcttaatgaagcggaaagaattgccataaaatgtgttgaggtaacataacaaacaattttttattttgatttttactattaagtttgatacgagtgaattattagcgatgcctgaaattgaagcgtcggaagatccatttttggcttttggaaatcacacaacagaaaatgacaatagttttatgcttccaatcactccaacaccatcaccatcattagctagcgccaaggctatggcagctggggtgaatattttttgttttattttaaatattttttcatattttagcaagtggctgattatttaaatagccaaactgtcgactgtgaatcacacaatttttgggcaaatcaaattcaaacagccaaatatccattacttattccattagtcaaaaaatatcattcggctccatgtacatcagccgagagtgaacggatgttttctgcggctaaacttattgtgacagatttgagaaaaaatttagcaggagaaacgttgaaagaactcctttttcttcaacagaatttgcctctttatggatttaaattcgaaatttaa

SEQ ID NO: 65505 - DNA, 3342 bp, Heterodera glycines
  Genomic contig location: Contig_ID=SeqID_7643; Location=16..3357; Strand=-
  SCN-specific regions: Sequence locations=1-146,168-321,344-420,451 -550,587-960,986-1020,1042-1197,1226-1253,1300-1306,1328-1432,1454 -1908,1994-2262,2285-2479,2508-3079,3101-3102,3124-3172,3220-3342
gaaacggattgcgttcatttttcaacgggttggccccaacaatggcacgcgaaattcccggctatttttgcttcttcggtgcctacgaactgagcaggacaatgctgagaccggacgggtccgccaaggaggagattggttggtcttttttggtggccaccaaaataaatttccaaaaaaaaactaatttatgcattttttaattttggcaatttttattttgtttaactctgtttattttttcggaaaatttgagcattttaaccgaatttaaggcattgcgaggacggcactctccggtgcatttggaggaattgttcgtctttttgacatttattttttgaaacaacttatgatttctcaatttaaaggctctttggactgcgatttttcccgtcgacgtcggtgagaaaatgttacaatattaatatttaattacataaaaaattacacatttcagttaaaagtcgaatgcaaattacgggagaacaaaattcgacccaactgtttttgcgcattgtcaaacaagaaggtgactagtttgattttgttcaaatttaggcttgaaaattattaaggccaatttgatcatttttggcgctataatggcgactctctctaaattaccataaacaaaaattttgcaaaaaatttcaaaattaattgggacgaagaggaattaaaaaaataggtcgtgggctctgggatttatcggggggactctcagttcagtgtgcaccagtcgagaccgggaaacccgtaaatcagttaccacttccgcatgtttaccaaattcgtgtctctctctgtgttcattcgtacattttggcaattcttctcgctaggtgtcagcgctctgtacaagggtctgttcccgacactgatccgaacatgctttgccagcgctgcgctgttcatcacctacgagaacaccaaacacattttgcatgccatctgatcggaggaggacgatgaggaggagcaacggggaattaccattttttgattgttttgcacccattttcagttattttgaaattaattgtgtgtttcccccccccccccccggcgttttcttcattgttgttatcattgatgtttttgttgtctgttttgattgctgctcactgatcagatcgtcatcgccaacatcttaaaaaaggaaaacatttttacacattttaacattttttacacaaaatttgaataaattttattaaaaaatcttcacgtgacatcatttcattcgctacatatgcatatgtatatgcacatatttgttctgctgttgttgctgtaaataatgtttatttacacatttgcaatttggtcatggccataaatgaaagaatatttttttgaatgtttgcttagcaaatttctcggattgtcgtccctcccaaacgcgtgctaaaaaaggcaatttttgctctcataaatctgtccatttgtgttaccaaattgactgactttgactttttttattatttattatctttgttcaataatgtgttcttcggccgatgagcaaatttcgcgccacgccatgttggcgacctcaatggttggggtggttattgtcgaaaattctattaatggatttttttttataattttgtcaaaagcattgttagagcttacaattaggtagattggcctcatggagaaataaagaattgaaggatttgtcaaatatatcgcacaattttcgaaataaaacaaattttcaatgcctaattgggggcgggtggaaataaatttgacattcgtgccgcttttgtagctgtgcaggaaccggtgcggcttctacggcacgccccagtgcgacgggttgtgctcacgctgttggcgcgactttcagctggagagcaagcggcaaaatgactaccaaaacaacatcaaagtgttgcgacagcaccagcagcacgcgacggggccaagcggtgcgggcggtggaagtgcggcggcgctgtcgtcggcggcggcggtgacgcgcaaaggctccgacgcgcgcttcaactcgctgaagacgctggtgaagaagtcgccgtccgtgttatccgccagcacttgcggtgggttggccgatgcgaagggcatagcaaaatacaaaggggaattgtgccccggcatttcagtcgaatttttttttgtcagacttgcttttttgaccgaaaactgacacggaaactttgggtttggttaggccggtaaccaagggaagcggaaattaaatattaataaaagcgctaattcggttagattttccaaaaagttttcccccaatttctctaaattggtcacttttgggcagaaatctgtcaacgtgtaaaaatataatttttttgttttcccgccccttttaaaatagttttgccttaccaaatttttcaaattttttcatgggtcgctaatttgcatcttttaaaacacattccgaattttagaccaatcgccgctcatcactttggggccgaggtataaaacataattttatatattttattggcgaaaaaagtgtcgacgaaaacctctcaaacatcccaaacatttcgacctgttcaggccaccgagtccggacactgtgaccgcccaggagcatctacaccaatttttagaggccaattttgcccacgtttatgccaaagagttggacaagcagtgccaagtgttcattgacaacttgttcaaggtggacaggcaactactttgtctatttgtgcctccccccccccccaattttagagtgaatttttgccaagcgatgagctctctctgctcgtccaggcattttaccaatcgatcaaagaaagtgccgtcaaatttgctgcgcaaatgccaccgcccgccgccgcaacggcgggggacggcgccgccacgccgtgcagcacctccgacttcatgacggaaattgagaactttgtgtgcactcgtgcgtaccccgtgctgtttggctcacggtacggcacggcgccatttgttcctctcattttgaacgcctcccctctcccaactccagaaaaaaagcatttttaaataagttttttcagaagaaaattcttttgcttgatttttttacaaaatttattgaaatttaaagagttttgtgtgtttttcaatttgttagcatttaaaagattgaaaaataaccaattaaaaaaaatccgctctctaaaatttatatttgaattaaaaaatcatttaatttttaaattaattgcctccagaacggaggaagaagcggaggacctgagcttacagacgcggatccgttcgttgcattgggtgaccaatggctatttggagacggcgctgagcgagtcgtcggccccaggtgctcaa

SEQ ID NO: 65506 - DNA, 616 bp, Heterodera glycines
  Genomic contig location: Contig_ID=SeqID_7644; Location=222..837; Strand=-
  SCN-specific regions: Sequence locations=1-253,275-616
atgaacgacaaaagttcggcgacggtgccgataaattcggcactgacggacactgctcacatttcgcatttaaaagacggaatgatcgactttgtggccggcacagctggtgagttgttggaaattgcttgaagtctcttctattttctataatcatcccataaattgaaaaaccgaaaaaaagtcattgatattcgaacaaaatgaattattgtgaagccgtctcaatcgttccgctctgattgcactcccctttttggtttgttttcattttcctccccgtttcacaggtggcgttgccacggtttacaccgcacaaccgctggacacagtcaaaggtttggaaactgatcacacatagtttttagtatcaaatttttgcttcattcactctccatgttccgttgcttaagtgaagatgcaaacatttcccgccttgtacggcaattgggtgcgctgtctgagacggacattccgtgccgagggcgtccgcggcctttacgccggtaagcattggcactaaaagttttttaaagaaaatggggcgattttttaaaatttcaaatcagttttcttaccaaaattcggtaaaagttttgtgtgcggaaatattaaa

SEQ ID NO: 65507 - DNA, 206 bp, Heterodera glycines
  Genomic contig location: Contig_ID=SeqID_7644; Location=1157..1362; Strand=+
  SCN-specific regions: Sequence locations=1-206
attcgttcgccacgggcggcacggcgtggacacggacggacttgtccatgctggcggacaccacggacttgacatcgtcggcaaaacagacgccggtgactggctgagagtgcgcgttgaactgggcaatgttgttccaacttttggcctggaaaatctgcacgttgctgcccccgacggccaaataggcgccagactggtcaaaa

SEQ ID NO: 65508 - DNA, 133 bp, Heterodera glycines
  Genomic contig location: Contig_ID=SeqID_7644; Location=1443..1575; Strand=-
  SCN-specific regions: Sequence locations=1-133
aaattagtcaaaatacatgtcagattcgtgattagcgacctttaaaaccccagataacaaattatcatgcttttttatctcaaaaaagttttgcaaaacaaaagggtccccccttttgaaaaaattttcaaaa

SEQ ID NO: 65509 - DNA, 813 bp, Heterodera glycines
  Genomic contig location: Contig_ID=SeqID_7645; Location=129..941; Strand=-
  SCN-specific regions: Sequence locations=1-26,48-388,432-743,766-813
  Gene Ontology: Mol. function=pre-mRNA splicing factor activity; Cellular component=small nuclear ribonucleoprotein complex; Biological process=mRNA splicing
atgcccatttccccccccccccccggtgttttgttgtttttgctgctactacccagtcatccgttctcgcttcagatacgaatttggaacgcggatgatcaaagtgccagaaatgttattggcatccacgaccgacccgtcactgacgtgtctctgcacccaaccggcgattatgtgctctgttcctctgaggattcgcattggtcgctcatcgacctcaatgctggacgtccgttgataaaagtcagtcacagagacattttgccaactgttttttttgggggggggagacaaatatttttacaatgttttcaaagccgttttgatggcgatagtcttaaaaaatgtggagaacaaagccaggttttctagccccagaaattttaagtttttaaattgtttattgttaggatatttttgtaatttctcatttaatttgtggctgggtgcaaacaatttttaaatcaatcaaccagtggaaaaagtgcactatacatttttccaaaaccaaaaacattggcacaggtgaaatccgacgacgacgatgtgccgggaatttgctgtggccagtttcaccccgacggactcatctttggcactggcggcaaaaacagcgtcgtcaaaatctgggatatcaaggagcagatcaacgtggcccaattcccgggccaccaggaggcggttgttgccatttcgttttccgaaaatggctactacttggccaccgggtcaacggacggcgaagtgaaaatttgggacctgcgcaaactgaagaatctgaagaacttgacactgtacgatgtgaagcaggcg

SEQ ID NO: 65510 - DNA, 524 bp, Heterodera glycines
  Genomic contig location: Contig_ID=SeqID_36082; Location=266..789; Strand=+
  SCN-specific regions: Sequence locations=1-198,221-346,369-377,405 -413,435-524
atgctaatgaaagaccccggcttgcgcttcgacatcactcaggtgaaatgccacaaaatataccctcttaattagtgccctctttttgaggggtttgaaaatataaacccctcgggctcccggaaaatgcgtcggttaaattttaaaaaagtactaaaagatccataaaatacaaccatactgtaattgggtttattgtaaatatgttctcctatattttgttcacatacctattgaactttacaatctcaatcatcacaatattctgtattttatttcgtttttctgtttcactgacgcatttttccgccgatcacacccctcgggcgattaatagggaaaacagaattataatttaatttaaaaatgacacgaagaaaataatatatatatatatatattttcagccatttggtggaggtgacggagcaggaagtgaccgagtccattcgcatgatgccgcacctcggcacgctgatcctcgtaaaagcgatgggccgcaaaaaacatttggcaatccgtaa

SEQ ID NO: 65511 - DNA, 690 bp, Heterodera glycines
  Genomic contig location: Contig_ID=SeqID_36090; Location=33..722; Strand=+
  SCN-specific regions: Sequence locations=1-384,407-690
atggtccgtgccgacttcgtcaccaaaatggtgcgccattttgaaggtgccattgtaccaactgcaatcgcttgtttctttgtggagaacagttttggggacaagttgcagaaaagtgagtcggtcgcgttgactttgtactttatttttgcactttccaattcgacagttgctccttcgtttaatcagtcattttggtacaaaatggcgattcccattcaatgccgaggccgtcgtctgaagcaggcttatgtttctgagcagttgcgtgagcacttcaaactgtacaacgaactgatgtgtcagtaccagagccaatacccggaactgcttaccggactcaaactcacccaggtctttttgttagcatttggtgtcctgtttcaaaaacaacccctttttccagcaagctcgccatattctgttggaacgttctgagcaggaacagctcgtcgagtgccttgtctgctttgaacgggtcgcattacgtcggatggtctgttgcaccgcacccatcgaaagtccatcaacgggcggtgcctctcaccagcacatcgcccaggagagtgagggtgaagtgctgctgattgaattgccttccgattcgtcacgggtccaattgctatcgaatgaacgagaaagtacgactattcttctgcaatttgcacttacaagggaaccacccgaact

SEQ ID NO: 65512 - DNA, 707 bp, Heterodera glycines
  Genomic contig location: Contig_ID=SeqID_36094; Location=490..1196; Strand=-
  SCN-specific regions: Sequence locations=1-132,154-284,308-319,359 -462,526-707
atgccaccatcaaatgccgaagtcgtcgtcgaaccaaatgccacaacaacaaaagtcaaattcaccgcacgacaaaaggtctgcccatcaacaacagctgcaaaagtcgtcgccacccaaaatgccggctgctcatcatcatcaacagcagcaaatgtccgtcaaccgtcgttttcgtcactttccgccgaagcaatcgcacgacaaaaaaaagggacaaaaacaacaaaaacaaattcaacaaaaaacaggcaagctttaataaaaagtttaaatttcatagcatttaaataattaaaaatattaacctttcactgtctttttaaattattataaaaattgttttaattatttttatcatatcttccaaagatttttttttacagccgccgcccccatcaatccgcattcctaagggcaaaacgccaaagaaggtccgtccacgccgcccggaacccgaccaaatttttttgaatttttacatttaaaatatcaatttaaatttcgatttaatttttaaattttcagattatcaagggcaagaggattggtgtttatcaacgaaaagcgatgccctggagctgacgcacttccacgacattgactcgcccatggactccacgcttcatgccattgtgggccgaccggtggcgccatttctacaacaacggcttaatgctcgcccactttttcatcaacgtaataaa

SEQ ID NO: 65513 - DNA, 441 bp, Heterodera glycines
  Genomic contig location: Contig_ID=SeqID_36094; Location=1..441; Strand=+
  SCN-specific regions: Sequence locations=1-2,24-441
agagaaatgagaagcaaaaaacaatagggggaccaacacaagggaaggcctgcctagcgcttttcacagctccgaaataagcattgaaggggggaccaacacgagggaaggcctgcccatcaacacccagatattaggaaatgtgaaagagagagagagagagaaatgagaagcaaaaacaatagggggaccaacacaagggaaggcctgcctaccgcttttcacagctccgaaataagcattgaaggggggaccaacacgagggaaggcctgcccatcaacacccagactttatgaaatgcgagagagaaagagagtgagatagagaaatgagaaagaccaatccacctttgccctttgcgctggtgtgacgtcgacagaagatgagaacacaaatggcaattgttgcttgaccacttgcagaccattttgctgctgctg

SEQ ID NO: 65514 - DNA, 405 bp, Heterodera glycines
  Genomic contig location: Contig_ID=SeqID_36099; Location=225..629; Strand=-
  SCN-specific regions: Sequence locations=1-405
  Gene Ontology: Cellular component=membrane
gtaccgttggtttattcttcgcgattatcacctcgatgtcactgtaagtttctgtcaaaattcgaatttcccaattttatttgtgccacgggtcggtttcaactctcttcaatttcagggtccaatgatgattatggtccaaaaagtgaccgttctcgccttttcacttcatgacggatcaaaaaagtcggaggaactcagccgaattctgtccaaagaatcattgaggtgcggtgattcactcggaacagccaaaaacactaattgttcagcaaagtgccgccaattctcaactttttggcgtacactttccaattccaaacggttctcacggggccaatggttttttactcggaatttatggaatttgtcagcggagaaaactttagcaaagcgttgaaaaag

SEQ ID NO: 65515 - DNA, 76 bp, Heterodera glycines
  Genomic contig location: Contig_ID=SeqID_36101; Location=330..405; Strand=+
  SCN-specific regions: Sequence locations=1-76
ataaaattcccatatttatgacacttgacgataaattaacttttcctccattagaagaacaaactgctcgcaagag

SEQ ID NO: 65516 - DNA, 524 bp, Heterodera glycines
  Genomic contig location: Contig_ID=SeqID_7652; Location=557..1080; Strand=+
  SCN-specific regions: Sequence locations=1-175,198-336,400-524
atggttaatgtgattatggtggtggtggtggtggtaagtgctattcgcccccccgccccattcacatcaattaatttgctaaaaataggcaatgttatttgtgtgacatgggggaaacagctgaccccacaaaaaaaaacaacaatgttttctaaaaattggatttttttaaatttcttattttggaaagaggaggagcgacagctgaccaccgaaaattttcaattttcaaattaaatgatttaattaaattttgctggtcagaacggtgattgatgaatgtggttgcttttgaaatttttgccacgtcaactgacagcacagcgaagaaaaggcaaaaaaaaaaaatttttttttttgaatattaagcatttttaaattaattaatacaaaaaaatacaaatgactgttctaaaaaaacaatttttgttcgtataaatgggccttttaaataaaaaaacaaaaatatttgcagataaaaatcacaaaaatgctaaaaaatacaaaataaagttttaaatcta

SEQ ID NO: 65517 - DNA, 439 bp, Heterodera glycines
  Genomic contig location: Contig_ID=SeqID_36106; Location=233..671; Strand=-
  SCN-specific regions: Sequence locations=1-439
aaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 65518 - DNA, 1284 bp, Heterodera glycines
  misc_feature (467)..(467): n is a, c, g, or t
  Genomic contig location: Contig_ID=SeqID_36107; Location=1..1284; Strand=+
  SCN-specific regions: Sequence locations=1-591,613-898,920-1125,1147 -1187,1209-1284
  Gene Ontology: Biological process=amino acid and derivative metabolism
tgagctcaaaacttggtgagcaaaaaaaaacgaacggactgacaataaacaatgcgcacgaagagacaaaaatggagccgattgaagaagcgaatttgaaaataattgacacggacatcggatattgtcgctacggaaagggcccagtcaattttctgttcatttgcggtggcgtcggtccgttttcgcgtcctcaaattttaaattccccccccccccctcctcactttggcaggctgttacaaaaaagattatccggagtgtgtactgcgtgcctttgaccccaactttgccaccataatttgcatcgacccgccaggatacggcaccagtcgtccgcccgatcggaagcaggaggtgaaccgttgcaaaatggacgccaaatactgcttgaaactgatggaggtcagtcagtttggaagtatacatccgtaccgttttaatgtgccacttcccccgttaatccnataaattccgtttattgtggtacttttgccttgctgcaattccctcatttcagaccctcaaattgacgccgtttgttgtgttgggatggagcgaagggggcagaacatcgatacacgtggcaggccaagggaagggcctggtcagccacatggtactgctttcgtccggctcccaagtggacatgcggggagacttggcattcaaaggtgttggaattcccatttaaaggaaacgtattcttgactttaactcattgaaaggcatgcgaaacacggaccaatggatgcccgcggcaaaggcaccctatttggagcattattccaacgaatttctcaaggaacaatgggccggactttgcgatgttgtagcaaagtgtgtgcacatgaatttttgaaattcgacctaatagtcaattaatttatcaaattcctttttatttttgaattaaaagggaagaaataatcgaaacaaaaaagcggttaaatctttttaaatctgctcatttagagtgtacaaggacctcggaggaagttttccatgcgaccgcgttctaaacacactgaagatccccgttttgatcgtcaacggtaacatggaccggttcgtccttgacccgagcttgatgagcaagaaattggaaaatgccaggttttcgccatttcatttcttacaattagcaggaatgtaatttttaggattgaaatacatgcccagggagggcacgaccttcacatcaaatacccacgttggtttgctttaaaagtgactagttttgtgaaggaatcggcgaaaagtgatgtgaaagcgaataggaaa

SEQ ID NO: 65519 - DNA, 86 bp, Heterodera glycines
  Genomic contig location: Contig_ID=SeqID_36111; Location=110..195; Strand=+
  SCN-specific regions: Sequence locations=1-86
attccgacagaagccaaatattattttgttcgttgggttgtcgggttcaggaaaaacgacactgttcaccaagttgataaactcga

SEQ ID NO: 65520 - DNA, 1946 bp, Heterodera glycines
  Genomic contig location: Contig_ID=SeqID_7653; Location=439..2384; Strand=+
  SCN-specific regions: Sequence locations=1-123,153-213,235-331,364 -652,674-809,832-887,909-1358,1464-1779,1802-1946
atgcgtgcccatttagtgtccatgcatgccaagtatgggctgcacgtgtgcggcgagggcggtgagtatgaaacatttgtgctcgactgtccgatgttcaagcgacaacgcattgtgagagtgtgatgccaatttttaaaaatttatttgggaatttgaaacaaaaattcgttgggggaaatgaattgatgttctattgcttcatggctgggcaaaactaatcaaaaccaacaagaaacgagaataaaacattttcggatccggcctcaaaatttggggtgcaccccaaaatttcgtcgcacgaaatttcgcgggacataatttggccgccaaaaattaaaaaaattaaactttaaaaattttctggatgccaaaaatggcaatggtcaagaattggtgtcccgacgaaaaaaaatgttaaaaatttcatagatattttatctaggcttaaaaaacgagccgatcacgaatctgaattcagattttgaaaatcactgatttttgtctatgatttttatcagctacttgattttttccaaaattttaagaaaatagtctggcataaaaaaactcataaacagatgttgtagagcttaaaaatcgaatgagctattgaatttatggaaaagacaagtttcgatttttaatgattttttgaaattaataattaatccctaggggtcacatgagacgggggcctggggttcgagtccgcttggctgcggtttatttttttatgacacttgatgaaaaatcatagataaaatgaaggttcatgcataatcagtgctcagaatcatgatcagagtattttttaaccccaaattcaaactggcatattttcttgcaattgatttttgatcaaaatgagtaattaattaattgccaattaagtcattgtcttctgatcagtgatcactcaaaaaacattcaaaaattttgtggcgatggcattccgttgtgactgctgcctgttcacctttgcctcatttgggctgctccatgaccatttactctacatgggtgagcaagcattttgtaatgcgtttgtattgtggtctctaaaagtcttgacgaattccgattggaactggacttaattggattttaattacgcaacaccgtggctcgtaattacggagtgtttaatcgattacggaaatccgtaaccccgtaattacgggagtccaaaaaagccttgtatattttcccccaaatttattttcaaacgggtaatgagggctattataccgaacaggggtcggacaatccgtcaataatggataatccttcagtgaacaattaattctcagaaaaaaattttttgagcaccgatcaaagattttcgagaatgattgttaaatttaataaataaaatttcatatttcttaaacattctattatttaataattcgatttaatagattatttatagaaatttcattttttaatataaatttattgacatattgtttactgacgaatgttcgggagccctaattccgacgcccaaaaatttttgaaaatggatttctgctcccaatgcagaaaatgtaattccgaatcatgtctatctttgtaaattgttgcgacagtgtccgcctcgtcgttgtcccatgccacgcattcgttcgtctgtccgttgtgcagcgtgccgtccccgtcgcggtcgtccgctccaccgcaacaacaatttgccagttcatttggttgcgcaagcgtttgccgaacacattgacatggcacacgtggcccaaacaccccacgaaatggtggattgatggctcatcggttaagagccttggacaatctcaccaaagaggcacgggcatttggacgaaagactcactccatttcccactccaaattttttcacggctatcaaaccgctccacagaaattctgacagaatttatttttttttaatgacaacatcaaaatacata

SEQ ID NO: 65521 - DNA, 941 bp, Heterodera glycines
  Genomic contig location: Contig_ID=SeqID_7654; Location=1390..2330; Strand=+
  SCN-specific regions: Sequence locations=1-84,118-204,228-233,255 -493,524-731,781-908,932-941
atgccaattaatgaaatgattttgcaattggaaattgaatcagcgaatgaatgtcaatctaatgaaaatttagacggaataatccaagaaaaatttggaggaaatgttcaaaaaagcagaagaaagggaaaaaaagaccgtttatggagagcaaatgaaataaatgatgacaaacattggataattttggaatcgaaattcgattatatatatatatatatatatatgggtgagaattaatagaattaacatttaatggaaattaactaaattcaaattaagattgaagatgctctatttttggaatttgtcaaaggattagtgacaaattttgataaattttttgaattacctagagaatattctaagggtttgatgcaaaaatataaaggcaaccttgacgttttgtatttaatgcgtgagaattggcactgtgaaaaaattggtaaggaatttaaagaaaacgaaatgacagaatgccaaaaatatcggaattatgtgaacatttatatgaatatttattccggctttatgttgaaggtttgttgagttttacatagtaaagcgggaccgggatgagaattcccggtcctccgaggtcccggttcccggtcccagattttgcaaagcccatgtcctggccccggtagggtcggcccaaccgggaaaaacatgcactggtaagaatgtgagtctgagcaaaaaatcaatgagcgaaattggggaaaaggaaaatttttgataaaaataatttaataatatttattaaagttatattttcaaatgcacaaatggtctagtggttaattaaaaaagcagccttttttgttgcaaatttgttaaaaaattgtactcaaattttcaaaattttcccgacggcaccttttggcaccgccggacccacttctttcccaaaagttttttggaaaaagcgtgccgaa

SEQ ID NO: 65522 - DNA, 655 bp, Heterodera glycines
  Genomic contig location: Contig_ID=SeqID_36112; Location=69..723; Strand=+
  SCN-specific regions: Sequence locations=1-58,80-503,551-655
atgatccgattacatgaatttgtggcccggaattttttgcggcaactgccacttctgctgtcaattttattattgtttttacggtggctcttggtgtcactgtgccgccttttgaaattgttacgaacggacaagggaaaaatgatcctttcaagaatcgaaaaatggcgaatgaagcctgttggttctcctcgcagaatgctcattatctgctgcccgattaggtaagcataatcagaacaaatgtgaattggcaaaaggaggcgttgactggcaaattaatgagatggaacaaaatttttcaatgaaatgagctagacgacgcttaaattctattgaattttgggtgctttacataattgaatattttgatgcttcaaattttatacacagcggcccaattttgggctccaagtacaaatatgctggatttttcgtcttagtggtctgtgagttagtcaccaaaaggggggtctcaagttcaattcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggtgaatactagagcaa

SEQ ID NO: 65523 - DNA, 304 bp, Heterodera glycines
  Genomic contig location: Contig_ID=SeqID_36119; Location=483..786; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggataaactctaaatataaaaattccctcaaaaataaaagggcgattgcgcacagccctccctatcata

SEQ ID NO: 65524 - DNA, 202 bp, Heterodera glycines
  Genomic contig location: Contig_ID=SeqID_36120; Location=1449..1650; Strand=-
  SCN-specific regions: Sequence locations=1-202
tcgattttttcagtgtccgtttgggggtactcaaacaattatgggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaaca

SEQ ID NO: 65525 - DNA, 79 bp, Heterodera glycines
  Genomic contig location: Contig_ID=SeqID_36121; Location=255..333; Strand=-
  SCN-specific regions: Sequence locations=1-79
aaccaacgaactgaactcgcgctggtccaccaccttcttcgtatttatgctgttggtcgcctttctgatcgcaacttcc

SEQ ID NO: 65526 - DNA, 1742 bp, Heterodera glycines
  Genomic contig location: Contig_ID=SeqID_989; Location=300..2041; Strand=-
  SCN-specific regions: Sequence locations=1-588,610-886,926-1079,1103 -1697,1719-1742
atggttgtctatcaaagactttttcaagttgttcgaaacgctgtcccagcttggaatccacagacttttatttcggattttgaaaatagttcaattcaggccgtgaatcaggtgaaaaagggaggcaagtattggttgaaatcaaaattataggtttttccactctctcggcaaaaaggttgtttgtttcatatgtcccaatctgttttccggcgccttcgaaaattgccacatttaaattcactttttttggcccaaaaccaagaaccgcatcaaacaaaaaccaatgtcaaatgtttaatttcgctcgcattcgttccaagcggttctgcttatctccatttctgtttgatcatgtcacaatttgatatggaaaatgaggaagttcagagtaataataactagggattagattttatgcagcttcctaaaatttttgcgctcgtaatatgctgaaataggcacaaaaacgattttttatcttggtttgaaacttctacgatcaattttataatgcctatttttgcctatttcggactttttatgcctttttaagtgtctatttagtatgcctaaaaatctaatccctaataataacaattgaattttaaaaaaattaaatcccatttgagaactggccaaatattttgcaaaaaattggcttggatgccgtcaaatttggcaatccgatcctgtaaatgatgatccggctgtgggccattatcaacatgtcgatttgtttatgcgaaactggattgtccaaaaaaattaccaaaaccgtaatgccacttttccaatttcattatggaatatgtgtttgaatttgaatgcgaatttatgccgtaccaataactccttggagtcatggcatagagtttggaacagcaaatttaagtaaaaaattttttttctattttatttttttcgaattttactttttcgatttagaagtggtcacccgaaagttagtgaaattgttaggggaatcgaatctgaagatttgcattgggcaaatgttgttcgagactgggatgacacgcctgtgaatggaattcgtggtaaaggcatgaaaagaaaagaaatttatgttgaacaagacgaaaatttgctcgcgctttacaacacacgtgaacagcgccatccctaccaatatttaagagctgtggcctatcgaatgccggacccaatttaacttttccataaaaacggaaataatttcgaaacaaaaataattattttgcttactaaatgaaatagcattgtcttttttaaaactaccatttactgtcgaaaagtccactgtcgaaaagtcctccccttaaacaaaaattttttctgtcgaaaagtcctttactgtcgaaaagtccgctgtcgaaaagtccttctgtcgaaaggtccgctgtcgaaaagtccggcgcccgtttggattgagtgttgaggcctagatatggtgcaacattcggaccgggtacatgattctcaatcactaccttctgtggtctattttcaagtatcccctttaccgtacgcctttctttatagagccaatcgtgtctcttcgccttgaggtcctcgcttatgccggggtcttgtaaattctgagaaatttttgcgtctaaactcgatttttcattttggagataatcaccactattcatcgcactccgtagagccaaatattccgcctcgggaatcattaacattttctttgcaaatttcatgatgttattttttctaataaa

SEQ ID NO: 65527 - DNA, 1213 bp, Heterodera glycines
  misc_feature (93)..(93): n is a, c, g, or t
  misc_feature (115)..(115): n is a, c, g, or t
  Genomic contig location: Contig_ID=SeqID_990; Location=18..1230; Strand=+
  SCN-specific regions: Sequence locations=1-727,749-857,891-938,976 -1213
atgtttgctgatttattggactcgtccgccgacgaagagcccactgaaaaaatcctcgatctttcgaacgagaatgatttggacaatactcgnatcagtcagtaattgatcactntcggtgccacgagaggctattatcagactcgcagaattgatctcgccaaaaatttctcaaatatatgaaaatcgaataactgatattaaccctatacaacaacttcaattagcattgttgttctatgcaacaggtgaatctacttttttgctattagcttaaaaggccgattatttggaggtgatcaccaaaaaacattggcggcagcttgtggtgtccatcaaacgaccatttctcgagccgttagtttagtaacggatgctcttcttgaatttgcgcatcattatgtatgctttccatcggccgaacgaatacaatcagtcaagaccggtttttatttggtgattaaagatcattagtagttcaagaaaaatggcaatttctagaaagccggaatgcctcaagtgattgcttgtgttgacggtacatttttaccaattcaacgtccgacaaaccaattagattatgcctatgtatgtcggaaaggctttactgctctaaatgcaatgggcgtctgtgaccatcaaaagaaatttattgcatttttttgtaactaccctgggtcctgccatgatagttacgttttacggtatttttaagattctgacaaatataaaactttattctttgattagttgctctaaattttattcgagaatggaggaaggcactcttgacggaattgtgctgggcgattcggcatacccgcaaaagaggtggctctttactccattaagaaacccacgcacagaaaaagaagaaaattataatgctgcgcacgctcaaacccgggtggccattgaacaatgttttggcatttttaaaaatcggtggagatgcatgatgtataaatgcagattatcaccgggtattttgttagttaaatggcactgctaaaataacttttaagaaaagttgacaaaaattgctactgtttgtagcatgttgcataacatcgcaattgattgtaatgcaccattaccaagagatttgttggttgctgctgacattgaaggagaacaacaaggaaatcccgatgaaaatgttgctcaaagtgcagaagcaatccgaaatgattatattaatcggaatttttaa

SEQ ID NO: 65528 - DNA, 601 bp, Heterodera glycines
  Genomic contig location: Contig_ID=SeqID_7656; Location=2113..2713; Strand=-
  SCN-specific regions: Sequence locations=1-424,447-601
atgtcttttaaacgcgtgaactctgcccaacccaccgccgtgccaatggccaaaaaatgggacttccgctcaattgggtaagtttaataagcaataacatataaatagctaatccgttttagaaataatttcccgatggagccctttaaacttattgaccaccaaactacaaaatgcgaaaaacataacggaatttgtgatcaacccggatgtggagcgccccgatgaaacactgcgagaagcgatcgatatgatgataaagaattccatatcgaagacggaggagacaatggggcgcaaagtgaaaatgtttggcgtggcattgactgctggacttggacacccaatttggctgccgtaccgacccttcccccaaaacaacgcggatgttgtcatggaggaaatcaataaattggggcagagcggaggagaagaaggggaggaggacaaaagaacaattctgctttcggaatcaataaagatgaaggttacctgtgtagcgctgccagctggagagggaccgcgaaatgtgcacaaatttgattttggtttcaaggagaaacagcggattaagttgcatagataaattttaatcaataaa

SEQ ID NO: 65529 - DNA, 375 bp, Heterodera glycines
  Genomic contig location: Contig_ID=SeqID_36122; Location=108..482; Strand=-
  SCN-specific regions: Sequence locations=1-189,211-236,261-375
atgcacgcgttttgcgctcgagatatttatcattggccttgtcaatccaaagcgaaacaacaaagatggtgttttgagcgaataaagggcataggttattttgaagaagtgtcaaagaacatgcatcaataagcctgcaaaatttaataagtggaaaatccatgagtatagaatttattttcagaaagtgtccccagacttttggaaaaatatatttgcaatttatcaacaattttgagaagtaagttagaaatgataaacttcccgattcaaaccaattttcgttgctttaattaaccgcgataaaaacatttgaatcaattaaatagcttctgagataataaggtttatcataaaatttcatttaaaaataaa

SEQ ID NO: 65530 - DNA, 394 bp, Heterodera glycines
  Genomic contig location: Contig_ID=SeqID_36127; Location=139..532; Strand=+
  SCN-specific regions: Sequence locations=1-161,183-367,389-394
tcaaagtcgagtgaaagcggcgaaccgcctgcaaatggagcagaagtggcgcaaagtcgcaagaaacgtcaggccgaagaagtgaccactgaagagccaccatcagaaacaaacgatgccgaaggtgccgaggatcaccaatctgcggcagcgggaaatggaaaagcaccaaaaaataagggcaaaaagaacaagagcgacagcagcgactcgtcaagttcgtcgagttcgtcgagcgaaagtgacgagaagaagaagctgaagaagaagaacaagcactgagcatcggtcgactcactaatgaggccgcttaattggattggggtcattagcgaagagtggactgtcacaattaatgttgtcaaaattgtaaagcttttattctttgatggga

SEQ ID NO: 65531 - DNA, 552 bp, Heterodera glycines
  misc_feature (517)..(517): n is a, c, g, or t
  Genomic contig location: Contig_ID=SeqID_36128; Location=15..566; Strand=-
  SCN-specific regions: Sequence locations=1-57,148-203,290-290,340 -340,431-450,487-517,542-552
atgtctgcggaatcgccaacaacatcacaacgccgtgctcgcagtcgcaagacgaagaaacgtgcggccagcgctggcgagaccaaaccactgcgacgctcggcacggattgcggcacagaaagcggcgaaggaaaaggcagccaaagtgacgttttcggacagcattcctcctccgtcgtcattcatttccccttttttcagcagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcacaagaagaaacaaccgctgaagaagaaggcgccgggcccgcgcagtcgcactcctggtcgacgcgtgaagaaaccgtcaacgaagaagtcacctgctcctcgccgtgcaaaaacctccaccaagaagcgcggacgtcctgccaagaaagcggaacaagccgaaccatcggacagcgngacagtcgccgacagtgaccgcgacgacagcgaac

SEQ ID NO: 65532 - DNA, 341 bp, Heterodera glycines
  Genomic contig location: Contig_ID=SeqID_36129; Location=345..685; Strand=+
  SCN-specific regions: Sequence locations=1-341
atggacacgggcaaaattcctgaaatttggaaaaagtttattgttatacctctctttaaaaaaggtgaccgaaatgacccacataattacagacctatttctcttacgtgctgtctatgttgagttatggaaaaaattattgcaaaaagcatttataacttccttcatcagaataatttaatatccgaacatcagttcggttttgttaaacaccgatctactaatactcaactaattacagtattagaagattggtacgacagcatatacggtaagaaaatatcgactgtatttatgtggactttcggaaagcttttgattcccttcctataaacatttta

SEQ ID NO: 65533 - DNA, 1085 bp, Heterodera glycines
  Genomic contig location: Contig_ID=SeqID_7657; Location=1174..2258; Strand=-
  SCN-specific regions: Sequence locations=1-883,905-1085
atgaaacactgcccggaaaatttcaacgaattttgccgcggaatggaagatattttgagcgaatgggattgtaccgaaatccaggcattcaatgaattgtgggaaggagtgaagcgaagagcggaagcgttggacgaatttgcggaacgactttatgggattgttgaacgcgcttacccaggtttgccgccgagctttgtcagcgattttgcgataaagcacttaattcgtgcgatgggaaatcaggaaatttcggttggattggaaatagctctccgtccaggcatgagcttcgacagtttcgtcgctctcgcagttcgagcagaggtagtgcaaaaggccactaagtcggccgagtctggaaatgagcgccggccgaattttaggcagaaaacgacttttcagccgcgaaatttcctaatgccaaggacgaagccgatagtttgctacaactgcaacaaagctgggcatatatctcgcaattgttgaatttactttggaccgaagcatttcgactgtccacaaaatccgccacaacatcaaaattttgtgaaaaaggcgccgattttcgaaaaattcagaaggcgagaagaaaccgaatgattttaagttgtctaatcaaccaccggcacaacgaacgaacacggaagctggaactaaattgaaagtgtccaatcgaccgcacatttcgtcgtcgtcatgttatgtaaaaggaggaaagaatgaggaaaacccgaccgaaaattccgaattgtttttaaattcaattgttgctacgttagttttgttcgccggtgcagtgtcgaagcaaaagtcaaagtgtggacgaatttgaaaaagtaaaggctcaatgagtagcaccgacgaagtgaaaggacgcaaaaccgatggaaaatgagcccaaagcgctgaggacatcgcttcttagagggcgaggatgtgatatcattgttgatttaaaatatgtttggcattttgttgtttaaatttaatgtcatttttgtttgtgattttgttagtagtagttagtttatgctgtcgtcagcaatattgattgtcctcgcctattttaatttgaaattaaa

SEQ ID NO: 65534 - DNA, 382 bp, Heterodera glycines
  Genomic contig location: Contig_ID=SeqID_7657; Location=54..435; Strand=-
  SCN-specific regions: Sequence locations=1-94,157-382
atgccatggacaagagcaagtgtgatgccagaaggaacggagtatgggagaaagtggataaaggacctgagagaacctctaaaattagcgcccgtagctcagttggttagagcacggcacggattgctggggtcgtgggttcgagtcccaccgggcgagttaccttttatgttctacatggcgctcctgggcggatcccctccacactgccgggaccactggaccaaggagagtccaagtccgtcggtgaagtgccaaggagagcccgagggaccggtcttccgagggaggcggaatgtgatgccagaaggaacggagtgtggtagaaagtgggataaaggacctgagagaacctctaaaagtagcgcccgtagctcagttg

SEQ ID NO: 65535 - DNA, 993 bp, Heterodera glycines
  Genomic contig location: Contig_ID=SeqID_36134; Location=44..1036; Strand=+
  SCN-specific regions: Sequence locations=1-50,72-327,349-350,372 -428,459-504,623-703,727-765,796-843,865-893,915-972
  Gene Ontology: Mol. function=calcium/calmodulin-dependent protein kinase activity; Cellular component=plasma membrane; Biological process=calcium-mediated signaling
atggttttcgagtatgtggagaaacggtatgtgcgagttgaatttgaacacacaaattttttggcatttttcgaaatagtctccgaaaaaggctaaaatttaaaaaattgcccaatccgttttctttcagctcattgatggaccttcctacggacaatccgttgtgcgaatttacggcatggaaatatttccgagacgcgctcaaagggctcgaatattgtgggccaattaccatttcaaaaaatgccgtaattaatgacctctctctggttttggtttttcagtgcatttccaaaaaattgtgcacagagatttgaagccgtccaatttgttgttgtccgacacagaaaatgtcaaagtgagtcgccaaaaaattgccaaagattgagagaaatttcaaaaatgagaaattttctaattataagtgcaaaattcaaatttttgaaagtttaattaggggagcagaattgaaaatgttacaaatccttattttacgaaacattgaaattttttataatttaaatttttgcaaaagcaaattctaaattaattctttaaatatttttttctaaaataaaattgttatttaatttttaaaattttaattttttaaaataattttgccaatatttttcacagattgccgactttggagtttcctgtgaatttgaaggtgattttacgacaataaaaagttaggtaattaatttattgcatcattttccttaaggaattgatgcctttttgacggtgaattgtggcggcaaaattttgaataaaaatttaaaaaattttccattcatttttcagggtacggccggcactcccgcattcatggcacccgaggtaaatgccaaataaaattttagaaatttgatcatagtttctgaaaggaaaatttcacgcaatttttgttggtttcactttttccaaatcctgatcagaaaatagtcagggtaatataaattcgtgacaattaaattaatttacaaa

SEQ ID NO: 65536 - DNA, 688 bp, Heterodera glycines
  Genomic contig location: Contig_ID=SeqID_36137; Location=1..688; Strand=-
  SCN-specific regions: Sequence locations=1-145,168-175,198-205,228 -325,348-385,408-535,558-625,648-688
  Gene Ontology: Cellular component=secretory vesicle
agcattccaatcactgggactcaacccatcagcatttcaatcactgggactcaacccaccagcatttcaatcgctgggactcaacccaccaacatttcaatcactgggactcaacccaccagcattacaatcactgggactcaacccaccagcattccaatcactgggactcaacccaccagcattccaatcactgggactcaacccaccagcattccaatcactgggactcaacccaacatcatttcaatcactgggactcaacccaccagcatttcaatcactgggactcaacccaccaacatttcaatgactgggactcaacccaccagcattccaatcactgggactcaacccaccaacatttcaatcactgggactcaacccaccagcattccaatcactgggactcaacccaccagcatttcaatcactgggactcaacccaccagcatttcaatcactgggactcaacccaccagcatttcaatcactgggactcaacccaccagcatttcaatcactgggactcaacccaccagcattccaatcactgggactcaacccaacatcatttcaatcactgggactcaacccaccagcatttcaatcactgggactcaacccaccagcattccaatcactgggacacgacccaccaacatttcaatcactgggactcaaccca

SEQ ID NO: 65537 - DNA, 962 bp, Heterodera glycines
  Genomic contig location: Contig_ID=SeqID_36140; Location=23..984; Strand=-
  SCN-specific regions: Sequence locations=1-19,42-89,111-155,189 -277,304-356,482-538,564-588,614-645,670-746,768-877,902-962
atggacgacgacaatcggcagaatgaaaagaaaatgacagcagatgtggtgtcaattgagaaggtgatggatgatgatgatgatgaattgtaaaaaacattttgccaaagaatcaacagaaaaggggggatacggtagcaataaagtacggtaggtttaaagaaaaataatatcagtattttatttatactaagaaatgctaataaataaaaagtagagtgccacgggaccgggaatttttgccaaaaccgggaccgggacttgccgggacctgagaagccgggaccgggaccgggacctcgattttttttcgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggattaaatcatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagattttcaacaaaaaaggttggtttttgggattaataggctcaacaatttactatggattttcatttaaaaaatgataaaatatgtatcaatttaaaaaaaactatgagtaatcatattttctctataggaaacccacgagtatacaaaaagaaaattcaaaataatttaatttctgtagagggattgaaccaagggaaagaagaagggaaagtcaaggagactagacattagggcatttgcacacttgggcaatgttactttttaagaatataataaa

SEQ ID NO: 65538 - DNA, 1757 bp, Heterodera glycines
  Genomic contig location: Contig_ID=SeqID_7659; Location=461..2217; Strand=-
  SCN-specific regions: Sequence locations=1-17,57-185,240-355,377 -389,451-578,600-1021,1168-1620,1665-1704,1731-1757
caaatcccattatctctcttctcactaaaattttcttcttctgaaagtgccttttgggggacgacgaaatgtgtccttcaaaaacgcaacacttggaacagttccattcgcttaatattcctatgattttcattctctccgcacttttctcactttctgcgacattcgcacagtttgtcccggccaaaagtcagtgaaactttttaagggaaaggcaaagaaagggattttcacctcagatcgctgctacagttgcgcatcggacaatatgaaagaagtgagtttagccgggggggggggtattttgaggcttcaaaaactcgaactttgaagctaattaattaatgtatataagcccccctaaccgcccgtgggcaatcccagaaatcatttttaaatatgtttgtatattaatgttttgaatttattgtttaaaaataatatttaaaagaaaaagacaaatataaatactaaaactatgcttgataggttctggttcttggtgctcatttgctagccttttgacttatgttagcacatgaaaacggtaattaccgtccctttgtccttaattgccgcttttctctgttttaaacctttcaaattaattaaatggaaaaaaaatttcgaaaagccgcaccattgttagccgtccttctcattactcctccgctttttgtccccagaatttcctcacgcgcagccgcggacccccggggcgcgtgcgcgagccgcgtctgttcgattcgatgtgcgactcggacacgtgggtaattcgggaaaaaagtgccatcgaatgtcagggcgcttgcttcaaatggcagcagacgctgaacaattcgggcgtcctttcatacgccaccatcagaggatgctacgaacgggtgagcatcgaatggcacggggaaagcgaaacggcggcggaaggaattgcgaaaagcattggtcggcgggacaatgctttttgttaggccaaatttgataagggatgtacgagattctcgagtcgagaaattcgaattcgtctcatttctctgtctcggcttctctcatttctctgtctcggcttctctcatttctctgtctcggctttttcttggggtgtctcgtcccctctcatttctctgtctcggctttttcttggggtgtctcgtcccctctcatttctctatctcggcttttttccttttctattctcgatgaaattcactccccctgatcttttcagatgttcgattcgtccgttggtggccccactccctcctccgacagttcgtcgtccgtcgccttcaacactgaatgcaaacacacgcaacgcgcgttggtctgtctggacgagttcagctccgtcgaggagtccacctgctggtgcttcggcgacttttgcaacgcggcgacggcgaaaggcgacggaattcgaaatgccatccgagcgacggcatcggcactttttgcatcatcacttttcatgtcattttggaaattgcaacaaataaattgcaaataaatatacaaaattaattacaattaagtgagcggggaattggataaacaccgaaatttatctagaaaaagtgaaaatactcaaaaaattttaaaaggaattaaaataacgaatacaaaaaatgaaaaataaaattaataaattcaaaaatcatttaaatgacccgaaacaaaacataaaataaatagcaaagctaaaatgctaatttttaagaaaatgtttgtttattttcataataattaatttgttccaa

SEQ ID NO: 65539 - DNA, 1436 bp, Heterodera glycines
  Genomic contig location: Contig_ID=SeqID_7660; Location=768..2203; Strand=-
  SCN-specific regions: Sequence locations=1-375,397-856,882-1226,1250 -1260,1299-1301,1340-1436
  Gene Ontology: Mol. function=3-oxoacyl-[acyl-carrier protein] reductase activity; Cellular component=cytoplasm; Biological process= lipid metabolism
gcaatgtcatccaatcgtcgaaggacgcggcttatttggcccgtcacatcggcctccgagttggcgttcccgtccatgtccctgccgttactgttaacaggctttgcggctcgggcttcgaggcgattgcgcagggaggccaagtaggagcgaccaaatggaaaaaagttattttcgctttgtttttcagcaaatcctcgcgggtgactcaaaggttggcaaaataaaaacaaaaaattttgtggagacgtgggctgttactttgtttttcgtttttaggttgttttggcgggtggaactgagtcgatgagtcaggcgccgttcgcagtgcgcggcgctcgcttcggcacacagctcggtgccaagattgaggtccagctttggggaagggttttttcaattcaatatcgatttcagttcgaagacgtgctttggcaaggacttaccgacgcgcacgcgaacatgccgatgggaatcactgcagagaatttgggtgccaaatacaatgtgacacgagaggaggccgacgcttatgccattcggtcgcaaaaccgctggagactcggtaagcatttgacttacgtcaatttcttcaaactcattcgtattttgcctgatatttccgattcttttgaagcttaaaatatttgtcctttcatttcagcaaacaatgccggctatttcaagtccgaaattgtgccggtcaaattgcagggcaaacgcggcgaggagaaactgttcgatgtggacgaacacccgcgggaaagcaccgccgagcaaatggccaagctgaagcccgtcttcaagaaggacggcctcgtcaacgcgggcaatgcgtcggtcggttattatttgatattttcattattattgtaattttcagtaaagtggccttcggtgcctagtatagaaagtcgtaatctttcggtttttagggcgtttgcgacggtgcggctgctgtcgttgtggcggacgaggaaagtgtgtccaagtaccatttggacccgttggtgcgtttgttggggtggcacgcggtcggctgtgaccccacaattatgggcattgggccggtggaggcaatccgaggactatgcaaaaagacgggcattgcgttggacaaagtggacattgtcgaggttgagggggtagaaaagttgtaatagatttttataaaccattttcaggtcaacgaggcttttgctccgcaagtgctcgccgttcaggtcaaattaaaaatacatcttatttcatacatttagctttaaaacatttgtaaatttttatattttatcttttcaatggttttaaaattcgtttcagaaggaattgggcttggaatcggatcgtctgaatgttcatggcggtgccattgcgcttggccaccccctcggcgcgtctggcgctcgaatcacggcccatttgacacacgagctcaa

SEQ ID NO: 65540 - DNA, 706 bp, Heterodera glycines
  Genomic contig location: Contig_ID=SeqID_36142; Location=193..898; Strand=-
  SCN-specific regions: Sequence locations=1-245,268-405,432-529,561-706
atgtatggcaatgatttgttggcacggcttaaagacgaaacggaaggacctggcgagaaggattttcaatatgcactggagacattgttgggaagccaacgggaagacagcacaacattcaaaccgaagaaaatcaaagcaaaaaaggtggtaaatttttaaaaagcccaaaatgagagagtttccctggggcttctttcaatttccgtcttatcactgatctggtgtcatattttgaaatttctgtttcaaattataaatgttttctgtcgtcatatcatatttacgacatcaggaatatgatataaaaaatggaaaaaaatttggcaaaaagtataacattgaggtcgtatttaacaataacatgaacacgtgctgagatgaaccgcaaaaaatctcagtgtcaataaaaataattaaatttaattttacgattcaatgattttcgatagcaattttaacttgtgaaatagtaataatttcaacatacaaattttacgtgttagcaaccttggacaccacgtaaatctaaatttattttattatttttattttaaattccatgtcatcattttttgtttatcctttttttacattgttgtccataaatgaagcaatttttagtcccaaaatttcaacccattccattttattcttgcatagtgtcacacaattgcagggacttccacaatgaaatgaaaataaa

SEQ ID NO: 65541 - DNA, 567 bp, Heterodera glycines
  Genomic contig location: Contig_ID=SeqID_36146; Location=90..656; Strand=+
  SCN-specific regions: Sequence locations=1-85,107-112,138-182,220 -430,452-567
  Gene Ontology: Mol. function=protein kinase activator activity; Cellular component=plasma membrane; Biological process=cell surface receptor linked signal transduction
atgcccattccgatggaatttgcattacccgaccacacccgtttgtccttggttgatttccctctacatctgccgcttgaactgcttcaaattgatgccatccttcaaatactcactgcaataatgcttgaatacaaagtaaattagtttgaaaaatattcaaaaattcttttgtttttgtgtaaaattttaatttttaaattattatcataaattattcattgcctttttaagtctaacaaaaaatttcaattctaatattatttacccttcaaatatgtgggtaccaaacagggacggcgttccgaggcccctaatatttcggaaattgaatgcttgaacccaaaatatggaaaagccggttttcgccaaaaaaattactaccttattttgttaagaaatgtgctaattttcaataaatttgcccatttttcatgaaactttttacaaattctttataaaatacgcaaattccaggtcattttgcagtcgcgcaactgtaacgcagtcagtgtttgcgtgatggcattggtggcacttttatatccgttagagtatgtacaataa

SEQ ID NO: 65542 - DNA, 73 bp, Heterodera glycines
  Genomic contig location: Contig_ID=SeqID_36147; Location=1..73; Strand=-
  SCN-specific regions: Sequence locations=1-73
aatcgaacgctaacggacgacctaatggaaaaaaatccccgaaggagagaatttaattaaatccattccttcg

SEQ ID NO: 65543 - DNA, 864 bp, Heterodera glycines
  misc_feature (415)..(415): n is a, c, g, or t
  misc_feature (441)..(441): n is a, c, g, or t
  misc_feature (464)..(464): n is a, c, g, or t
  misc_feature (473)..(473): n is a, c, g, or t
  misc_feature (510)..(510): n is a, c, g, or t
  Genomic contig location: Contig_ID=SeqID_36148; Location=129..992; Strand=+
  SCN-specific regions: Sequence locations=1-13,35-76,118-173,195 -785,862-864
atgaaagcagagaaaagcaaagtaaaaatgacaattagaagaaacattgtgaataggtatttgaataaatattagcaattaaataatatattttctaaattttagaaatattttattgagtgaatgcaaatcccgtgaacgatttacatttcagccatttttggccaatgatttcaaaaagcgcttttttgttgacctttgcacaaattcacgtgctttgccgttgaaaatgtccgtgtactgcttcaacttagcaaagtgaaaagttggcgtcagaatgcgtcgctgtcttttccattttgcatcggtgctcagcagcaaaccctcgcccagccactgcttgaacaagttgtaatcattgccctttgtcagttccatcgaattttccaatatttcctaaatcaaatcatattcnccttgaaatttcatttaattttactntggcactctctgaatccaatgcncaaatgtgnagctcagaggcaaaccaccagcacatcgcattgtgcncatcgcgaagtgcccgatttgcatggccaattagaaactccggcacatctgctcattttgaagattaattaaaaatgaaatattgtcatataaatgtgagaccatatctagattttgggaacaggtggagatgaccgatcagcggaaccctggcaatttgccaaaaattgtcggacactttcaaaagtcgccgataatttgaaaaggcagtaaaaagccaaaaaatgaaagcagagaaaagcaaagtaaaaagggcaatcagcagaaacattatgaatatttgaataatattaacaattaaataatatttttatctaaattttttaaatatttcatttaattgattattttgga

SEQ ID NO: 65544 - DNA, 583 bp, Heterodera glycines
  Genomic contig location: Contig_ID=SeqID_36150; Location=363..945; Strand=+
  SCN-specific regions: Sequence locations=1-547,575-583
  Gene Ontology: Cellular component=extracellular space
atgtcactgggaaggaacaaatcatttgccccggggcttttgctgataattcttccgctgatcagtttcaacggacaaatcgcgatcgcttcacccattcccaacgccaaagaaagaaacaacgaaatacaagcacaggcatatgatccatcagcagggaagttggcagagtttggagcgagagaaagacgccaaaacgcgatgctttgctgctgtcagatgggcgcaggcgggggacctcaaatgccaccaccgatgggaccacagatgcctcctcaaatgcccttaggaccacaaatgccaccacctatgggacaacaaatgccattgggaccacaattggcaccaccgatgggatcacagatgccacctcaaatgccattaggaccacaaatggctccaccgatgggaccatcgctgggacctcaaatgccaccacctatgggacaacaaatgccattgggaccacaattggcaccaccgatgggaccacagatgccacctcaaatgccattaggaccacaaatggctccaccgatgggaccacaaatgccaccaccaccaccaggccaagcgaatatgg

SEQ ID NO: 65545 - DNA, 1298 bp, Heterodera glycines
  Genomic contig location: Contig_ID=SeqID_7661; Location=560..1857; Strand=+
  SCN-specific regions: Sequence locations=1-741,763-770,795-961,983 -1071,1094-1298
ctttatctgcagcgattgttggcttttggtgttcgattttcttgcgccttctcagcttggcctcgaaattgcactgattagccgccgctttgacatttacgtggatgaacacttcaagacgcgcaaatggacgttgggcgaaattcgaatttgctacaaaattgaagaaaatggcaccaagcaaatgcatattcacgatgccgatgcaaatccattgccaatcccgcaaaatccgttgccgaacaaaatcatcggattccgaggcattaagatcgtgtaagaaaccgatcatccagattgttttgatttaggacactgactaacattttcagctacatcgatcaaaatgtcgtcgcatttctccgccgttttcaccgttttttctccatttgttcaacggaattgggcattatcacgtgcaatgatcacattttggaatttgttttgctcaacatttggccaatgctgcacgactccattcgtgcgatgtattttaacaccatcacttttcgttgtttgcgtcaattggccccggcactgctcagcgattctccatcacttcgctttgtctctttcaatgatgccattctccctgttcttccgcctgatgaaagtgccaatgcgacggatggccaagcggtggcaaaatggctgttcacgccccattcggatggtatgcccaagtggttcagctgctctgttaattcacttgatcaatggtcttcgacactggaacagttcaaaacggtggatcattcccccctatttaattgggttttttgtcccttttttaggcattttccaatgcttcttcttcagttacttttcgcattaactttctgctgtcttctccgattgactctgcagttgtgccatttgatctgatcaacgaagtgactgtggagaaattgacactgcaacaagaagacgaagatgtttggctcacgcgttgtccaattggatgggatgagatgaaatggggaaatgtgcaggatgaattattgaatgacgatccactgaatgcaattctatttttgatcagagaggacagattcgacgacgggtgaacgattttaaaaattcaaattgaattgattttaatgatgcaaaaatgcggttaataaacattgaacagtatatgatagatacaaaaaaaacaaaataattaggatgttagttggttgactcataaaatgccattggccccataaaaattgaatgctcttaaagtgtaattaaatcatcatcgttttttcaggcttctcgacgcagcttcccaagggccgagtgatcactga

SEQ ID NO: 65546 - DNA, 1198 bp, Heterodera glycines
  Genomic contig location: Contig_ID=SeqID_7662; Location=668..1865; Strand=+
  SCN-specific regions: Sequence locations=1-23,46-539,567-1198
atgaatcgacggtaagaaaaattttttaattacaaattttcatttacccatacatttttaacgcatttcagttggatttgtggcgacgtttggatggacattctcccatcgtttgaccatgcccaacttggcctcaaaatggcattgctttccgaccgtttcgatgttttggtggacgcgcatttcgacagaaaaagcgaattgacaatttggaaagcaatcgaaattcgcaaggacaaaggacgaaatgcaaacgaaaatggaccaacaccgaaatttgttgtacggatcggtgacaatgacatttctttggaagaattgcctattggaccgtggggtgacaatgttatgaagtttccggttgtacttgtccatggcaattttgtgcaattttcgatgccgaatcgtccgttgcacaacaaaattcgttttcattacctttatatcgagtaatttgaaccttttgatataccacttacctattaaagcattttaatatttcttcagctacattgactactctgtgctcgcatttctccgttccaacaagccaatttgggacagaatgggcaccaaattgacattgtggccatacagaaccgagaaagatcagtcaatttgggatgtttttgttcgcgaaatttggccaatttttgcgccaaacattcgtcatttgggctttcacgatggcgattatttggacaaattgcgtagtcacacttcaccaacaattctcactgatcttgatcaattgaatgcaattgattccggttttctattcccagaaggaattgctgattttgatgtgctgaatccaactgctgcccaagcgttgaccaaatggttgcacactccgagcaaaaatggtcaaccgaagaatttgtattactttaattctccacggaatctcggatgggtcaacagcttcaaagaggtcgtctcgccagaattttcattaatttgtttttgttttaccaatttttgtgtttaggcattccgtcgtgccaccacttctatcagttacaaaattcgatttaatttatatttggaaccaatgccaattgaaccatttgaattggtgaacaaacggacgaaagaaaagctgacacctgacgaaggagatcgacgaattcgacgtaaatgtgtgtaattggctgttgaacggtgcccattggggagacggcgacggtgccagcaa

SEQ ID NO: 65547 - DNA, 622 bp, Heterodera glycines
  Genomic contig location: Contig_ID=SeqID_7663; Location=142..763; Strand=+
  SCN-specific regions: Sequence locations=1-248,275-286,309-622
atgccaactgaacaatttgaattggtgaatggacggaccaatgagaagctgacactgaaacagagcaaggaatgcaatttggttatttggctgttgcaacggtacccaattggggagacgtcgacggcgccagttaaatgggaagacagcgtaaatccgagtgccaatttgaacagtatcagatttgatctgtggagtttcgataaatccattgggtgagcagcagcaatagcatttgaattttatcgaaaaataaaatatttaattaattttaggccattgtcgccaccaacggaagaagaaaaagcggatcaaatcaatgaaaatgtcgtctgattaagtgtacggaaatgaataattgaataattctatttgagaaatgatcgatctcaatttgttgtgcttattttctctcagaaatgcttttttaattgtttcgttccaattatataaaaatatgcttttttgttgagcaatttattaataattagggtttgtaatcgagaccggataagagggtcggtcgaacggtttcggttaaaaaaccgaaccgaaaaaaaccgaagaaaaattttcggtttcggtttttttgaatttttttatcttttcccaaaaaaaaaca

SEQ ID NO: 65548 - DNA, 505 bp, Heterodera glycines
  Genomic contig location: Contig_ID=SeqID_36152; Location=228..732; Strand=+
  SCN-specific regions: Sequence locations=1-176,201-222,267-318,356-505
atgtccagcgtggacttggacctgtaccagccgagccgggcaaaggacgtgcagacgctgtaccgggagtacgcactgttgcgcgagacggagcccgactgtcccagcctggacatcagcgacatcacactgtgtgtacactgtacagtacacccaaggggggtgaggtgcacaattcatcccctccctcccctcccgccgtttcccccgtaaaatcttaagaaaattttcaaaaatttgggggaaaaattagaaaaattttcagctattttttgggcaaacgttagaaaaagttatagaaagtctttaaattttctcatataaaattttataattttttaaaaatttaaaaattggggagggaacgagctgctcccagtgggacctgaggctccaagaaagccggaaccaaatttcacctaacaataagcgcttggttgatctcgcaaaaattcgactcatcgaaaaatttaaatttgcctaatcatcactctgatttgctgaa

SEQ ID NO: 65549 - DNA, 60 bp, Heterodera glycines; identical to SEQ ID NO: 52045
  Genomic contig location: Contig_ID=SeqID_36153; Location=517..576; Strand=+
  SCN-specific regions: Sequence locations=1-60

SEQ ID NO: 65550 - DNA, 285 bp, Heterodera glycines
  Genomic contig location: Contig_ID=SeqID_36155; Location=197..481; Strand=-
  SCN-specific regions: Sequence locations=1-44,66-155,203-229,259-285
aacaccgaagagccttctgagtggaacaaatgcattgaattattggacagaaagaaagagacggacgagaaaatctcacaacaagtgacacttgtggcgaatttgggcaaagcattcgacgagggcattcagcagaacgaaggcgaagaacagcgggaagaaaaggagaaggaagaggttgagaaggaggaggagaaggaggtgcgtttggaaatcgaatggaacggacttttagttttagagaaaaagttttttcgatttacaattattggaccaaaattctaa

SEQ ID NO: 65551 - DNA, 786 bp, Heterodera glycines
  Genomic contig location: Contig_ID=SeqID_36157; Location=130..915; Strand=-
  SCN-specific regions: Sequence locations=1-581,613-631,653-786
gagaaaatctttcgttctgtgctctgtccaaaatcgttttggtctctttcgcaggcgtcgcgcgaccacctcgaggtttgcttacggaatttcaaaaaatccgggacgaatttcaccaaattttcctttttaaattgtggcaaaacccatcaaaaacattcggaattgtgctcgaagttagcaatttcaaaattttagctgcggaacatgcaaacagataccggaaaacatccttggacccttaaattttccctccttttttcgttaaattttcccatttttgcttccttttcagcattttcttcccctcccttccatttcgtccgccattaaatcatcgtcagtttctgtcgctcgtcgcaattgtggcgccccgctcgacgagttgctcagttgcgcattcaccagcgacccaaatttttgctttggcaatccgttggccaaattttttgcgcgcattcgaagtaaggcgaacaaagatggaagagttttgaaaattgggccctagagaaaaagctaaggttcaatggtttcacattgtgggaggaaatttacgtataaatttagaaaaaaaaatttggaaggaaaaataattccaaaaacatttatttatctaatttaaaattctataaacaatttttgttttcaaaatcctcaatcttcagatggttacttcagttcacccgaacaagtccaactgagggaccaccggcgagtgctgtacgaccattacattcgccactatcagatgaacttgctgaagaccctgttgatcaactcccatgt

SEQ ID NO: 65552 - DNA, 49 bp, Heterodera glycines; identical to SEQ ID NO: 51181
  Genomic contig location: Contig_ID=SeqID_36158; Location=523..571; Strand=-
  SCN-specific regions: Sequence locations=1-49

SEQ ID NO: 65553 - DNA, 63 bp, Heterodera glycines
  Genomic contig location: Contig_ID=SeqID_36160; Location=500..562; Strand=+
  SCN-specific regions: Sequence locations=1-63
atgccgactgaaacaacggaatccaacgaaaagaaagaaaatcccgaagacatttcgagcact

SEQ ID NO: 65554 - DNA, 1380 bp, Heterodera glycines
  Genomic contig location: Contig_ID=SeqID_7664; Location=34..1413; Strand=+
  SCN-specific regions: Sequence locations=1-132,155-377,399-963,985 -1380
atgacttcaagaagtgccaaaagaagtttgaagaaaagtgatggcttgtccggaaaagagtccgtctcaaaagcacagcaaattgagcaattttttggcattgacgaggcaaaatgtgaaactgccgaggtaagaaattatcagcaaaaagtgagaattttgaaaatttcaaattttcgactttgttcgaattcgtgctttttttatggtcgtgtgaactgcaatagagccaaaaattgcccgaccgacatcggaattatccgtaaattacattcacactttgccattttcagcgaacgtcgaagtcgccgagtgccaagcgaagccgaagctcaacaaacacggcagtgcaattgctgaaaaagatggcgaagcacaaaaaggaattgaacagcagcaaagaaacgcgacgagaagaggacgagagggaaatggagaacattccggacacattggacgaactgaacagtcgggggacggaggacgaaaggggcaaagggtgcgaactttggcaaagtgccgaaaaagacaaattaaaattagacaaagcaaaaaatgacagaataaacacaaccaactttaggtgttctagaaaagtttcatttctcttcaaattctgcctttattttcggcagccaaaatccgaacttttacattcaaaaaatgcatttgtgctaccaatcccggaaaatgccacttgaatttggggattacaaattcatttttctgaattgtcagaatggatttctgctcttcatcgaccattctgttctttaagaactgaaagtgtgcagacggtgaacgaattggacgaattgctcgactcggagacggccaaacgcattcaatcggaaagcgaagtgaccatccgattttgctgtccgctgctcgccaatgtcggctccgttgggcaatgtctgtgttttgttttactttttcccattttattttttgtttttctttgtcagtgttttccatcgacgacttttcccccctcaaaactctctcgtcgtcttccaatctttccgtccctccctttctctgtccgttcgttttccttttcctctctcgccctcactcgcgccttcgctgcactctcttcgaccgctttcgccaaagggccgtcgccgccggcggagcgatcgccgtcccttacgacacttttgtgttcgccgtttgctacgcatttcaggcattttttggccaaaaagatggccatttgtcaattttattcttatttaggtctctcccattgctttgcatttttccgatgtgtcttcggacgtttcatttgagcagcaattggacaaattcgctgctcttttcgtctcctcaaaagttcgatgtgcccagcggaggcggtgccttttctatgcgaat

SEQ ID NO: 65555 - DNA, 361 bp, Heterodera glycines
  misc_feature (57)..(57): n is a, c, g, or t
  Genomic contig location: Contig_ID=SeqID_36162; Location=1060..1420; Strand=-
  SCN-specific regions: Sequence locations=1-73,95-171,227-361
atgagtgtaattttcccatttatgttcatcgtaattccctcctccccctgtccaccncagggtcgaaaaagccgaaggaggctcgaccgccatcgccacagccaggcgagcattgtgagcggaatgcttggtattttcgaagccaccgaaacaggcggtggtgacgacgacggagaagatggaggaggagacgcaggaggaggcggagaaggagaaggaggcggagcagtcgccaacgaccagtgcccgtcagtgggaacagttgccggacaaatgccgtgcctatttggagttcatacaaaatcaactgggcgtacccgtcgaatacatcggagttgggaagggacgggagcagctgatt

SEQ ID NO: 65556 - DNA, 72 bp, Heterodera glycines
  Genomic contig location: Contig_ID=SeqID_36162; Location=1..72; Strand=+
  SCN-specific regions: Sequence locations=1-72
aaatccgattccgattaaatcgccgattccgattatggccaaaaatccgattaattgcgattccgattacga

SEQ ID NO: 65557 - DNA, 140 bp, Heterodera glycines
  Genomic contig location: Contig_ID=SeqID_36164; Location=562..701; Strand=+
  SCN-specific regions: Sequence locations=1-110,132-140
cggtgcaaattaataaggcaaaggaattcaggggtttactaaaagcaatgagttctgagtaggaaattttctgtgccacatatacactatattttaatcacctgtgaatttttaacatttgatttatttttattagagtt

SEQ ID NO: 65558 - DNA, 393 bp, Heterodera glycines
  Genomic contig location: Contig_ID=SeqID_36165; Location=183..575; Strand=+
  SCN-specific regions: Sequence locations=1-393
gttataacgactgttgacaccaaaaaacctcttttggatttctgtgctggttacaccgacaatttcgttggcctcattgaaattggacgatctgatgacgacacaaacttctttaaactttacgagattggacgtcgaagggacttcgatgaggaagaagaagaccaggatgaacaagtgaggggattaacagtcatttattattactgttaaagtaagtatcttaaaatgaatattaagaatccggaagaagaggaggacttttcactgggaagcagttcgccgagcagtagtagcagcagttccaacaattccgacacagaatctcattatccacatgaaaacggaagtataagagacattgaggagggagcagaagaccaggacggacag

SEQ ID NO: 65559 - DNA, 820 bp, Heterodera glycines
  Genomic contig location: Contig_ID=SeqID_36167; Location=1..820; Strand=-
  SCN-specific regions: Sequence locations=1-83,105-459,483-820
  Gene Ontology: Biological process=glutamate metabolism
acatttttggaaatgacgagtgccaacgcttgaacaagtgaacgattgacaatttctttaattggcacaatcgaaattaattaaattttgatttggctatttaagggagggatcggtgaaagcatttggcgaaatgacagaacaaatcaacgcgcaattggcacaaaagggacggccgcgcatttcggtgtccgaagcggcgcttggctttatccaagtggccaatgaggcgatgagcagacccatccgaagactaactgaagtcgggccaaaggctcgagagaatggcattttcggttaaggccaaaggcttcgacacttcgcaacatttgttgagctgtttcggcggtgcgggaggacagcacgcatgcgcaatagcaaggacacttggtgaggggggagcacacttgggaaagcattttcaattgtggaaaagggacgagtcgagcatttgccatgtttatttatatatttatttttttgggggggggggggggccgggacggcattcggcagcatttacacacagttaaaatcaaattttcgcggtccaggttttgcgaccaataatttctggatttcaatttgtacttttgcttttttaaatgccaagcatataattttaatgcgaaatttgattggtcattatatccgcccgcaaatatcggaaaattcttaaaacggcggaggaaagaaaaaaaagtcgcatttgaggtattggccgagttttggtccatcgccaccacggcgttctgtccgcctacggtttggtgctggcggacgtgggaaacgagcagcaggaaggctttatgaacacttt

SEQ ID NO: 65560 - DNA, 623 bp, Heterodera glycines
  Genomic contig location: Contig_ID=SeqID_36171; Location=73..695; Strand=-
  SCN-specific regions: Sequence locations=1-623
aatcgcgatttcgacgttgacgcagaattagccgacgttgacttaagtgacaacagaggtcagtcattaatttttatcattttttacgccttaaatttaagagaaatcaaagtccaaaagtgagaaaatgcagcggtgggcggaggaggagcgccgttgggagaccgaatttgatgaggcaaatacgaaaagtcggacggatggacgacaaaattaccgacaaatgggcgcgaagatgccatggggtgagcgaagaacggtcaatggcatcatacgttaagggggtggggcctgccatttacgaacgaatgcgaaggggtcaacgggaggggattaatgatgactaattccacggttcatgtcatgtaaatcgatgatttctaaaaaacctatctatcttaaattatttcaaatgaaaatttgatattttaagttaacggaacagagcgacgacagaacggtggagacacatcggccggggctggtataattttaacttcaaaggagtttaacaatccgtcataatttgttaatttcagcaactttcgccatcaccccgtcgccgccctcggcttcttcgtccgtttttcgtggagggagtgcaacccgcgcgaggggaggag

SEQ ID NO: 65561 - DNA, 174 bp, Heterodera glycines
  Genomic contig location: Contig_ID=SeqID_7666; Location=468..641; Strand=-
  SCN-specific regions: Sequence locations=1-174
atgtcagatccccagaatattactcttgaccatctattattttttacgactttcgctaatgaaataatcaatttttactacattactattttatacattcacgacttttcaaagctacgttttcatgtgatttttaatgagttgtcactgaatttggattcagttaacccattg

SEQ ID NO: 65562 - DNA, 261 bp, Heterodera glycines
  Genomic contig location: Contig_ID=SeqID_7667; Location=17..277; Strand=-
  SCN-specific regions: Sequence locations=1-261
atgtcagatccccagaatattactcttgaccatctattattttttacgactttcgctaatgaaataatcaatttttactacattactattttatacattcacgacttttcaaagctacgttttcatgtgatttttaatgagttgtcactgaatttggattcagttaaccccattggtaagtagctgcgaatgttagcattataaaagatttttatagaaagcgttgcaggaacgtggtcacaaaagaaaatgcataattaa

SEQ ID NO: 65563 - DNA, 449 bp, Heterodera glycines
  Genomic contig location: Contig_ID=SeqID_36174; Location=203..651; Strand=-
  SCN-specific regions: Sequence locations=1-51,73-297,353-449
atgccaacggcacattggcattgggtcaccgacgtgagcaaaaaaacagaaacaaatttaatttattaattttgcattttggtgacagaactcgttccagaggcggccattccacgcgttgccgcgactgcgagccgatcgccgcccggcggagggcccttttgaatgccacggggttcaggtggtgttggtggtgccattttgttaggggtgaatttcatttgccctctccccgcattttttttaaatcccagaaactgaaaaattggtttaatttttttttgaaatctttgagacattttaaaattttattttttgaattacattataaaatttttttatttcaaaaaaagaacgaaaaatacgttttttaaatttcagtcttggccaaatgcgccaatttttggacatttgtgcaatgcgaatatgtcgagcaacggcggagccgg

SEQ ID NO: 65564 - DNA, 90 bp, Heterodera glycines
  Genomic contig location: Contig_ID=SeqID_36175; Location=7..96; Strand=-
  SCN-specific regions: Sequence locations=1-90
atggccagatttgtacataaaaatttggacaaaagctcagcaagaagacaacaaattaaccgacaaatcataatcaatttgattattcag

SEQ ID NO: 65565 - DNA, 473 bp, Heterodera glycines
  Genomic contig location: Contig_ID=SeqID_36175; Location=218..690; Strand=-
  SCN-specific regions: Sequence locations=1-292,315-473
atggcggtaccaataggcgcgccggggaaattataaagatcatggttcaattccttatcaaactttccataaaaaaggatcaagtttctataaaacaatatgaaattctgaaattttcagtttttccagcgtaaatttttcgcggaaaacccgtgaactgtccccgtgaatctcccgtgaaattcacggtaaccgtgtccgtgaagcacggcacatctcttccatttgccataaattaatccattcgtaattttatttaggtattttagtggtttaataacactgagaacatatgttgcaatgctatcatttgtgtttctatcggaattgtaaccgtgatatatactcttattgttggaaatgactatataaatctttccttgcttaaagccgaagaaatatttcaaattgaacaacttttgggtggcaatctcaacgactttgtgacatattgtgaacgaaatgtgagctga

SEQ ID NO: 65566 - DNA, 248 bp, Heterodera glycines
  Genomic contig location: Contig_ID=SeqID_36176; Location=1056..1303; Strand=+
  SCN-specific regions: Sequence locations=1-212,235-248
atgtgtattttgggacctaagaaacggcacgtgactggtcatgtgaccgaatatttcacaatgaagtgcaccgcgcggaaaatgactcctctgtcaacgaaaaatgctgatttgccgaagaaaaatgcggccaccctcaaaatgaccccagcaaatcccgaggggagtggtacgcaccaaaaaatcgttggcccacgtgcttacgtgtggtcaaaatgctgcaacaattttatgaaagcggcacgagt

SEQ ID NO: 65567 - DNA, 273 bp, Heterodera glycines
  Genomic contig location: Contig_ID=SeqID_36180; Location=315..587; Strand=-
  SCN-specific regions: Sequence locations=1-273
atgagccacgagtgtttccaagacaggcacaggtatcagttttcatctaataacttaattgattaaattttgccatttataggacgaactcagcactaccgtatcctactacagttttgcaccatggagtgaacgatcagagctgagagcacgcatcaaattgctcgatggggacaccacacatttcaacatttatttgctccacgacgccattgaacctgtcaaaaactgtaaaagcgcattttggatacggtggttgggcattttaataaa

SEQ ID NO: 65568 - DNA, 275 bp, Heterodera glycines
  Genomic contig location: Contig_ID=SeqID_36181; Location=296..570; Strand=+
  SCN-specific regions: Sequence locations=1-88,132-179,216-275
atgacgatgcagcttttcaaaaggcacttcgcgattccattcacgatcaaaagtatattttacaaaaaaaacttttctattaaatggcatttattataagttaatttaaaaatatttttatttattttttagatgaaagtgtgcttctacaaaagaaaatttttgtgcttttgttacaaaaatatgaaaataaaattttcatttttgaagtttgtatttatttccattatatctttagcacctatttaattatttggaataagaataaaatttaa

SEQ ID NO: 65569 - DNA, 1670 bp, Heterodera glycines
  Genomic contig location: Contig_ID=SeqID_7668; Location=1112..2781; Strand=+
  SCN-specific regions: Sequence locations=1-34,57-118,182-329,352 -397,492-511,535-598,620-812,843-1054,1077-1133,1163-1169,1210 -1432,1454-1493,1530-1553,1578-1585,1622-1634
atggaaagtgatctggacaaaaacaatgtgtgccaattccaaacaacatttccattacatgattatctcaacaaaattaatcgggatttggaagttgagcaaaaatgtaagatttgtgaaaattaaaaaaaatattttataacgaaatttatataagtgtatttatatttctataaaaaatggttatttattctgtttttgtttgacctaacgtaaatccatttttaattgattattaaaatacctcctaacttaattatttatatacacaattttcggcaattaaattcgattaatttccaaatttattgaaaactgaaatgaaaatcttaataataaaattataattatctttatcttttgcacaaagtcaaacagttttttaataaactctttcttttaaaaacaattttattaaattaaataaatatcaaaaaaaataattaaataaattcatatgtaataataataataataattattattttttagttaaatcagagcgccagcttaaacgttttattaactttgccaaaacaaggagttctccaccaataaattctgatgtgcatccaatttccaaaatttcaatttcgatgaaaaattttccaattggcccgtatgaattattcgattttcagaacaagtcggaaagtgtaatgattgaaggtaaaaatatataatgtttcgtgtcccgacatttgcgcctttgtccaaaatcgggttcaaaataaagtttttttcaatccctgatcgcataaacagctttaaataagcgattgaaagtgattgtatccgatcatttgatcttcaaaaatttttaaaaaaatagtaaaatttttcaaacaacaaattattgaacataatgaaccaaaagaccgtgttttcttaattttattgctaattaggcgctatcagagtttgaaaaaactcaactttgagtccgattttggacataggcgcaaatgtcggggctgcaaatgtcggggctcctaatgtttagatgaaaaaatgtttttattctcatttgcaaaaatggaaaaaaaattctccgagatttttgaaaaagagccttggataaaaaagaatatatgctgtttctccattttatctgcatgaaaacgccgcccataaataataattccaacatttttatttaaatcgaattcaaaaaattaatataaaaaataaataaaataaatatattttcagctgtgcaacaagacgcaaatgaaactgatcaatcatcgggcattgcaaatatgattgagataattgatcctttgaaatgcagcgagctttgtggggttgccgatgaactttttattgaaaaagatgaacatcaaagctttcgtgtaagtaacaaatgtcacattggcgcgggtacttttggcgacttaaaatttaaagtgtcattaccaattgattagggtaattaaatttcatttaattatttgttcgatttgatggaataagtgttttctttcgcctggaaaatttaaaaagtttaattaagaaatttaaaaaaacattcattttagcgggggagtacgaaaaagaattaaatgaaagtaaaattaattcgaaatttaatattaaaattagctatatataattaaaactcattttgcacgataaaaaataatgataaaatgctttaaaatttaaaa

SEQ ID NO: 65570 - DNA, 737 bp, Heterodera glycines
  Genomic contig location: Contig_ID=SeqID_7668; Location=3076..3812; Strand=-
  SCN-specific regions: Sequence locations=1-737
atggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttag

SEQ ID NO: 65571 - DNA, 204 bp, Heterodera glycines
  misc_feature (184)..(184): n is a, c, g, or t
  misc_feature (190)..(190): n is a, c, g, or t
  Genomic contig location: Contig_ID=SeqID_7668; Location=3814..4017; Strand=+
  SCN-specific regions: Sequence locations=1-204
atgatctcgttgacttcgtcgcacgtgtcaatggtgcggagcgagaatcaaacgattgagcagctccttgtcattgccaaggagttgttggaagttaggatagacatagtctatcagctcttccttgctcttaacgaggaactgcggaggaaatcagaagtgcttctccggttttctcgagccngatttngcgcacatttgcaa

SEQ ID NO: 65572 - DNA, 582 bp, Heterodera glycines
  Genomic contig location: Contig_ID=SeqID_36186; Location=85..666; Strand=-
  SCN-specific regions: Sequence locations=1-582
  Gene Ontology: Mol. function=calcium-transporting ATPase activity; Cellular component=integral to plasma membrane; Biological process =transport
atgctcggaagaaacgggcaattgtcacaatttggcagcaaagatttggaccgtttggtgaaagaagtgattgagccaatggcatccgacggcctaagaacgatttgtttggcctacaaagactatatagcggacggatcagcacaagtggaggagaatcagctggcatttggaggcgaaatcgattgggacgacgaaagtgcggtcattagtgacttaacagtcgtcgcaattgtgggcattcaggacccggtcagatcaggtctgcctctgtctgtccatttagcttctttaattaccatcgtccatttcagaggtgcctgaggcaattgcgaaatgtaagcattcatttgaaacattgaaagcactgtttaaggcaaatctgatgtaccattttttttgttgcttaggtcaacggtctgggattgttgtccgaatggtcaccggcgacaacataaacacggcccggtcgatcgcgacttcttgtggcattttgaaacctggagaggatttcttagcgcttgaggggaaggaattcaacgaccggatccgggacgaggacggcgaagtctgccaggagaa

SEQ ID NO: 65573 - DNA, 591 bp, Heterodera glycines
  Genomic contig location: Contig_ID=SeqID_36189; Location=247..837; Strand=+
  SCN-specific regions: Sequence locations=1-418,440-519,542-591
atgaaatttggtgggtggatagatgacgcccagattctattgtgagatgatgaccatttttgcctgaggaccatgattgacgtgatatgacgtgtgaatattcttggctgaaccaaataataagataaacaattgcaattatgcatatttgcaaatgtatttcatgattgtttagacttataaaaaattatggcgtactgaactttaatatcttattattattcctattaaagatcgtactatttacaacatgatcataccgagcaggtgaaattagaacaacaagctagctttgatgacatatgtgacagagatgtgtcgatggagcataagaaattctctgccgcattgatcacgtgattcaccgagatattgctgatcagtaatcagattctacaaaatacccgacgatttgatcaattttttgatgaaatttttggcagtaaaaaaataagatagtgaagaaatgtccaataattgcgatgaattggaacaattaaaattgggatccacctcaaagaaaatttatgaattgaaaaaagattttggattgaccaaaaacaccacctcttatgtggaaaacgcaaaata

SEQ ID NO: 65574 - DNA, 763 bp, Heterodera glycines
  Genomic contig location: Contig_ID=SeqID_36190; Location=234..996; Strand=-
  SCN-specific regions: Sequence locations=1-278,300-396,422-763
  Gene Ontology: Mol. function=pre-mRNA splicing factor activity; Cellular component=nucleus; Biological process=mRNA splicing
gtatgagaatgaccagggctgttacaacgatgagttcaacccgttcgccaacgtgtcgcagaattacgtggaaaagcgcgagaaacaattggaccaaacgcgacagaaaccgcggctgaccctccgccagcaacagatcaaaaaagacaacgaaatgtgggagaacaaccgactggccagatcaggtgaaggggggggggggtgattagagttgactgactaacaattagcatgatagttaagtaggattcgaaaaacatggaaattcacatataccgcacattcagccatttttgttaaatgggcatccggcggtgcccgctaacaggccgttatttcgctaaaattaataaatttatcttctttttttttttgaaatgttttttgttgataattcattaaaaattctgaaaatttttccccggcggcgcctatcggcaccgccggcccccaaaaacctatttttacttaaaaaaattagccaaaaatatcaagcaatgcattcatccatcattcattccaaagcttttgagaacaccaactcgggtcataaaaaattatgcatttagttttagcaattttcattcatttgcacttctgtttgtttgttcaggcgtggtcactttctccgaggaactcggcgacttcttcgacaacgaaactgacgagaacagagtgtctctgctcgtccacaacataatcccaccctttttggacggccgaattgcgtacacgtgccaaactcagcctgtcattccggtca

SEQ ID NO: 65575 - DNA, 616 bp, Heterodera glycines
  Genomic contig location: Contig_ID=SeqID_36191; Location=83..698; Strand=-
  SCN-specific regions: Sequence locations=1-14,47-79,101-549,575 -578,600-616
atggtccaattgcacatttttacaaagaaaaaataataatgcgtgaaataattgtgcaatttggaaattctcttgataaataactgaaaaataattttttcattacgaacttaacagatgattgaaatggaattgaaaggataaaaaatgaaatgaccaatttgctatctaatcagcgattctctccccctgatttgtgaataaaatttgggtacaaatttttgggcgctagggatttcagccactagagcatttaaaaggagcagctaaaacatttaaaatcagccccgataaaacacttagaaccagatagaattacaatgtttaccaaatctttaggaaatgcatcaacttttcaatattattatataccatttcttttcaataatcgtttttttccaaggttgcaatttacttttgattaatttgttatgcttaattaaacattaaattctttaaaatcatttttttagaagagaatgattggccaaccgagctggatttgcgctactccaaaaaaggagagcgacggattccataccccggcgatcaagggaaaaattttttcaaacagcatgggaatttaaaaataacaatttgaaaatgcttcattaaa

SEQ ID NO: 65576 - DNA, 475 bp, Heterodera glycines
  Genomic contig location: Contig_ID=SeqID_7669; Location=1717..2191; Strand=+
  SCN-specific regions: Sequence locations=1-99,211-475
atgcgaataatgcgaaaggcgaaatgcgaaaagcgaaacctaggcacatccctggtacatatgtgggtggctggacatttcgacaatgaccgtttcgccaatttaaatataataaaatgaatataaaaaataataaattaattaaaaaaatatattgatgaaatttaaagagaaaaatttaattaggtagttatattttttaaatttaatgaatgcattatctatcgcctattatgtatgattattaatagtgaagaaagaagacaaaatgagacggacctataaccagtttttaggcgtttttgagggtgctaataacggatcttaactcgggtttgcccaattccgaactccggacccgaattcgaacaaaaaaaattgagtttttttaatcaagaatagttttttcagggtaaaagcttctaattcattatcaactatttaggtgtaaaacaatgtttcaatttttaattaa

SEQ ID NO: 65577 - DNA, 610 bp, Heterodera glycines
  Genomic contig location: Contig_ID=SeqID_36193; Location=1001..1610; Strand=-
  SCN-specific regions: Sequence locations=1-77,99-306,330-331,353-589
aagtttgaacatcgccgggaacgtgctcagtttggctccgattgagggcggcagcggagaatacgtggccatttgggtttgtgtgccgtgtccaattggacgagtgccctcacttggccatacgctttgtttctttcagaacaccgctgacaaagagccgaccaaaaaagggacacggcaggacattgaatttgtgctttcggtaagggcgtcgaatgatcagcgaaaagtgatcggaaaacaacaaaaagtgatcgatcacttatggaacattcattcccatttccaggccaaggacaaaacattgagcaaaaatttgcaagtcaaattttacccccacaacgacacacacgcgggatggggacagaagttggaccaaatcacttggcactgctccaccaacgacattggccatgtgtttgtgttggaagagcaaactctttaaagcgaaagacgacaattgcattttaaaaagcgatgggcggagatcaaacggagacggccaaaattaattttcaattcccatttcaatgcattcattcatttctattttctttaatattttgcaacaaaagttcaaattagcaaaattgtttgcccattccttttt

SEQ ID NO: 65578 - DNA, 815 bp, Heterodera glycines
  Genomic contig location: Contig_ID=SeqID_36194; Location=336..1150; Strand=+
  SCN-specific regions: Sequence locations=1-381,409-815
atgggctcttttctgtaccagatgaaatcgttttaccaaatggccaatgaaattcagaaagattttgtgagtttttttcgaatgattttaaattgcttttccccctttagagtctgatctacaacgacgtgtgctacagagtggagaaggcgaagaaggaccagacggaactgcgtgcacagattgagggcacaaagcgcaatgttttggagaaattcttaaaacattcggtgggcgttagccgaacaattcaaattaatcgctaattatggctctgaaaaatgccacaagttttatgccacctttcaccccattttgtctaggtgtttgtgctcaattcgtcgtcgtccaactgtggcgagttgtcgtccgatttgtccacagccgcggtcgccgccgcttcggctgccgttgggggcggtgccgaagggtccgcgcacattcgccaaggctatctgttcgtgctggagatgcgcagtctgttatccaaggcggtccagtccaggggcactccgaccagaaattactgcgtctactccaaggagtccaggtgggcaacttgccattgggccgggtaatcaaatgcgataggcatgagaaatctttagatttgggagattgatttttaacatgttcgatttccaggattttgacgcttatcccggtgaacagtttgaccgtcaagacggtatgtccttattgttttgtaatgtgattctctcccatttactatttaaggatatgaagggctgtttggaccagaccatttcgtacaaattgaaaaattgcgcccgaaggccgtccgattcgattga

SEQ ID NO: 65579 - DNA, 183 bp, Heterodera glycines
  Genomic contig location: Contig_ID=SeqID_36196; Location=216..398; Strand=+
  SCN-specific regions: Sequence locations=1-183
cctttctctccaacatcccagcggcaaaagttgtgcatccgttcgcttcccaagacacgtgttccaaggagggctgttgcaagtgcacaggcgaaagtcgaagcggcgaagccaatgcccgcggcaaagccatcgacgcgaacaaattgcacgacgagcggaaggaaaagagcaatttcgaag

SEQ ID NO: 65580 - DNA, 401 bp, Heterodera glycines
  Genomic contig location: Contig_ID=SeqID_36201; Location=207..607; Strand=+
  SCN-specific regions: Sequence locations=1-15,38-401
atgtactaccaggcctggatggaagagcaggcacagaaattgatcgatgccaccactcgcggtatacaaatagaaaaattggctaattaatagagcctggacgggaccggggcctgccgggatttttgccgagactccctctgtcccggttttttggacggtcggaaaaacgggagtcccgggattccgtcccggtcgattttctaagtcccgaacatttcaaaatccgggctctcctaattaaaatggatacggtcatcaaatacacactccattttatgggtttagttttaaaactgaatttgctttcagcttttacatcgcagcggatgttggcaccaggagctccaggatttgtgccgcccccgactggcgttcccgtcatgattgtaatgttttga

SEQ ID NO: 65581 - DNA, 489 bp, Heterodera glycines
  Genomic contig location: Contig_ID=SeqID_36201; Location=702..1190; Strand=-
  SCN-specific regions: Sequence locations=24-202,224-374,397-438,460 -489
ctcatcatcatcttcatcattcttgcggttgctgtttgattgaggttcgaagcgcagccgacgaagccaatgcgccgttggcattcaccgcaatgccggacgattgtgccgcggcaacagcggccattgctgcggcggtgactgccggcgtcggaatggcactcaaagcggcggcagtcattgacggcattccctgcggcaacaccggcggtgtgaagaagccggccgccgaagggatcaccggcggacgcacaatcgacatcggattaacatacggagcacgcggtggcttaacagaggaggtgtaaatcaagcacatgggattagttttaaaggccattggcaaactgtacaaaatacaaacctacaataggatttttttaattttaaaaaattgaagtctagataggctgccccccccccgtatcgtttcccaattttttaaaataatttatcaaacttgaaaatttagatatttttggtaataaa

SEQ ID NO: 65582 - DNA, 896 bp, Heterodera glycines
  Genomic contig location: Contig_ID=SeqID_7671; Location=575..1470; Strand=+
  SCN-specific regions: Sequence locations=1-896
atgcgccgatgtgccttctcccacccaaagccgcgcttccgccgacggcacttacggccatccgtcaacgctgcgccaattgccgccggcaccgcccacacaaatgcggcgcaagtcgcttctgaaatgctcgctggcaccgccaagtacttccgtgccgcctgctgccgtcgctgcgcccccgaaacagtcgcagtcgccgcgcatgcgacgctttgcggaacgactggcagtcattcaaatttcgctggacccgcccagtccgcccgaatttgcgctgcaatcgccgcccgacgaaccgccgccgtctttccatcccttttggctgtctccggcctacgaaagtcacttccggcccattgaagattcgctgttgcttcaggtggtaatgatgccgtcatttgactttggaaaggcgcgtttgccgccccacaggtgccaaaagtgaacgattgcgaagatgcccccgacccttttcgccaatgttcgccgccgccccgtcgctgctcattcgcgtcaacgctcagcgaatcgtcgtccatctccctcaacacttcctaccaatcgcttctcttttcgccttccggcattgatcagacgccacacctcgcccagcgatgtccgtacggacactcgcggcgacggtcgaggtaattaaacggagggaagaccctaattgagccaatttaaacggctgatcgataattaattcggggtccggacaatctgtcagtgataatccctcagtggtcaatccgtcagtgaaggacaatccgtcagtaatggacaatccgtcagtggacaatccgtcactgtataatccgtcagtggacaattcatcagcaaatttttcttgaataatgatcaaaatcttgcgaaaatgattgataaattta

SEQ ID NO: 65583 - DNA, 319 bp, Heterodera glycines
  Genomic contig location: Contig_ID=SeqID_36202; Location=264..582; Strand=-
  SCN-specific regions: Sequence locations=1-203,225-319
gcggcttttctttgccagacgctttgtatcagttgacatacattgaatattttgaaaatggcaccgaattaggcaaatggcgaacaaaaatggtcatcgaattcaacctgtacaattattggataaaaaaattggttgatgaacaacatgaagaaattgaaagaattcaaagtaatttcaattattatacagtttgacatggcggcctttaaaaaatttttgaattcaccagggattttatgtgaatattttttcgggaattttcaccccgatccgagacttttatatcctcgaataacggtgatgaaacaagattaaa

SEQ ID NO: 65584 - DNA, 75 bp, Heterodera glycines
  Genomic contig location: Contig_ID=SeqID_36207; Location=475..549; Strand=+
  SCN-specific regions: Sequence locations=1-75
tccaagtggggaattgaactcaggcgaaaaattatgaaaggtagaaagtttaaccactacaccacatgtgcatgt

SEQ ID NO: 65585 - DNA, 805 bp, Heterodera glycines
  Genomic contig location: Contig_ID=SeqID_36208; Location=125..929; Strand=-
  SCN-specific regions: Sequence locations=1-236,258-642,664-772,794-805
atgacaacacccaatttgccttacggtgcaagagaggggagcggccagttcagtacgggcaccaatttcagtcccccaccaccgccgtatgacgccggcgccagtagtccatttgaacaaccacaccaacagcatcagtcaccatcgccctacggaatgatgtacagcggtggcaatgtgccgtcgccaccaccgccgtcctctccttaccaccaataccaacagcaggcgccgccgcaaatgtccccgccgttccaaccaccaattggggacccacaacagcaggttgggggcatgccaagccaagccaaccaagagaaaatcgatgcaaatgatgggattgggttgggatggcatggaaatggacatatggaggaatttcggattttttaaatgttttgggttccattagggttgtactaatggaattgcacacaggtacagatagatgatcatttaaactgaaagtttcggtaacaaatgccaaaagtttgccctccaccaaattttagaaaaaaaattgtcaaaaaatggatgagggcgacaaaattacaaatatcaaattgtgaatccttggttttctcaattcgatactcgaccaaaaaagttgaaaaaattttcaaatccaaaaaattttctacggaattttttaaaataatttcttacagttcatgtacgacccgttgttgaacactgcgcgtcatttgggtggtcaatttgcggagcaacaaaagcaaaaggttcattcattcatcacacattctacaaaatgaaagagcattcattttaaatgggctcaattaaa

SEQ ID NO: 65586 - DNA, 102 bp, Heterodera glycines
  Genomic contig location: Contig_ID=SeqID_36210; Location=287..388; Strand=+
  SCN-specific regions: Sequence locations=1-102
gtcagtttgtaatgcgaccaatgagtgacactgtcggttccctctctgaagcattgcaaaacgaagacccggggattgagctcgtgacattctacaattcag

SEQ ID NO: 65587 - DNA, 723 bp, Heterodera glycines
  Genomic contig location: Contig_ID=SeqID_7674; Location=341..1063; Strand=-
  SCN-specific regions: Sequence locations=1-55,92-151,179-318,348 -578,685-723
atggcaattttatcatcaacaactacaccaagcctttgcattggattcgaccaatcaacaacaacaacaacaacaacagcagccgcaacaaatacaaccgggaacagtgcaacaccatcctacgcagcagcagcaacaagaagtagctgtgcaacaccaacaacaacaacaacaacaaatcactgcttggcttcaaagtcaacaacaacaacaacagcccgtttaccatcagctgcaaaacgcacaaaattatcaactcaacccccagccaatggcagacgaaatttttatttatgaggatattgtaaattcaattatataataataataataataataataataatttccaaaaaaaggatgcgcaccccgctacgagtgcggccagtggtggtgatggtgcaccaggtcccagcagtgcctcagcaagtgccacgcggcgaacaacacaagtgtgtgaaactttgcatttcactgaaaaaaaatgtttttcgatatttttaagcgcaacactacgcgccgtggggggagaggacaaagtcgaggacgaacgacaacagggggagatgagccggttgtaaataattaaaaaaattttaatatttataatggatggtttcaaattttttaaaaatgttatattttaaaaatattaatggaattttttgaataatttttttaaatggaaaaaaatttaggatttgtttaaaaaactgaaataaa

SEQ ID NO: 65588 - DNA, 280 bp, Heterodera glycines
  Genomic contig location: Contig_ID=SeqID_7674; Location=2670..2949; Strand=-
  SCN-specific regions: Sequence locations=1-12,36-178,200-280
aaaatataatggaaaaattttttaaaaaattttttctccatcttcctttttgatactaaagcatcagagtgctaaacttaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcgg

SEQ ID NO: 65589 - DNA, 396 bp, Heterodera glycines
  Genomic contig location: Contig_ID=SeqID_7674; Location=1086..1481; Strand=+
  SCN-specific regions: Sequence locations=1-17,41-396
atggcccaaattcagcatgttgttgatgttgtggttgttgctgctcatagtagttgtgatcatgcagatgaactaactgacttgctgcaacaggcaaaggatggggcaacggtacaggcaaagtatggggcggcggtacaggcaaaggatggggcagcggtacaggcaaaggatggcgcggtggtacaggcaaaggataaggcggcggttctgccagatactgagaagggtattgaggccattgcatcagcattggccgggttggcaaagggattgggggacgccaagacggcctttggtgccgcgaaaaacggctctgagggtaatagggacgaaattttgggcgatccgaccaataccaaggcatttggccgaatttacccaaaagaaaaataa

SEQ ID NO: 65590 - DNA, 582 bp, Heterodera glycines
  Genomic contig location: Contig_ID=SeqID_36212; Location=6..587; Strand=-
  SCN-specific regions: Sequence locations=1-271,293-424,451-487,510-582
cagaattaaagtacaggctatagggaagctactcccgaaggattcggtctccccataaatctgggcgcatcggttcggggggtctgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaagtgggtgcgtttcagaaccctttctgaaaaaatactctagaaggaattttgcaaaaaataaataaaaacgaaagc

SEQ ID NO: 65591 - DNA, 309 bp, Heterodera glycines
  misc_feature (272)..(272): n is a, c, g, or t
  misc_feature (301)..(301): n is a, c, g, or t
  Genomic contig location: Contig_ID=SeqID_36213; Location=20..328; Strand=-
  SCN-specific regions: Sequence locations=1-309
atgaatcctgatcttgaaatcgctcaaaaatttttcttgtgtaaagaaaacaaaaaagatgtcgcaacaatttttctcgaattgcttaaggttggtatttgaattgtgctttattataacagcaaatggataattttcataatttgctttttaaagagtcaaaatttgagtccgaatctcgtcttctatcaaaaaagactgaaatcccttgcattcagagcattactgacaacgaaatggcgcccttttacgaaatacgccgccctcaactncgcgtgcccattgacaaggctaaactgcnaacactga

SEQ ID NO: 65592 - DNA, 224 bp, Heterodera glycines
  Genomic contig location: Contig_ID=SeqID_36214; Location=659..882; Strand=+
  SCN-specific regions: Sequence locations=1-78,127-224
atgaccacaagcagcacttcttctgaaaagggtgattatgaatttcattggaagaacccaagggagattaaacagaagtaaaatatatatatatttttaattttagaaaatataaaaacatttttagatgggagtcattcgcaaaatttgggcaatctcaagctcaagcaactcaagtcactgaaatcacagggaaaaacttcgataaatggtgcacaaattaa

SEQ ID NO: 65593 - DNA, 847 bp, Heterodera glycines
  misc_feature (142)..(142): n is a, c, g, or t
  Genomic contig location: Contig_ID=SeqID_36215; Location=898..1744; Strand=+
  SCN-specific regions: Sequence locations=1-187,220-847
tatttaaatcaattctttcgggggaccgtgccgggtggcgcggggtaaagcagtgctggttcgtttcatcacggaaccgaaccttttggctagtcagcaatcgttgcttaactgccagatcggacgggtgcgcatgattccnctgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccaaagacaaaaaaatcgattttttcaagtgtccgtttggggta

SEQ ID NO: 65594 - DNA, 236 bp, Heterodera glycines
  Genomic contig location: Contig_ID=SeqID_36217; Location=393..628; Strand=+
  SCN-specific regions: Sequence locations=1-71,145-151,174-236
atgagcagtgaattccattctatgaacagaggcacaatttgcaaagatgaaaagccaacggaagccgagcggaagagaagagaaaatgagggagaagaagaggaagagaaggagaagggcacgaggacggccaagaagaagaagccgtacaaggagctgaccctggaggaaaaggtggagctgattcgacttgcggaacgctgctcaaacctcagccaggcgagcatcgcggaacg

SEQ ID NO: 65595 - DNA, 954 bp, Heterodera glycines
  Genomic contig location: Contig_ID=SeqID_36218; Location=255..1208; Strand=+
  SCN-specific regions: Sequence locations=1-780,811-877,922-954
gtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatt

SEQ ID NO: 65596 - DNA, 809 bp, Heterodera glycines
  Genomic contig location: Contig_ID=SeqID_36221; Location=64..872; Strand=+
  SCN-specific regions: Sequence locations=1-38,60-302,402-777,799-809
atggccgctttgaaccccttgctagctaggaatgtgccggcgaagaatggtgatccggcattcttcgagatttgccagcaaatctgggcaattctcggccaattcttgggtaagtttgtcttatttggtatggggaaggcgggagatggggggaatgaaaacggcaaaatgcaaaaataaatgcttgtaaggatggtaaagggaaaaatgagaaagaaaaattgcgagatgactatcagtggatcagtttaatggccgagaaatccattaggggaggggcataaatgtgtgcaaattatgtgatttatttaaaatgattgaaaatgattttaaatatatatatttatttgaaagaaagttatgaaattataattacatttaattgatatttaattaaatttgtccttgaattgtccttaaatgctaacttaaaaaaaaggaaaaactttgggatataatgtgaggttactgtaggttatattaccgatccggctttaaggggaattgaatccagtgactttcggctatttgaccaggccggaggaactcgcaacggcatgggcaacagtatgccggcgcaagttggcctgcatccgctgcaccattcgttgccaatgaagcgcctcgtgtcgtctttggcgcacgagggcctgcacatcctagaattccaacagggaaggcagtggccgagggctggcaccagcacgaagcacgatcatgggccattttttcgtgccaaatgtgccgaatttgatgagatttccggtggactgatccagccggaaatgcaagagtttgacccattgtga

SEQ ID NO: 65597 - DNA, 924 bp, Heterodera glycines
  Genomic contig location: Contig_ID=SeqID_991; Location=2071..2994; Strand=+
  SCN-specific regions: Sequence locations=1-350,375-396,419-924
atgtgctccaagtgcttcaaagacatgatcaagcggaaacaggaaacgggcaacaccgcgccttcgacgacagctgcggctaccaccgcagcgaataaaacgacggaaacaatgccggtcgatgcggtcgtcgccgcattggcggcgagcggtggcggaacgactgagcagcagcggagcacgtcctcaccaggtttaagcgaaacataactgaaaatagtcctttgagctggtgcaatttctatacgagagaaagaggaggtcgaaattataaaaatcaatcaaattgaacgggaaattgaaaattgcttacaatagctatagcaaaaagaagaaagttgaagagagcgaaaaaataataataattatttaaaccgatagttttctgattgttacttttcttacagttaaaataatcgtcaattatttgaattttaacgtgccatacaaaatatgttttcagaaaatgcaatcacgggattgtctgcttcgtctggcaccactgcctccacttctcatccgggaatgctttcctgctcagccgccacaacaacaacggacgcaactaacaacacccatgcggcgccaagtcctgcgccgggacaacagcaggaagatacccagcagaagaagaagccaaaccgatgcggggtgtgcagcaaacgggtgggacttaccggtgagcgaaggggaagggttgggcgaaggagggaagaatgggtgggggatggaaatccaataggaggtacacaaacctaaggtggtaccaaagactaaagcctgtgatttttaggtttcgaatgtcgctgcgggggtctcttttgtggggagcatcgttacgattctgcgcacaattgcactttcgactacaaaacggccggacgcgaagaactgcgtgccaaacatcctcaggtgtgactaaaa

SEQ ID NO: 65598 - DNA, 165 bp, Heterodera glycines
  Genomic contig location: Contig_ID=SeqID_992; Location=831..995; Strand=-
  SCN-specific regions: Sequence locations=1-90,113-165
atggacatcgatgaattgaaaaaaatggtttattttccaccaaaatgtttatttatttgttattttattattttcagagtcctgagcagcaaaacaaggtttaatatttttacagagagactgttattcaatttacttagatttttggacctaatgttgaataaa

SEQ ID NO: 65599 - DNA, 1089 bp, Heterodera glycines
  Genomic contig location: Contig_ID=SeqID_994; Location=566..1654; Strand=+
  SCN-specific regions: Sequence locations=1-492,514-595,628-781,803 -1089
  Gene Ontology: Mol. function=single-stranded DNA binding; Cellular component=nucleus; Biological process=reproduction
atgggttaccctcgccaggaagtcgttcgtgcgctgcaagccgcgttcttcgacgccgaccgtgccgtggagtatttgtgcaatggcatccctgagggactttctctacaagagtcaaattgtgagttagagtagttcagcagtattattccccgttttctttaattttagctgatgctgacaatgatgcggtcaatgaagaaggggaacttatggaatcattggagaacccgcaaggactctcttttttggctcaatcgccgcagttccaacagctccgagacatcgtaaggggatgaggatttattttatggattcaattttgattttcttttcaggtacgtactgatccatcgatgctgccgcaaatcatccaacaaattgccgccgccaatccgcagttgatggaggcaatcagaaacaaccaaggcgcgtttttgcaaatgctcaacgagggacaaccattgggcggtgggaccgacgctggagccggtggagaagcggcggccggcgttcagcaggaagcggcgcaaagaagggtcagcattccagtgaatgcccaggacagattggcaatcacccgggtttgtcagcgaatgcaacaaaataaataaataaaaattcccattggctttttcagctcgtttcaatgggatttccggaagcgttggtggttgaaggtggttttgtccgttattttttgttttatttacaactttcttttttagcttatttcgcctgcgacaaaaacgaggtgtcgcttcaattaaaactattaatttttgtaaattaaaatgcttttttaaggatttggctgtcaattacatcttggcgaggatggatgagtctcagaatgaacgggcgggtgccgggcagcagggcggacaataaatagggtaacggaggtgcagtaatgatcgcaaattcctcatatcgtttccctaaattatgatcattttttgctcctaaagtgcatgttctgttctattctcgccctttggctgttcgttgtgttttattatgaccatattaaattgtttgcggactgaaatgaccacatttacatgaaatggctcaaagatattcaga

SEQ ID NO: 65600 - DNA, 1690 bp, Heterodera glycines
  Genomic contig location: Contig_ID=SeqID_995; Location=1914..3603; Strand=+
  SCN-specific regions: Sequence locations=1-37,59-92,115-474,496 -514,537-720,763-1089,1112-1135,1157-1513,1536-1565,1587-1616,1639 -1690
atgacaaaaaaagggggacgagaagaaaagggagacggcgggacagtggcagggaaagaggacaccggcacagtttctgttgcggacgaagccgacggagggacaacgaccaccgccgctggcgcaaacgatggcagaacaaccgcaaccatcgaggacaacaatgccaatgcgaccactgtcgacaacaatagcagcgaaactgttgccgaaaacaatggaggcagcgccgctagcgttaccaataacagtggcagcacaatcgcaaccgtcaccaccgaccacagtggcagcacggccggcaccgataacagtggcagcaacgcgaccacctgcgaacaaagcactgcgacgccagtgcagcaacagcgcacgtatgactcgaacaactcgcttagaccggtgttcatccagggctacgacttccaagtgtccaaggtgtggtgattgatgtgtctgctctttgtttgtttccattgttttgttttgtcccctcccattaggcgcagtattgggtgttccagaaggtggctgacagtcagaacaaaagcgtggacgaaattgagttggcgtgtgaagcgattgtgccttcgcgagtgatcggacgaatcatcggaaaggggggacacaacgttggtgcattcatttgggggatcagtttttggtttcattattcagcttttaggtcaagaagcttcaacagagcagcggggcccgtatcaaagtgaaaactaacaattttgttttgttttaaaaatgtttgaaaggtgccggacgacatcagaggcaacaccaagagcagtggcgactgggctaccgttagcatctatgggaatttctacgcggtgcaggcggtccagcagcactttggcgcgcttatcagcgaagtggaatggcgtgacagtcgcgagtgagtgcattgaacccttttaactccgcttttgtctggcactcaattgtctgtgttttcagacaggacgagagacgctcgcgtcattggaacggcggaaacagtcgctgatgagccgaaaaacaatttgtgtcaggaaattaaatatgtaacgatttgtgtggagaataactttgcggattgtttgtttgtttttatggccgtcagattaacaattgattatgtttattattcattgtctgttgtgcattttcgggtaatccttcgggattggtgtcccgacggaaaagagataaaattttcttcaaattttttctagggaaaaaaaaactctgatcacgaatccgagaacgcacgttctgaatggtgtagattcgtagagttttagaatgagttatcaaatgtatggaaaactttgttttcactgcggcttttggctcctgacagggagggaggatttataaaacggtcgaatcctgacaaatttaatatcattgtcctaaacatgcggatgaaatcgattcaatgcagtttgagagatcttcgaaccggtttaggattctaaaatgggtaatccttcggaattggtgtcccgacgggaaaaagagagaagaaatttcctttacacggctagtcaattttgggctccaagtacaaataagtttattatttatttagtaatcagaacgccaaaactttgcaaaactttaaattttcttgggattttcccttgtaaaaatggaagagccgatctcgagttaaaaacttaagtttcacaaa

SEQ ID NO: 65601 - DNA, 348 bp, Heterodera glycines
  Genomic contig location: Contig_ID=SeqID_7675; Location=1..348; Strand=-
  SCN-specific regions: Sequence locations=1-315,337-348
ctaacttgtcatattgtacttttgaccgtaactgagcttctttaatgaccgccgcagcggattcccaagcttttctaagagacttaactaatttctgcttgacattgtcaacttcactggtgttttcgggttcggtgttgggattcagaatttgctcaatgcaaaatatcgggtctcgcccaaagaccaaaaagaagggggtctcctttgtggaagagtgaattgatgtgttatagcagaaattggcacattcaagaaattcatcaaaatctggttcttcacttgaaatatatttcgcaagtatattgaaaggtcctaaaagatcgctcaactactgcattgccttgg

SEQ ID NO: 65602 - DNA, 773 bp, Heterodera glycines
  Genomic contig location: Contig_ID=SeqID_7675; Location=1..773; Strand=+
  SCN-specific regions: Sequence locations=1-12,34-493,515-584,606-773
ccaaggcaatgcagtagttgagcgatcttttaggacctttcaatatacttgcgaaatatatttcaagtgaagaaccagattttgatgaatttcttgaatgtgccaatttctgctataacacatcaattcactcttccacaaaggagacccccttctttttggtctttgggcgagacccgatattttgcattgagcaaattctgaatcccaacaccgaacccgaaaacaccagtgaagttgacaatgtcaagcagaaattagttaagtctcttagaaaagcttgggaatccgctgcggcggtcattaaagaagctcagttacggtcaaaagtacaatatgacaagttagtacgaaatcaaaccgttcaaataggagatagggtcctattacgcaattacgcaggtaaagtcaaaacatccaagaaatttcaattaccctggaagggactttatcttgtcattgagattaatggtgtccttatcacaatcgtcagctgcacatctcctcaaacaaacccaagaattgtacacattaatcaaattaaaaagtattttgagtactcaggacccccttgcaccacgaaaaatcttcaaaaagatgaagaacaagcactaaaggaattagaatcaagagaacagaccaatgtacctggctattctcatgattcctatcaaaatatctctgataacacagtattaatagaaaacgcacctgcactcacccctaatccctcaccctcttcacagtccaataatcaggtaaaagaaaaagaa

SEQ ID NO: 65603 - DNA, 1048 bp, Heterodera glycines
  Genomic contig location: Contig_ID=SeqID_7676; Location=434..1481; Strand=+
  SCN-specific regions: Sequence locations=1-370,392-423,445-682,704 -797,819-940,962-1048
atgtcatacgctgcggcgttcgttaattttgatctgggagatatgaagaagatttcgctaactgatggccattgcctaatggcatttcaaggatcgaacgatccatttagtaacttcttcttttcgccgttcgtttatgagggggaaagatactcctgtgtggagcaggcgtttgtcatgaagaaagttcgcacattcgaactccatggcgtggcggcggagttaatgcgatttatccacaaggacgacccaacaccaaactccccgcggtggccagacggtcacccgcgtgaattaaaatggttcggacgcgaagccgaagagagagccactcccgccacaaaaagaaaatggtcggaaaacacacaaagaagtttcatcgccttccttgtggagcagaagtttcgccaaaatcggcacttggcagctcttttgctggcaacaaacgacatgtggattgcggaagcgtgtaaagatcgaaagtgggccgttggatactacaaagacgacccattcctgtgcaactacacaccagaaaatggcgcatttgggcgaaattggatgggcaatatcctcatgagcttgaggatgcgaatgctaaatgagcaacaaagtgttgctggtccttctaggcaaattggtaaatgggaggactcaatagcttataattaagaaaactctgaggagttaatataattttgaaactttggtctttatcttatctcttgtcacagaaccaccgtctgctcctgtctatctcatagcacaagagcttgccaatggactgataggagctaaaattgattttgacaacagctttccgcactttgttctgctcccaaatcgtttattgtcaagtggtcttggtctgggtgacttctttactcctggtaaattggaagccgacaacagatttaccatcctggcttcaaacgtcacggagatgacaaaggagaggaaactttggattaatccaaattcctcaattttggcggtccaagcgaccgtaattgacatcaaaagtaaatatctaagtctaagattctga

SEQ ID NO: 65604 - DNA, 452 bp, Heterodera glycines
  Genomic contig location: Contig_ID=SeqID_7676; Location=1187..1638; Strand=-
  SCN-specific regions: Sequence locations=1-41,64-131,163-244,266 -387,409-452
atgacctttgttgggcaagacgctgatcccgaagtagtcatcacatattttggaatgacctcggtgggtgtaaagcgttcattgatttcgacaattgtgccaatctcagtgatttgttcagattgccacatttctatggtaaaatatatataaattttcagaatcttagacttagatatttacttttgatgtcaattacggtcgcttggaccgccaaaattgaggaatttggattaatccaaagtttcctctcctttgtcatctccgtgacgtttgaagccaggatggtaaatctgttgtcggcttccaatttaccaggagtaaagaagtcacccagaccaagaccacttgacaataaacgatttgggagcagaacaaagtgcggaaagctgttgtcaaaatcaattttagctcctatcagtccattggcaagctcttgtgctatgagatag

SEQ ID NO: 65605 - DNA, 575 bp, Heterodera glycines
  Genomic contig location: Contig_ID=SeqID_36223; Location=41..615; Strand=+
  SCN-specific regions: Sequence locations=1-324,346-406,436-575
atgaatgattgcctttgcgccaagtgggggcggggggtaaatggccaataacaaggacattaattatgcttttatttgctatgctttgatattaaaaataaataccaatgctttgcggggaagtgaaaaaaaggaaataactgcaaaaatatgtaattaattagtgatggtaaaaaaaataataacaacacaaaatgcaaattaaagtgagtgtttacagcggcggcagagattatttgggccgagcgacccaattagggccaagggactgagggcggcggagagattggcgaagccaaaaacggcgaaaacgccttggacttctccaatttaattaaaaatgatatttgcacatttgttctctttttttccggccacaaatcccccgcttcattaagcccaacccccaaaatcccaaaaaatcaaattttaaccaccgccctcagccggaaaaagttggacagaatcggccaagacaaaagaaaggtcaggtgatcggtcggcggtcggtccctttgcttttcccttccgccgctgcgccgtttttttcattcatttcgcagcctatcgaaaga

SEQ ID NO: 65606 - DNA, 514 bp, Heterodera glycines
  Genomic contig location: Contig_ID=SeqID_36225; Location=332..845; Strand=-
  SCN-specific regions: Sequence locations=1-260,282-514
atggacgaagggacaaaaagggaaaggacgaagacgacgaacggagtcagtgcggaagagatcaaagcacagcccctgggcacaaaactcaaagccggacggaagggaagagacacagctgaaatgcttctcctgaaaaagacggcactaattggattcagacggagttggacattaatggaagactaatattgcttattgcttttggcaattttgccagcagaccaatgtttccgactcttctgactgtctaatgatgcttttacagtaatagccaaataatattaattctctttctcaatgaaaggcttttcctttggcactgttggaataattaacaatttcccaatttaatccaattttcccatttccgttatttcagaatattaccgttctttcttctgctttcaaatgacctcttccgaagaaaaggagaaaaatgaagcaatgaatggacgaaaaacagcgaactttgaaaaagcagcaactcattagaactaatgacaaaaataaa

SEQ ID NO: 65607 - DNA, 670 bp, Heterodera glycines
  Genomic contig location: Contig_ID=SeqID_36227; Location=328..997; Strand=-
  SCN-specific regions: Sequence locations=1-267,289-670
atgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaattctctacaatattcaaaaaaccgcatgtctctatgacttataccggctgaggtatgggcacttcaattttgacgtagtgtaaaatgcactattttcttaagaaatacagtactttttataggcaccgaaataaaagtcgacgtatctcagcgggcctaaatcgtagacccactattccaaaggcaattcggtagcaaattttgtgctctataaaatgggcctactcaaattttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattgtgaacatggtaaaataaa

SEQ ID NO: 65608 - DNA, 66 bp, Heterodera glycines
  Genomic contig location: Contig_ID=SeqID_36227; Location=311..376; Strand=+
  SCN-specific regions: Sequence locations=1-66
cataaacatttatttgatttattttaccatgttcacaatttgatcaaaatataggtggtcaaaagt

SEQ ID NO: 65609 - DNA, 1037 bp, Heterodera glycines
  Genomic contig location: Contig_ID=SeqID_36229; Location=1..1037; Strand=-
  SCN-specific regions: Sequence locations=1-25,48-133,155-902,926 -959,982-1037
tttttggccgtcctgtcaaattattaatttcaatctttttctctttatgagttcacccgacttcttaacagtcagttgcaaacttcttatctgccgaactccacgaagaaggttgaactgcaccaggaactgcttgttttgctatggaaatgttgtgagtactaccaggtcctttttacagtggctacaattttcactattttatcggattgttacagaaattcctttattatgtgctgaaaagcagcgatgtgcttgaacttctcgtcccaattttgttccatctcaatgattcgaggacggacccaagtcgggttttattttattcttctaagtacccttttaattgaatttttgttcttaagctcggattggtttgattcatatgggcgttttcctaattcttcttttgagtggtgaaagaaatttcggtgtccgattgaataaggcaagtcaaaattcgactgataaaacacgattgaaattatattaattactccatttttagcctttcacttcccgaggacttattgacgtgccaatttttaccggatctcatgccgatttgctgataattgttattttttaatcatgtttttatttattcaaaaatgttttaggttttccacaaattaatcactagcggaaatcacaaattgcagtcacttttcgattgtcttcttacaattgtcgtgaatggtaaagttttcttttgtttttgcattattttcaattcgttttttcagtttctccttatctcaaatcgctatcgatggttactgctaataaattagtgcatttggttgaagcatttaggtccacccaatttgtcagttgtttttttacattcaaattttcctttagcactccttggttcattttctcaactccaacaaatcaccatttgattttctttttgcttgaattgttcaacaacatcatccaatatcagtttgacggtacttttttctacctttttcaaaatactttttttttacatttaggcaattcaaatttggtatatacaatcattcgaa

SEQ ID NO: 65610 - DNA, 1670 bp, Heterodera glycines
  Genomic contig location: Contig_ID=SeqID_7679; Location=114..1783; Strand=+
  SCN-specific regions: Sequence locations=1-10,33-34,57-384,408 -1018,1041-1134,1156-1289,1312-1367,1389-1670
atgagaactttggatgagaaattgaaagagataatgaataatggaattgcatttggtggcaaagtcatgctttggacgggagactttcgtcaaacccttccaattcagaaacatgccacgagagctgagatggtcaatgcaactataaagagaagtgagtattggagattagctaaaagatacagattgacaaagaatatgagagctcttgcaacagagcaagaatttgcgaaagatttgttagagattggaagtggaaaatggaataatgagaatgatgagataattttgccagagatttgtataagcattggtgatttagcagaagagatttttggaaattgtattgtttctgagaattggaatgaaatggccaaaagtgccattttagcaccgaagaatgttgatgttagtgaaataaataatagagttttggaaatgttgcctggagaagaagttgtgtacacgagtatagacttggctcaagacgagaatagacaaagagcagatgaatatttggatgagtatttgaatgctttaaacccttcggggtttccacggcataagttgagacttaagaagaatgctattgttttgttaatgcggaatttgaatatcgaaatgggcctttgtaatggtgcgagaatgaacgttgagcaaatgcaaccgaatttgattgtgtgtaagattttgactggagacaaggcaggtcagactgtgtacattcctcggatcacgctttgctgttctgaagagtacccttttgatttgcatagtcaccaattcccgttggtgttagcttttgcaatgacaattaataaggcccaaggtcaaacccttgagcaagttggaattgatctgaggaaagatgtgtttagccatggacaattgtatgtggctctttcgagagcaagagcttggaataagttgagaattagattagatgatggcaatttagagagaaaggtgaagaatgtcgtgtacagagagttattagataacagtgattagataatgtgttagactagcattggatttagatttagtatagtattagaattgattttgtatagacaaatctgttgttctttgggttgctcaagacagtacgaacacaattcaaagtaagtcattctttttaatttcatactttatcctttctccaaaaataattgttcataacacattcgtactacctagcgggggatgcgccgaaggcgctgaccccgctagttttcttaaaaaattcatctcaaaaatttgtattgattttcttgacaatttaaaacaacttttttggcagtttttagcaactataaattatccctattcatcacttatataaatgagtacagaaatagattttccacgaggaggaacctcaaaagttttacaactcggattgcataataggtaatgaattggatctttcaacaaataattccttaattatgcaattttagaaaaggagcgaagagaatttctccttttagcagcgcaacagctaaggtccgttggcgtcgccattcacaaattttcatagctttagaaaaaaacgaagattgagggagatgacatcgttccttatgctggggtttttcgccaaaaattcacacgtgaaatcctcacacaaaatttgcgtggattggccatcattaaatttgtaacta

SEQ ID NO: 65611 - DNA, 793 bp, Heterodera glycines; identical to SEQ ID NO: 36239
  Genomic contig location: Contig_ID=SeqID_36239; Location=1..793; Strand=+
  SCN-specific regions: Sequence locations=1-20,42-62,90-793
  Gene Ontology: Mol. function=organic anion transporter activity; Cellular component=integral to plasma membrane; Biological process =transport

SEQ ID NO: 65612 - DNA, 49 bp, Heterodera glycines
  Genomic contig location: Contig_ID=SeqID_36241; Location=362..410; Strand=-
  SCN-specific regions: Sequence locations=1-49
ggaagctattcccgaaggattcgatctccccataaatctgggcgcatcg

SEQ ID NO: 65613 - DNA, 502 bp, Heterodera glycines
  Genomic contig location: Contig_ID=SeqID_7681; Location=13..514; Strand=-
  SCN-specific regions: Sequence locations=1-385,407-502
ataaaggtcgattggactcataaagtgcattagagccgaaaagccacccccgcacacggggtccgaaggctagctcaaaccaagtggaaaattcgttttttatgcttaatatcggtagggtacgattcggtgccgccgtttcggtgcccgccgtttcggagccgtttcggtgccagggtgggttcactgccaatcaacgattatggctactcaaattctaacaaagcgtggaagaaaaaaattgttacacgatggttttctgtatgtcttcgaaaaattaaacaaacggggtgacgtcaagttttggaaatgtgaatttttcggacccaggacatcaaatgcaaatgtcgtttgcacactgatatgaatgacaatgttttggaggtttaaatatttaattattaatgttagatatgtaaattttaggcaatcggcatgcacacttgtccgtctggagccgaaaatatcaaagttcaaacacttacgacatcgctgaagaaac

SEQ ID NO: 65614 - DNA, 369 bp, Heterodera glycines
  Genomic contig location: Contig_ID=SeqID_7682; Location=3349..3717; Strand=+
  SCN-specific regions: Sequence locations=1-253,275-369
atgcctgggaaaccagaattgttgctgttggaagggaggggaccgagcacagtcgtcgttcatccgcgcccatctcccgccacgacgccatttccgaacgacgactttgtcgacaaaagctcatcggcggagcagcgccataaaaatttgcgagttgcccccagcactttcacttgccatccaataaaaacgagattgaagccgtgccgaggcctttcctccccaagtgttttcaaagcaaccgcagcgccttcaccgtcttcacaactcttctgtttccgagtcggccaaccaatgagtgacgagacaattttaaacgcaacggacagcgattggcccttcagcaaaagcgaaactcggaactcaacg

SEQ ID NO: 65615 - DNA, 160 bp, Heterodera glycines
  Genomic contig location: Contig_ID=SeqID_36243; Location=182..341; Strand=-
  SCN-specific regions: Sequence locations=1-29,53-160
atgctctgttctctacgtggagttttgccaaatttcttcaaaagacatttatctgttgccattcaaaaaaatataccggaggagcatgacgagggttttgtggacgttgcgaatacggagatactgtgcaaatatgttttcatcaattaccagtttggag

SEQ ID NO: 65616 - DNA, 340 bp, Heterodera glycines
  misc_feature (322)..(322): n is a, c, g, or t
  Genomic contig location: Contig_ID=SeqID_36245; Location=390..729; Strand=+
  SCN-specific regions: Sequence locations=1-53,75-340
atggtttgtgccggtattttgggaatcattctttggtttatcaatgatgcagggagggttttgaggttttgtttagcggtacaaattgttaattatgcaatttcgagcaaaatttccatatgaaaaacatatgaatttaatttgttttaattggcaaaatatattttggcttggctttacgatacaaaaaacaaacaaaaaacaattatgttttgtgtcatgaattaattaatttcccattttcagtgcgttcgcgtgcgcaaagtttgaaagagttttatgcggtacgttcataaaattatggcaaatgtttaaaaaaagncaatgaattaaatgtgaa

SEQ ID NO: 65617 - DNA, 247 bp, Heterodera glycines
  Genomic contig location: Contig_ID=SeqID_36247; Location=578..824; Strand=-
  SCN-specific regions: Sequence locations=1-162,184-247
  Gene Ontology: Mol. function=adenine transporter activity; Cellular component=integral to plasma membrane; Biological process=transport
ggagtcgcttggcatggcttttaaggagttgttcaagcgttggtgtgtcactgagtctgatcgctctgtaaattatcgtcgttttgttgccggttggtcgggcaaaaaatattccgaatgtctcaatgccttaggcaatttgttggccggcggtttggccggaagtgtcacctttttcttcatttacccgttggacttctcgcgcactcggctcgctgttgacatgggcaaaggttgacccccagct

SEQ ID NO: 65618 - DNA, 116 bp, Heterodera glycines
  Genomic contig location: Contig_ID=SeqID_36248; Location=489..604; Strand=+
  SCN-specific regions: Sequence locations=1-116
atgactaaggaaaagccaaaggagcagtgggaaaaacaatgggcagacgaacctgagaaaaaagccatgaaagaacttgaaaagaccgacaaacaattcaaggaaaacaatcgaag

SEQ ID NO: 65619 - DNA, 608 bp, Heterodera glycines
  Genomic contig location: Contig_ID=SeqID_36248; Location=326..933; Strand=-
  SCN-specific regions: Sequence locations=1-79,102-608
gaatggtaaaacaatgggcagagaagaaacggccagcgtaccacggcacaatgcccaaaacaacaataaccgtgtggagccggaggaggaggaggtggacagtttctggtcggtgaaagaggacgaactcgtgtggggccgatgaaccaacagaagcgatatttgagggaagagaagggaatgagcgaagagatgcccgattttgtactcgtcatgtcttttttgttttgtttattcgttttgcctttccaaatgttctgcttttatacaatcgtcgttttttgtcgccatttttggcttttctcagctttttaaagtggccttttcaccttcgattgttttccttgaattgtttgtcggtcttttcaagttctttcatggcttttttctcaggttcgtctgcccattgtttttcccactgctcctttggcttttccttagtcattgctttgttagcggaggatttgtttggactccattccattcattgtacgaatgtcccccccccccccccccaattaaagtgcgttttctttgatactcatcgtcaattcccccttttgagcctctttctctcatttcgttgtcatttgttccttaattagatt

SEQ ID NO: 65620 - DNA, 611 bp, Heterodera glycines
  Genomic contig location: Contig_ID=SeqID_36249; Location=40..650; Strand=+
  SCN-specific regions: Sequence locations=1-203,233-297,319-384,414 -513,560-611
atgaagaaacaaaaccgactgaagaaatgggaaggaattgtcaacaaatttatggaggaaaagggaaaatatttgcgtaaaaaagaacctaaaggcaaaaagaatatccatcatcgagaaattgatgagcaaatcgccgaaacatggggcactaatagcagaacaatttacagatggaaaaaaaattgggacagactcgtgagttttattttattaataattttataaatatggtaactgccaaacttcctattaaatgacagtcaaaaaatgatcattaccgataattagggttacaatttttcagctgaaaattttggactaaatgtgtaagtaaattttctaaaaatggttgttgctaaaaggtcctcattaactcgtaagttttattttatttataaatttataaaaaagccaaaaaatgccaattaaaaacagaataaatttgtgaaggaattaggcattttaaaaaagacatttcgcaaatggaaaaaagaattactgccaaattgctataaaagtaataatttttttttattaatttcaattctatttttaagagaatattaccaatgcggacaaattagaaaaaacacggcaatattttgaaa

SEQ ID NO: 65621 - DNA, 1056 bp, Heterodera glycines
  Genomic contig location: Contig_ID=SeqID_7684; Location=469..1524; Strand=-
  SCN-specific regions: Sequence locations=1-396,418-703,926-978,1000 -1056
atggataccagattcgtggtaagtgcccccgaaaacgcaaggaacttgtttttatgacaataaaattttcactgacgcattttctactgacgcattttccactgacgcattttccgggcgcccttcacgcaggagagaactgatcaaattggacgacgctttagctgtggatttgtgttttgtcagttaccgcaagttgtaagcgtggcctattcttaatttattactaattggaattcctacggaattggttcatttagcatcattaacaataatatgtatacatttcagcaatgggacattgccgttatcacattttaccgaactgtggttaattgggatggattaatgcttcatctttatgacgttttgaccgcggtaagttttaacaaatttataaaaaccaaattgttttaaattttctcaaaagcgcagattgagcaagggattaaaccaccaaattttccccggcggcgccgtcacaagtgatatgaaaaacaaaacaaaacaaaaaagtcatcacttttcttttttgaaaaatctaaatttttgttttcgtcattggcttagttattttttcatttattgttttttgtatacaaaattcacgttacataaaatgtggagcataaaaaattaaaaagataatgacggcacttttcttaactcattggctgccgccgttccatcgtctatttatctcaattaattttattaaatatttaaattcaattattttttttaaattaaaaatattcaataaaaataattataatcataattcataattcataaaaacttttatcaaatcaaattaacaaaatataatgttttattaaaagcttaaaaattgatggattaatattttgataaaaaaataaaattaattatagaatattttttatttattaaaatagaaatttttcaagaattaatcacttatttaaataccctaatttgctattctcataactattgctgctgctgcttatctgcttggttaatcagcttttcgattaatatttaatctataaatctacaaaattcacaaataaa

SEQ ID NO: 65622 - DNA, 388 bp, Heterodera glycines
  misc_feature (20)..(20): n is a, c, g, or t
  Genomic contig location: Contig_ID=SeqID_36252; Location=538..925; Strand=-
  SCN-specific regions: Sequence locations=1-291,313-388
caaaaagcccagcgaattgncaaattgcgactgacaaacacgcggacgcaaatgcaaatgcatcgcaaaacaccgtagtctacgggccaatgtcagttgggcaaagggatacggtacatcgacctgtctcgagaagaactgttcgcggatcttatgttttcttgtgtttgctgttcagctttcccgccgactattggcaattgcccccagcgcttttagccgcgcggctgaggcgtttcagcaaggcggacattgtgcgaagccttcggcaaaatgcccgacggatgggcgtcgatggaggcaaactgcgtgcggtgatgcgacacatcgaaataatgcgacgggaggaagcgcagctgcgcaatcaccggcactatcagctgcctga

SEQ ID NO: 65623 - DNA, 890 bp, Heterodera glycines; identical to SEQ ID NO: 36254
  Genomic contig location: Contig_ID=SeqID_36254; Location=1..890; Strand=+
  SCN-specific regions: Sequence locations=1-37,60-365,389-479,520 -606,676-742,779-799,821-843,870-890
  Gene Ontology: Mol. function=amiloride-sensitive sodium channel activity; Cellular component=integral to plasma membrane; Biological process=sodium ion transport

SEQ ID NO: 65624 - DNA, 691 bp, Heterodera glycines
  Genomic contig location: Contig_ID=SeqID_36260; Location=16..706; Strand=+
  SCN-specific regions: Sequence locations=1-302,327-535,557-691
  Gene Ontology: Mol. function=ATPase activity; Cellular component =chromatin remodeling complex; Biological process=spermatogenesis
atgttggacttggaatgctttacatttttgcaccgtgccctcgaatccgaagtcaacccggtcattgtgttcgccaccaaccgaggccggagtaaaataaggtgtgtgcctcgggtggaaatgtcacattacgcgtaccttacatccgtcaaaactaatttgctcttgtgtacaattcatattttatgttaactttttgattttcaagaaattcggatgaaattggcttctacggaatcccaagcgatttgatcgaccgtttgctgatagtgcccacccggccctattccatcgaagaaatgtccttggtttgtttgtttgttcgtggtggatatatatgtagaccggcgggtggtcccactgctgatcgttcagattgtgagaattcgtgccgatgccgaaggcgtactgctcgaccccggggcgttatctcgcctttgtgagctcggtcaaaaaacttcacttcgttacgtaatgcaactgttaacacccgcaaagctactcgcccacattggcgggcgtgagtccgtagaggttagaaggagaaaaactgtatttttagcatagaaatgacatttagattgttgacattgacgagtgcgtgcaattgtttatggacagcaaaacatcaactaatctactcaaaagcaagcagtcagaaggtggagacgacgatgtggagatgagttga

SEQ ID NO: 65625 - DNA, 443 bp, Heterodera glycines
  Genomic contig location: Contig_ID=SeqID_36261; Location=226..668; Strand=+
  SCN-specific regions: Sequence locations=1-338,363-443
aagtcgactcggctttggctgaacaaattcccgttgttgagaagcccataattaattatcataaaagagcattcgcacaacgggtaacaatttgtgaggcgatcaacaattgggccaatattcggagtagtgtccaagtagaggattattcttttatgctttactatgccaacacgagactacaaaatgatcgatcattgatcaaaaattatgcgatcaatttcaacagattgtatgagcccgaatatctgttcgacatgcaaaaactgaagttgcaaatcagtgccaattccaaatttgacaattcgtatgccccactccgccgtatatttgaccaccaaatggggaaaatgaagacaaaagcgatggcgaagtttgtgtcaagcgccttttcttgtcatcagcacctcagcatgttttcaagaagtcattctatggcatag

SEQ ID NO: 65626 - DNA, 328 bp, Heterodera glycines
  Genomic contig location: Contig_ID=SeqID_36262; Location=195..522; Strand=+
  SCN-specific regions: Sequence locations=1-10,46-92,192-224,247-328
atgcattcagttttttacttaatgtttatttttgtatttattcatggctccatatgtgagtgatatcccattttgaaggaaaattgatttggaaattatttattagtctttttatagaatttatttttattatttagacatttggaaaaattcattattaatttaagaaaataatgattattttaaaattactttgaattctatcattttttaattttctttacagtttattaacaaattagtaattatgtaaatatggttgaatgaaattattttaaaattgtcgctcaaaactcccggtttcaaacattgccgcatccttttctta

SEQ ID NO: 65627 - DNA, 199 bp, Heterodera glycines
  Genomic contig location: Contig_ID=SeqID_36264; Location=87..285; Strand=+
  SCN-specific regions: Sequence locations=1-17,40-150,172-199
atgacggagtatgccagtgttgcagtgagaaagcatttacacgcagctttatcttaaatttgtattatactaaatcaaatttttttaggtatttattgaacgctttttatgatttatcatttttttttggggttttatcgtataaaaaggcaaaaaaggaatttcattttctccgaaaaactctcggattaatttgaca

SEQ ID NO: 65628 - DNA, 422 bp, Heterodera glycines
  Genomic contig location: Contig_ID=SeqID_36264; Location=419..840; Strand=-
  SCN-specific regions: Sequence locations=1-25,48-147,227-264,287-375
atgggaagtttttgggcaaatttatataaaaatggtgccaaacttgtgaaaagtgccggtgccgtagcaacaaaaagtttattatgccagttgggtcaactcgatcaagtcattgtcaatacatttgccaactcattaactcaggtttttaagtttaattaaatttaatttaaattcttttaaaatactcagattttctaattttaatttattttaaatttatatattattttttagcgttttttattttttggcaaatctccaattgattatgttgaacaaaatgatccggcaatgggacaccttttgcaaaatttgtacaccatttaccaaaaacttaagctgttgaagtttttacgtaatgcaattaaatggaatttttaacaattttatataaaagttttttcttaaaaattaataaa

SEQ ID NO: 65629 - DNA, 294 bp, Heterodera glycines
  Genomic contig location: Contig_ID=SeqID_36265; Location=520..813; Strand=-
  SCN-specific regions: Sequence locations=1-294
atgcctttgctttatccatacgaaaaagacggaagcgagagagaaaaacaaaattttaatgtaccctatttttgcctctccattagagatactttcaaaacagattgccaacaaatgtcaggctgtaaccgccaatgcaaattttgcatgtaaaaatgtttgccacgtttaaacgtgataaaaagacgtaaggcacgacggaaggggaacccatcaacaaatgttttttgtataacatgatgtttttaataattttttaagaatattgattccagcacatgcacgtattcttga

SEQ ID NO: 65630 - DNA, 337 bp, Heterodera glycines
  Genomic contig location: Contig_ID=SeqID_7689; Location=130..466; Strand=+
  SCN-specific regions: Sequence locations=1-255,277-311,333-337
ttaaatattcaaatttttctctcggcggtacacttccatctagagctcggcctggaactgtatccaggcctggatttttcctggatccaggtccaagtctaggccatttttcggcaacctgggtttttcctagacctagattttcgccggcccctaaaaattcttattcttttaaaaaattggctcaaaatcgtgcaattttgtcatgtctttaattttgaccctaaaatcttattttgaccagcgatgtacttatttcgggaaattttcaagggtaaccctggttaaaatgccctttactttcattggcatttaccaaatttattattaaaaatta

SEQ ID NO: 65631 - DNA, 1514 bp, Heterodera glycines
  Genomic contig location: Contig_ID=SeqID_7689; Location=3279..4792; Strand=+
  SCN-specific regions: Sequence locations=1-88,150-316,357-602,624 -658,715-746,770-784,807-862,892-1032,1054-1114,1159-1390,1412-1514
  Gene Ontology: Mol. function=phosphoserine phosphatase activity; Biological process=axon guidance
tcgttattccaaagtgatttggcgaagtttaaaacgacagaggccgtcggccgtgtgttttgacatggactcgacactaattaaagtcaaaattaatgataataaaaattatgaaactaaaatatttattttattttaaactaatttttcaagaaaatactgctcaaaaaagcacttttacacttctcaggaagaaacattggatgcgtatagcagctttttcggcttggatttgggcggaagtgccatcactgaaaaagcaatgggcggacaaattggctttaggttaagccagttttcaaatataagaatacgcatatttaaaaaatatattaaatttatgttaaaatatttttggattttgttaagaaaagcactggcccttcgcttggaaatgctaaggccaacaaaagcccaatacgaacgatttttgaacgaattcaccccaacattaagcgatggagtaataaattaaatttctggtattttccattcagtgccccaattccaaattaaaaaatccatcaaaaggccgcgaaaatcataaaatagcatgcgcaactctctttgttcttcaaagtgaataaatagttccttcttcttacaggaatcatgctgcagaaatttcatttgaaaatttttggaaagagcaatgaaatttaggggaattttaaagaaaataaataaaaatggggatgatgaaagagtaaagtggaatggaaagtaaaattcttttgccattggccaataatttatgcagaagaaatgggcggagtaaaaattgtcaatttcttaatttattcattggggaaggaaaaatgctatttgcgcgcccttttggtggctttttttcatttgaaatggcgctacagaaagggaaagtacaaaattcctaaataaatccgcttacctattttttagttatactttaattaggttgaacagttggttactgtactccgtgggtacggtgtcgacctttacattgtcaccggcggattcgtggaggtcgctaaaagggtggcacagcgtctgaacatccccaacaaaaatgtatttgcaaatcgaattctgttcagtgctgacgggtgttatgagggctttgacaaaaggcaaaaattacataaaaaatgaaaagaaaaaaataataataatttagtcaattgacgagtcaatcgggcgcttcgccaattggaaaagcgggcgtttgccaacttttgaaggagcggtgagaatttggcaaatgccattttgggcaactgatttaaattttgggtcaaataaaatgctaatttgtcaagaaattcctacaaattgcttgtgatggtcggcgacggaggcactgacatggaggcacggcccccggccgatttgttcgtcggttatggcggaaatcaggtcattaaatttaaacgctcaacggcattcttggttggcaggtgcgcgagaaggttcggctgggctccgattggtttgtgcgtgattttcgaacccttaccgacgcaatcgaagag

SEQ ID NO: 65632 - DNA, 688 bp, Heterodera glycines
  Genomic contig location: Contig_ID=SeqID_7689; Location=1479..2166; Strand=+
  SCN-specific regions: Sequence locations=1-71,113-261,362-531,553 -576,598-688
atgcgttcgctggccgcgttaatccaacaattggtcagtgctctgaacacactgaacacagtcatgcaacaacagcagcagagataattaattaattggaagaaagcaaaaacattgtggagagaaagaagagataccgtatattctctaattaaggccctgtctccattaatcccgctgtctccaattatgtccccctttctgaggatgatgttgaaaaataatcccccgtctctatttatccccccgggggataaatggaattattattttttaaaaatcttatttttaataaaaattaattttaattaattctaatttgaaattcatttaaatgtttaataaacatgaaaaaataatacagaaaaatcacttactttactcaagtccgaacataggtaacccagcccggtgctatgtcgttattagagctcggtattttgaaaaaagcctggacctggacctggattccatgttcgacctggacctggatttcctggacaaaaatccaggaaaatacaggtccaggaaaaatccaggcctggatccaggtccaggccgagctctagtcgttataaaaaagccgtcaaaaagggggcaatcattaataattggtgtcccgacgaaaaaaagtgttaaaaatttgtcggatattttttctgattgtgagcttaaaaaaatgcgctga

SEQ ID NO: 65633 - DNA, 489 bp, Heterodera glycines
  Genomic contig location: Contig_ID=SeqID_36272; Location=375..863; Strand=-
  SCN-specific regions: Sequence locations=1-247,276-377,420-449,477-489
atgcggcaaatggaggagcttggccagttcctccgggagcgttatgccgctgcaaattttttgccccaacattttgacagaaaagaggtaagaaagtgatcaattattgattgattagggctatcaatttgtaaatattaatctccgaaatcaaaaagtacaggcaatttttaactggaatttgatctgaacgcctaattgtagataaaagaaaaaaaattatcctattattaattcatggacattgatttatataattaatttaattattttatcaatcattgagttctttcgcatcagctcagcacggaattaattgtaaagccaaattgggaaggtgaccgaaagttttcgccactgttcgtttcgtcaccgagaaataatttaaaatatttctggattttttttatttttaaattggtttagttttgatgcaatttccaggtaaatttccgattaaatttaaaaaatggattaattagagtttga

SEQ ID NO: 65634 - DNA, 386 bp, Heterodera glycines
  Genomic contig location: Contig_ID=SeqID_36276; Location=38..423; Strand=-
  SCN-specific regions: Sequence locations=1-107,134-386
atggagaaggcctgcaaaatttggagagattatatcgattttagtgcgctaggttcgatgaaactttttaaaatataagcctaaactttttggcctgtttaaaaaggaattaaaaatttttaaaaattttattcatgtccttttgataggaaaagcatcagggacccttgtatacgtcttaattagcattttgatcggtggggatcggtttatgaaaaaatatttagtaattgatttttcgtcagagggtagatatagtaggtctaaaagttaatataaaatctataaattcagttttgatggagttatcgtcatatcagtgattttccctgtatttcagattctttaacaagatatggtccgattaatatcagattgtaaataaa

SEQ ID NO: 65635 - DNA, 206 bp, Heterodera glycines
  Genomic contig location: Contig_ID=SeqID_36276; Location=1029..1234; Strand=-
  SCN-specific regions: Sequence locations=1-36,66-90,119-206
taacttgtaaataaaatttggtgcgtttcagagcagtctgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttat

SEQ ID NO: 65636 - DNA, 327 bp, Heterodera glycines
  Genomic contig location: Contig_ID=SeqID_36277; Location=454..780; Strand=+
  SCN-specific regions: Sequence locations=1-282,305-327
atgaccgcggcgggggcaagagtggatggggctgttcagattttgtccaccctgttccttatcgccaactacgcaatcgtgctgccaatgttcctactgtgttggatgatggttgtacactggctccgccgctccggcctcatgcctccgcctcatcaatcaccgtcgacatcccaacaccccaaccgctacggtggccttcacaccatatttgaggacaccgttgagcagaaggcagggcatgagaaagacgtacggcaacaacaacaacgccacacgtcagctgctgctgctgctgctgctgatactgtcactacagaggcaatg

SEQ ID NO: 65637 - DNA, 162 bp, Heterodera glycines
  Genomic contig location: Contig_ID=SeqID_36280; Location=1215..1376; Strand=+
  SCN-specific regions: Sequence locations=22-162
gaatttcccccgctctctccattcattttgcgatgcatcaaagcaccgtcgcgccgtcctccgccgctgctgcgcagagtttgggctgtaaaattgagcccccaaagccaagggttgacgccacgcgggcgaccgactcggacaaacattcgacagcaaaaa

SEQ ID NO: 65638 - DNA, 126 bp, Heterodera glycines
  Genomic contig location: Contig_ID=SeqID_7690; Location=1..126; Strand=+
  SCN-specific regions: Sequence locations=1-126
aataacgtaataagcaatcagctacaaaccaccccggccatatatcctatgagaaaaattgagatcaggagtcttttcatcccgcgtggcacttctgacctttcacacaatgtttttacaagcatt

SEQ ID NO: 65639 - DNA, 809 bp, Heterodera glycines
  Genomic contig location: Contig_ID=SeqID_36282; Location=1..809; Strand=-
  SCN-specific regions: Sequence locations=1-468,501-607,629-750,773-809
  Gene Ontology: Mol. function=alpha-methylacyl-CoA racemase activity; Biological process=isoprenoid catabolism
aaaaaggttttggcattttggaatttgattggagcaaattgtggaaatcttttgggggccgaggctttgtgttggactgcgcaatgacggaagggttggcttacctgggctcttttctgttcctctcccgtcatgagccgtggctttggcacgaggaatttgcccttttctcgggtaaatgtcccatctatcggtaattttctttttttcgagattaatctttgtttttggccattcgtttgaaggacttacgaaacggcggacagaaaatggatggcagtgggagctgtggagccgaaatttcagcagaaactcttcgaaagtatgaagattttcgaatttggcacttattttcgattgctttgcagttttgggaatttccaccgaaaaaattgacggaatggcgaaattaacgcgcgaaatggaaaatgcgttcaggggaaaaacgcagagagaatgggccattatttttgaaggtgaaaatgaaaagggtcgccttgcccctcccaaacggtgccattgaggggaggacgcgtgtgtaacgccggtgctgaacatggacgaagtggggcactacgagcagcacaaaagacggaacgcattccttaggggggaagtggagggagaagccgtttgggtgccgagggcagtgccgaaacggatggaaacggagaaaagccaaacgaaagcaaaaagtgaaaggacggaaagggaaaaaagccaaatgagggccaaactgtgagcacggccaatgaatgaatgaatggcacaatgtcttccaaatgcctttctctcccaaaatgccattc

SEQ ID NO: 65640 - DNA, 49 bp, Heterodera glycines; identical to SEQ ID NO: 51181
  Genomic contig location: Contig_ID=SeqID_36284; Location=557..605; Strand=-
  SCN-specific regions: Sequence locations=1-49

SEQ ID NO: 65641 - DNA, 381 bp, Heterodera glycines
  Genomic contig location: Contig_ID=SeqID_36291; Location=501..881; Strand=+
  SCN-specific regions: Sequence locations=1-139,197-381
agggtcatcacaatggagtcgtgcaatcggttcagcggagttgaacatgctgcttacctgcactatatgcgcaactccagcgtgtatttcgggcccggctgtaacaatggcagtcaaacaattgaaaaactaacgaatcaaaaaaatatttaaaaatttaaattttcatttgaaaataaattttttttattttattcagaaatactggtcattggtcggcttgtttcacgttggaatggtacaaattatgctgccaaattgttaactttcattttcttcccaatttcagtgccgatcattgctcatttgtccggcgatgacgcactttctgatcgaacaggtcggtgattttggccgtttcactcattaatcaaatcatcg

SEQ ID NO: 65642 - DNA, 1320 bp, Heterodera glycines
  Genomic contig location: Contig_ID=SeqID_7692; Location=1012..2331; Strand=-
  SCN-specific regions: Sequence locations=1-163,186-373,395-476,498 -669,780-927,978-1108,1133-1175,1207-1281
atgcgatggaggggcaaaaatttgggcaatattgttgaggaattggataaagaaggaaatgatgacggtgatcagaaaaatgatcagccagataaaagagagacaatgcgaaaaggagagaagggaaaagatggcagacaaaaacagtcgggtgacgaaatagttgaagaaaaagagaaaaatgatagtgaaaagggcgaagcagtgaagaaggaccaatttgctactacagtattccggatattgtaaactttactgtattaaaaaatggagaggaataaaataataagattatgagtttattgctgactttcttggactttaactttgagactgggattctggatttttttaaatctgtaaataattgacttaaatgtataaaaagatttttcgccggcaatccatttttatgaaaaaacctaggcaaaagggggtgtctttttgaaaatacttttaatgaagcctaattaggatttttgttcttgggcttttttgggatctgaattccggaaacaaaaaacctattgactcataaaacaaataaataggagggcctataaaatgcaggagtttttaactttgacataatctatatatttggaaatctctgtaacaacagtatcccttcaggctatttatgcactaaaaaactgtattcaaaatgggaattaaaaaatatattataaacatatctatatttttcttgcaaatatagattatatatctttttttgataaaaatttaaaataaattcgaatatttatttcttttttaaagtgcgctcaaaaaagtcgcgtcgcgcattgcggacacagctgaccaagcgcacagagacaacgcaattgttgtggtgttgttcatgtgttcgaccattctcatcttagttcaagtgaaaaaaaagatgaaaaattttgaattaaatcgaataaatatttttaaaaattttttaattattaatttttataattaatttaggtagaaaccaatttgtgctccaccatgtttcaaaatgtcaaaattgaagttgaagtgctgcgtcaaattgtgttcgacccaattgggcgtgtgcttgcccaaacgcaggtggacaattgaaaaaaaagtcaaattaataatatttttttaaaaacaggtgcattacgttcccacgtgtttttaagctttttttaaaaatttcttagtttcaaaattaaaaaaaaatacgggcgtgaatcaataggggggggggcggactagctgctcccgagaaaacccttaataacatttaaagtttcaaagttataaattaaaaaaaaaaacttagaaaattttaataaa

SEQ ID NO: 65643 - DNA, 203 bp, Heterodera glycines
  Genomic contig location: Contig_ID=SeqID_7692; Location=3918..4120; Strand=-
  SCN-specific regions: Sequence locations=1-203
acattcgaaaactgttgtccaccgtggacgcgaccattcaattccatgggaaaacgacggtgctggagaacaccattcgggacgggggcaatgtgctgttgaacattgacgactatttggaaaagatgcgcaacctgaaggaggcaatcgccttttttgccacccatccagtctacagaaaccacgagcacattgtacggtag

SEQ ID NO: 65644 - DNA, 618 bp, Heterodera glycines
  Genomic contig location: Contig_ID=SeqID_7692; Location=4137..4754; Strand=+
  SCN-specific regions: Sequence locations=1-78,105-237,264-410,432 -503,541-544,566-618
atggcaaaggttcaaaaaatcattaaaaaatggctggccgaaaaatgggctcccggtaaattggacactatcgtataaaaataaataaataaaaaataaataaaacaaaattttggtttggctaaatgattttattttattctgcacatacttatgttttttataagcgtaataaaacggaaataaataatgtttttattaacataaaacttcagcaaaagaaaacaaccataacatccaaaagaaaaaagttttcttttggataggattcccatcttttgtgcaattttagcacattgaccaatcttcaccctttttcgtgcattttttttggcacattgatcaatcatcttgcatgttgaatgcttgattctaagtgccttaattattaatccatttaccctacccaaatttatttttcaactcaattcctgggtttattttaggatggtgtccagttttcccgtgtccagtttcctatttggagtccagaatccgaacaaaaggagaaaattaatttttctctcaagaatgtgatgcgagcgcccccagaaaaccccccgagtattactccgaaatgcataaaaacaactttttaatcttttttttatgggacca

SEQ ID NO: 65645 - DNA, 164 bp, Heterodera glycines
  Genomic contig location: Contig_ID=SeqID_36293; Location=205..368; Strand=+
  SCN-specific regions: Sequence locations=1-22,50-164
atgataactcctgtaagtaggctttttaaaatataatttaaattattttcataatgttttttcttggtattttctcattttttaattttcaggaacaacaccaaaagcggctcgaatttataaaaaggaaaaaaatgaatagcgtgggctgtttcggcttggag

SEQ ID NO: 65646 - DNA, 383 bp, Heterodera glycines
  Genomic contig location: Contig_ID=SeqID_7694; Location=406..788; Strand=+
  SCN-specific regions: Sequence locations=1-28,67-129,152-259,293-383
atgtttccaactctgaagaaaacgcaccgaactcatgtacggattgatgcgcccgtgcgcgcggtaagtgcgccgacgcattttggcggccgcttgcacgacgatgtggtcaatgaccaaatggtcgacgtccaggcccttcacctcggcattactctccgcatttctgtgcaaaaatgacgatacaaaatgcaaacacttaacatttggtcaagtttgtttattatgaattttcttgtgggtaggctaggatatacggaaaccaaaatggaattccaaataaaatgtttttagggtcccaaacagaacggccttttacctgagaagttggagaaggaactcggcggactttttcggccaacgtccctgtgttgtgcctaaca

SEQ ID NO: 65647 - DNA, 503 bp, Heterodera glycines
  Genomic contig location: Contig_ID=SeqID_7695; Location=2057..2559; Strand=-
  SCN-specific regions: Sequence locations=1-503
atggcattgccacgcgccggtgcccggcagttgcccccgctgaccatcggcagaggcggcgtcggaaacagcgaaatggcgactataatgacagacgatggaggaacaggtaaacaggtctaattgttattgtgggcaaggaaggcgcagtggcaagacagggacaaatcattaaatgcgcaaacaacggcattttttgatgtgccgtaattacaaacggactgtccgggacaaaacttattatatctgtggaatttgcccattttggaagagcaattgctgcccaaatgctgcttaaaccaatcaatttcctattgatgctttagagtcaacaaatcattgccgcgacggcgacgaggagccgccgcagcgacgccgccgcgggccgaagttggcactggacgaattggacggatgaaaaagggaaaatggacgaaaaagggggggggggggaaggcactgttttactctttatgagagattttctgttcaattaaaataaa

SEQ ID NO: 65648 - DNA, 631 bp, Heterodera glycines
  Genomic contig location: Contig_ID=SeqID_36303; Location=1..631; Strand=-
  SCN-specific regions: Sequence locations=1-192,216-631
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattcctctgttccaagcaccccaccaaaagcaaaacgatataaccaaaatataaggaaaaatttttttaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctaggcgcatcggttcgggg

SEQ ID NO: 65649 - DNA, 892 bp, Heterodera glycines
  Genomic contig location: Contig_ID=SeqID_36304; Location=55..946; Strand=+
  SCN-specific regions: Sequence locations=1-57,79-138,160-182,224 -292,314-474,496-545,569-716,800-892
atgaggactccgccaccactgttgtgcagcgctattcgctgcctgatctggcttcatcaacagcaacaacaacgccaaaaccaattcgcttgcacgcgaacaaattttcttggcacgataatgccaacatcaacaatttgtgacggcgcaacaacaacaacccaaggaatggcacaccgcgtaccacaaccaccaacagacaggggcaggcggaagcggacgctaccgcgaaggtattgcaggtaaaaaagcagacggatcagctgcacccagtgaccacgaaactgaaacagccgaggcagcgtctcccagcttggtactgtttatattaccaattaggcattatttgataccggtatatcctggagactgttaattttagttaatgctattttttgtgtatatttgaacaatatcccaaaaaactgttactgtactacaaaaacgggcaaaatgtaacaaaatgtgcttccgttttttaaataaattaacaatttgcttttaattgcctcacataaatgtccttctaaaaatttagagtttttatcaatcaaaatttttaaaatttcagcgaatcgactagccacggtggcgcaccaccaacagctgagccgattaaaatgccaaataataagcggtttattatagacgaagccgagttggaattaaaatatgcttggattcggcactataacgtaattaaatttgaacgttgcattaaatttatttaaaatttatttttgtcctttttaagtaaaaaataaaagtaataatcattttataatgtttattataaattgacgaatttcagccaattacagctcttgccggaggacctcggatggattggaataataacgataaaaataatgaaattgtaacaaaattttaa

SEQ ID NO: 65650 - DNA, 148 bp, Heterodera glycines
  Genomic contig location: Contig_ID=SeqID_36310; Location=885..1032; Strand=+
  SCN-specific regions: Sequence locations=1-148
atttgttaaaaagtccaattatcactgcattcttatgattctcgcttcttcgtcaaagcgattagcttgtcaattcctcatccgaaaagtgcctcattttgctgtgacttcctcgagaaaagagtattttgttgttttgtcgacatga

SEQ ID NO: 65651 - DNA, 1274 bp, Heterodera glycines
  Genomic contig location: Contig_ID=SeqID_36311; Location=229..1502; Strand=+
  SCN-specific regions: Sequence locations=1-149,174-223,245-268,290 -590,626-814,852-871,893-1070,1093-1274
atgtgttacaacccaaaatttttgaaatttattaaaaatcgtaagaaacaaaagaaatatatgagtttacatatttgaaccgctgtgacgtaggaattcggcgggggtttcacgactttaaaagaaagccaaagttaaagtcacatgacgaaatttaaaaaatttaaaacattatgccaaatattaaataaacattatgccaaaataatatttttggcattttgaattaccaaaaggcaaaatttcgttttttcggtgttcctctgctaattccttccatgttaagccattgtacatgtttaatcctgcctttctttaattctctcaacaattcctctgtaggcagctgtcactgtttggtcaatggtttggattaagcctgaacggttgttatttggacacagtttttggtaaaaaaaaaacaaattgcaaaaatcgtaaccttttcttttattaggcattctgaacgtgccaacccgtatttttgtgcttcaacgtcgaaaaggccatcgtgaagatgagcagcaacggttttcgcatcagcaaaaacagcacagtgacgtctcctcctcatcgaagggttgaaaatgaattttttaaattttgctaaattataaattaaattccaaatttcagtgctcagcggaggactgtcggctttgtttgtgtccaccatcgactcaatttttgacactcgtccgccaccctatcgcatcatttaccagcgagaattggacgagggccaaattgcgtggggtcagtcagaggctaatgactccaaaatttggggatgggccaaactgggaattttggctaaaattatttttgtaataaatttaatttctaattttcgcttttttctgaaattaatcatattaatgcgatttttaaattttacaaaaattcatccaaatttttcttccgtttttcatctctcccaatattttccagtgattgcaattgccgtcgattggcgcgatgtgttggacaattggcaatgtttggagacttcgctgttgccaattttggaggtattttcaaagtaatagaaaaaataacaaaaacaattcctttttaaattttccttttcttagtcattgggcaccgatgagaacgaattggagaaatttgtgctgacaaaaattgacgggtttttggcgctgcgcgatgaaatggaacgccgtgaacatttggtggccgacggtggggaggaggacgatggcgccgagtcggctgccggtgaaattttacaaattaaattcaaaattccataa

SEQ ID NO: 65652 - DNA, 199 bp, Heterodera glycines
  Genomic contig location: Contig_ID=SeqID_36311; Location=8..206; Strand=-
  SCN-specific regions: Sequence locations=24-199
atggcacgaaccaagcaaacagcccgcaaaacccaatcccaaaaaggcttttcgtcgagcagtggcagccaacacatgcagagtcaactgcacaacttgagaaaacagttggctacgaagcgtcccaacccaaaacgagggatcggatacaaagaattgcctcctgtcaaaattgcccaaaaacgtcatcataagaaag

SEQ ID NO: 65653 - DNA, 1095 bp, Heterodera glycines
  Genomic contig location: Contig_ID=SeqID_7696; Location=483..1577; Strand=+
  SCN-specific regions: Sequence locations=1-150,172-179,201-597,622 -702,724-963,1010-1095
atgattggaacatacggagttcccaaaagtgtgtcgattatgtcaattgcttggcggaagccattgcgtgcagtctttaactggctgatgatttcttcgttgccctctgaacggacgagcttgattttgtcggcagcgtggatggcgtcgtattctgaatgtttaagttgtatgttaggtaaataatatttggaatcaaaaatatttaattattggacacttctcaaacaacaaatttgaggggcggtgttgactgccttccccccttccaaatatttgccattttcgtctgaaattagcgattgtcgttggtttcaatcacaataacaaacgacttattttgcgacagatttggctttagtcgttcgtaattgtgattggcccgggttaaaaatgttaaaatatatcttaatcaattaccctaattttcgcatttttctatttattttcaaaaaatttttagtcaacatctactaaaaagtgttaaatgaattcataaaaaaattacccgcggccccttaggcaccgcttctatcccagagcttagctgtgatgacccttacttacattgaaaaatcttactacacacacacacacaaaaaaaatattattttttattaacctttaattaaatcgacggggattaatttattttcagttgttggaacgccaattaatgccacagaaaaaataattggaaacatcagaaaatacagtgccatttttgaatactttatgaaaatgattgtgaacgtttcgagataaaatgaatggaaatgcacagccaaaaggtcatttataataatgggttttgtgaatgccaacgcataaaagggaggcacccaaaaggtcatacatccatttgtgcagagcaccataaaaatttaaatatcagatggaaaaggttatgtaatgagtaatatttttggggcaaaaaaaaggcaaatacaaaaattgttacacataaatttagattttttattttgtttcttaaaaattattttttaaagaattgatgaattatagaaattttggtttagtcatatgtttagactcactttttaatcctataatgttcataaaagcaaaaatgta

SEQ ID NO: 65654 - DNA, 117 bp, Heterodera glycines
  Genomic contig location: Contig_ID=SeqID_7696; Location=81..197; Strand=-
  SCN-specific regions: Sequence locations=1-117
caccaaaaagaccctgaagtttcttggagaaatgacgcaactgagggtgtgctgggcaagctcaccacgacgatgggcccttgtttctgcaaaggaacagcttacttaatacattcg

SEQ ID NO: 65655 - DNA, 128 bp, Heterodera glycines
  Genomic contig location: Contig_ID=SeqID_7696; Location=1785..1912; Strand=-
  SCN-specific regions: Sequence locations=1-128
gtgacccatggacaccatcatcgacgcaatttgcgcctccaaattgcccgtgtcgcgcattctgtgcgaccagatccgctcggtgggcaagtcgatgctgctggtcgggccggtcgagtcgtccaaat

SEQ ID NO: 65656 - DNA, 168 bp, Heterodera glycines
  Genomic contig location: Contig_ID=SeqID_7697; Location=3232..3399; Strand=+
  SCN-specific regions: Sequence locations=1-168
  Gene Ontology: Biological process=growth
tgttgttggtgttccgcacttgggccaacatgtgttggaagtccaacgggcggccgtccttcgcctccatgtacgccgggtcgaggccgtcgtcgccaaacgtgaactggaccacctcgttggtggaggtgcgcaccgtgttgccatagttgacagccaaatcctggc

SEQ ID NO: 65657 - DNA, 574 bp, Heterodera glycines
  Genomic contig location: Contig_ID=SeqID_7697; Location=2260..2833; Strand=+
  SCN-specific regions: Sequence locations=1-25,48-106,288-574
atgaaattatgcttatttttatccgttttaattgcatttttaattgtgctaattgaaattggagcagaaaagaaaaaattggaacaatcatttgaagaaatatttggagaaaaatgggaagaaaaagaagaagaaaatttagaagaagaaaataaccaaaatgaaaatgatcagaaaaaacgagaaattattgagaaattttacaaaattaaagaaaaaattaaacaaaacgaaaaaatatataccagaaaagaatggaataaaattgaacagaaaatagggaaaaaattggggacaaatcgccaatacatttacaaatggatcaaagaattaaatcttcaaaaatataaatgccacaaatcaaaaacggatgaacaaaaaattgaaattattcaaaaatttaattcaatgaaaaatgagtataaacaaaaaggaagaaaatattcaaaaaaagaatggaagaaaaatttgcagaaatttataagaaaattggaattaacgaaagaagaattaacaaatggaagaaacaatttggaatgaaaggaaaaataacggaaaagaaaagatagaaaaa

SEQ ID NO: 65658 - DNA, 548 bp, Heterodera glycines
  Genomic contig location: Contig_ID=SeqID_36312; Location=291..838; Strand=-
  SCN-specific regions: Sequence locations=1-97,186-202,224-432,455-548
atgatcgtcttgcaaagccaaatcacagcgtcgattacagtaaccagtagattgacagtattcatagccaaattttcgaatacggcaaaaactgatgagaaaaatgaactggacgaagaagaagatgaagttgttgatgaagatggagaacgggaagaagaagaaggtgaagatgttgatgaagatggattggcttaaaaagaaaatgattttatgaccaaagtcattaaaacaatggcattgggaaatctttccggaataactttttcatggcttaccctccgtttctgatgccgatctttggttggcatttgcacgcatttcaaaggacagcaaataattcacaacttcgattcgcccgtgaaaggacgcggcagtgatcgcagcgcgacgcaattgatcagagaaatggactctttccataaagaattggactaaaagtttattggccaactaataattttgaaaaacaataactttatggtattttcccgaaaattttcatttttttagtgtattttgtgggagtcccaaaagagatgccataa

SEQ ID NO: 65659 - DNA, 243 bp, Heterodera glycines
  Genomic contig location: Contig_ID=SeqID_36313; Location=10..252; Strand=-
  SCN-specific regions: Sequence locations=1-98,120-243
atgcacgcgttttgcgctcgagctatttatcatcgggcttgtcaatccaaagcgaaacaacaaagatgctgttttgaacgaataaagggaataggttattttgaagaagtgtcaaatgaacatgaagcaataagcctgcaaaatctaataagtggaaaatacatgagtatagaatttattttcagaaagtgtccacagactttgcaaaaaaagatttgcaatttatcaactaattttgagaac

SEQ ID NO: 65660 - DNA, 371 bp, Heterodera glycines
  Genomic contig location: Contig_ID=SeqID_36315; Location=71..441; Strand=-
  SCN-specific regions: Sequence locations=1-371
atgcgcaggcaatgggcaaacaaattcgcgcgccttgccagcatttcccggaagacgctccggtcaaacaaagccggcaccgcctcgcatgaggtcggccacagcgtgatcatttggcttcttggggtgcgacaatttttgaaggttagtttagggcgaggcttatggggtcggggtcacttcggcgcggaccatttcggcgccgcaaattttgaaacgctataacttttttatttgtcattaactttagctaatctggcatcattcgaaagctctgggtgcgctctttttataaactgactaaattttttgaaattttgcaggctaataaagtatctcaaaagctatcgaatgataacaaaaatatttaa

SEQ ID NO: 65661 - DNA, 527 bp, Heterodera glycines
  Genomic contig location: Contig_ID=SeqID_36316; Location=111..637; Strand=+
  SCN-specific regions: Sequence locations=1-226,257-527
atgctcatcggcatgctgttcatcctcagcgtgcagtcgctgatgctgctgacggtgctgcgctgtcgttactttctgtcccagcgcgaattgcacgcgatggcactgcacgtggcgcagaaaagcgtaagtcacacaatagagagaacaaaacattggctaattaaattggaatttcaaccccctgcctccaatttgtgaggattcaaaaaattcctggatttacaaatatttatgaattattaattaattaaaagtgcccccaaaaaacttgaaaaaatgttcagcgccaggattacccgaccatccaaattgtggtgactaatggctccgttctttcctctgctgctgcagccgccgaaaatggctttgttgcaccgccgcaggggaacggcgttgtggggaacagtgccggcacagaaatggccaatggacacgcgacaacggcacaaaatggacagcagcaacagaatggggggcagcaggacgaaccgcaggatcagcccattctcaagggaattgtgtga

SEQ ID NO: 65662 - DNA, 337 bp, Heterodera glycines
  Genomic contig location: Contig_ID=SeqID_997; Location=137..473; Strand=-
  SCN-specific regions: Sequence locations=1-337
atgccatttggattcgaagagaggcttttcctattcccagtgaacttcgcgattacatcgttaatgctctggtcgaaatgggcgttgaagtggccaaacactcgttcagactgactccatcatcctttttggcaatttcgaattcgcttatttcagtttagtaatcacaataatcgaaggtttaagaataactcttccgtggataaagtgaatgtctatggaattgtccgttcctttcgtgccaacccggccgagtccattcttctcgctgttccaatgcgttcttctaagattgaagcggttgctgttgccttagcttttgctgattatgctaaaa

SEQ ID NO: 65663 - DNA, 840 bp, Heterodera glycines
  misc_feature (514)..(514): n is a, c, g, or t
  Genomic contig location: Contig_ID=SeqID_998; Location=3590..4429; Strand=+
  SCN-specific regions: Sequence locations=1-83,105-556,578-670,705-840
atgccggaggaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgaaccgatcgacgctcagcgaccactgctgtatatggaggtagaagagcaatggcgagtcaacaaagcattcgttttttcatttttccaggcccacgtgttgctcagcctgaacgaacttcgatcaaacagtggacgccatttttgccgttgtctggaccttggacgcgatgaacaaccggatgccgattctggacagacgatggagttcaactacgttgtgtgagtgacaacgcgaaatcgagaattaataacattcccttattttcaagcatgtcgttggttggccgtccaatggacaaactccttcacgaatccggtgaccgcttcagccccggaactgcgatcggcacttcaattcaacttctcanagcgcttaaggcgttgcacagcgttggatacctccatcgtgacattaaccagcaaactcggccatcggcacgcctgagacgaacgaacagcgccttctctacctcctcgactttggaatggcgcgcaaatatgtcagagaggacgtgagctgctcttctttttaattaaaaacatggcaaaaacagtttctgttttcagggcacacaccggcgccaaagggacaccgcccgcttcagagggacgccaatctacgcaccaatctctgcgcacatcaaacgcgactacagccgccgggatgacattgagtcgtggttctacatgctga

SEQ ID NO: 65664 - DNA, 1383 bp, Heterodera glycines
  Genomic contig location: Contig_ID=SeqID_998; Location=1416..2798; Strand=-
  SCN-specific regions: Sequence locations=1-272,295-413,436-1096,1122 -1166,1189-1199,1221-1383
  Gene Ontology: Cellular component=integral to plasma membrane; Biological process=nonselective vesicle transport
atgacaaaaccgcaacaggttcttgttcttgatccgaataacgaactcagcttcaagggttggtttacactgctttgcttaattacctattctctacgctattgccgtctaaggaccgtttactgagtatgtgaatgccaatctcacactgtcaaatccctcgcgaaaggacgtttatttcaaggtgaaaacgactgcacctaagttttattgtgtccgtcctaactctggtgttatcaaggtgaataagcatacccaaagttttgtggcaattaaatggacagaaattaaggcgaatgataaaacccaaatcaacgttatgctgcagccggttgaatcgcctgagactctcgagagtgagcggagccggcacaaatttatgattcaggtactttcgccacctctgcacaaacaaaaaaaaaaaatttttttttagactgcatttgcgcctgatgacgagcagcttcctgtggaccaattctggaaaactgttgacccaacattagtcatggattcaaagctccgagtggtgttccagcgaccttttggatttggcgatgaaaacaatcgggacgaaaccaatgcgactggtccgtttttcaatttcaacaaaacgggcgaaccgaaaaacgaacagccaacgcaaactccaaaatcgaccgtaatactttgcactttgtctttgagttaatttttcccatttgaggaagcaaattctggcgatattcaacttgctttgcaaagggaagttgaacttcggatgatgtatcaggacgagaaaaaaaacctcgaaaaggagaattacgcactcatcgtaatccgaatgcctttttctgaaccattcgtcattttctgtttcaggataagctcgaaaaattgactcacaatgctgctgcgggaggcgttcttcagcaggacaatgtgcaattgcttcatgtaaattccattaatttcaaaatattaccataaatcagtgaccggggcggggtgtcgcctaacgaaatcgccctattttgggaattgggaggggaggacctttaccgctccgttaatttatgctatgagaatagtaattgtaaaaaatgccttcagtgcgccctttgttgacattttttaaaattttgaggtgtaggcacaaaaccgaaaagtacctaaaaactagcaaaaaattgttaatttttgtgagtaaaacctggttaaaaaacttttcttcaacaaaaattggaaatttcgcccgaagcttttttaatgctaaatgcacaaaaaggttttgggcctaggtctgcacaacatttttggttatgaaatttgcatccattttaggctattttgtttgccgttctcgctcttatggttggactcatcgtgggcaaattgatgtga

SEQ ID NO: 65665 - DNA, 2826 bp, Heterodera glycines
  Genomic contig location: Contig_ID=SeqID_999; Location=6345..9170; Strand=-
  SCN-specific regions: Sequence locations=1-489,511-569,591-922,944 -1060,1082-1610,1636-1704,1726-1779,1801-1838,1860-2005,2027 -2077,2099-2797,2819-2826
atgaggaagaaaagaagtggagttcacacgccgaacagcatctgtgaaaaagagcagaaaaagcctaaaattggaaatgaatctgctgaagtgtgccatttccaagcggagaaatttgttggagaatattgcactgtccacacgcggccatctctcacagtgaaggcactctccttcaatagctcaattggccgtttgtgtgtaatccgtcaaaatgaatcgactgtcaggttcgtcagtttaaagtttttccttctcaactgaaaattcagccagcagttcccggctcaattgtcccttgttgaattttacaatgcagacaatttgccattgattttcctggaaaaaagcattccggtcaatgaccgatttgaaacgcttgtttgggtggacaattgggcggtgtttggagggttgggaggccgtctgaccgcactgtcaccattcaccagcaaatttggtgtgagtgggttttttaaaagttgggtcgattttttcggatctgttaagcgtgttcaactgtgcgtttctgatattcttgtgatgactcgtgccggagaaaaccatcagtttgttgctgggaacacttctggtgaattgctcgttgtaaacaaccgcgacttcgacgaggagggaaagtgcaccaacaaagtccccactttttcaactgtccaaaccattaaattgtccaccgatgagcacattaccgccattggatgttctaacaataagaccctaacaccgcaaatgatggcagttgggaaggtcaatggactttccttatttttatatgaatcggaatggaagaagcacaaagaaatcgacattcctcggacgaaagagagtgcgaacgttgtgtggtcacttatttttgtgtgagttgcgctttcaaaacgacaatttttaaatgcgtttctttctctcagggaaacttttcttttcacgggcgattcgcgtggccaattgagtatttacgacgcattgaatggaacacttttgaaagtcgatttttggtgtatttttcgacactgatttgtttttagacactaaaaacgcaccaagcggcagttctcaccattgccacgaacggtaaagaggtttttgctgcgggggcagattatcggatacaaatcgtaaaaagaatatcgcatgacaatgtacagtcgatttatgacgtttttatttaaattgacttttgttaggtccgtttcgagtggcaacaaagtggccagcgccttttccatgccaacgacgtgagggctatttgtgtgttggacaaacgattgcttgtttctggagggtccgactctgagcttttcatttctgataaattcactcatgcgaacccccagataaaagtaagcactttaaatgattcggttatctgttcccctgctttatcttcagtcagaatgcgctttcttcgtctcaaagtccaattgctatgtgattgtgagccaccatttgtctcatcttgacttatggtataaaacaatcggaggatctcttatggaccaaaggttcgattaataaaaccaagacaattataaaacgaaaattagcgaatgaacttaaatgcacttttaatggttaaagcttaacttttgtcctaattttcattcaattttagaaagcgtttgaaactatttcttcgaattaccagtggcaaattagggtttatcaaacaagtaagctttcgaatgaaatttgccttgggtcattgctcctcttgagtttcagttttgtgtctcttccgatgggaaattccttgcctttgctggtgctgttgcaggtgctatccgtgttttccgacttcactgtgaccaaattactactttccttgcgacatgtgcccccgaacatatagaggacgcacaatcaagcaaattgatcaaactaatttggagcaatgataagggcgatgaagaaaatggcagcaaacgaacaggacacacgggggggaggacagtgtcaggtcgaagcggcaaaatgaaaacgcaacagcgaatttaaaatttagcaattcattgcacgaacaaatttttgtattttgcacgcggagaatttaatttggttcgtttggatttacaaaacaaaaggcttcgtacttttgcatcaaaaggttgtgaatgtttgtttttgagctggttacacccaatcccttttcaagtgaatggtggtcatgtcaccaaaatatgcgtcgattcagctgacactcgacttgtggctttaacagtcgcgggaactttttgtttcgacctgaccaaattaacgcatgaaaatggtcaaatgggagaggacggattaatttcattggaattgccacagaaagcgcatccgtatgactgtgtcttttacgacaagtgcaaaatcgtcattattatggctgacttgaataagcacgtcataatctatgatttaaattcaaattcgattttgtttactattggcaatgccgagttgggtttggtttcaaatgaatgggtcgcttatttgcatgtgaatatgagggggactgtcgttgcaacaacaaacaaagcgcggttgagacttttgagcatagaagaggtaagaaagaatgaagaacatgtgtctaaaccaatccattttaagagcaaaatacgtctatttgttgatgaatctgcagaatccaatgagcatgaaatcgctaagagcagtgattcccgaattgaacctttttggctcgaggaccgatccgatctatcgacaaattgtttaaactccagatttgttcttgtaaagcatgtggaagagaatgtttcgacgagaatcccctgtcatctaagattttttgggaaaaactga

SEQ ID NO: 65666 - DNA, 1240 bp, Heterodera glycines
  Genomic contig location: Contig_ID=SeqID_7699; Location=60..1299; Strand=+
  SCN-specific regions: Sequence locations=1-118,142-218,240-389,413 -643,666-1176,1199-1240
atgccattgcatgggaacttcaaagatattgtggcagaagtgaaatttacaaatcgcattgaaatggtgtggatttgcagcaacacgaaaaaaaagatgttggcttacaggtatttgttattaaaacccaaaaaatatttcccaaagccaagactttgttttctttttcaacggatatttagtatttaatgcttgagcagcttattcgaaattttaccattctttttaaatttttggaccccaaaccgggattcaaacattaagtccaaacctcaaattttcgaatttagcactttttgaattttacttttgttcgaattcgggtacagagatacgaaattggtcgaaatggattgtcatattcgtgatcaacgatccaaaaaccgtcctaaagtaaatatttttaaaagtacataatttaagcacatttattagcattaaaaagtggattgtatctgatgcctaaactacaaaagtatctatttttatgactgcctattttttttttttttttgttctctccgacgacatttattaacagcatttgtatgaaaaataaacgagggttactattttgagtcaattttttttagaagatgaaggggtttttgtccgccggcgttgccattagggctacccggggattttttatttttatttttaatgaatttgctaacaataaaaagtataatacatttttggaaagccttttttccttcgcacttaccttcctgtcgtcctatgcaattcttcgaaaatgttcctgcatatttttgttactactgttttcgtatttatttgctaaccaataatacaattttcagttacgaagttccattccaaaatgcatccaagctgatcatggacaaactcatgcggtggtaccacagcgaaaaccccgacaaacagttttcgcttgttccgcttccatttgaaaatgttggacggatgagagaagcgctgaacaaagagttggatgcgaactacgacggttgtcgggatttcgtaggtataaatattatcgttgtgctctttaattgaattatttataaatttgctaattgttatacccttttattagcaaaagggggtaaaatttgttaacctttttagcaattgcaatattttaaatgggtgcacaaaaaatcgctgaaaatttcttgagacatttttttcttaaaattttctttaaaaaactctaagatttaaaatttgctaattgtaagttttgaaacagcta

SEQ ID NO: 65667 - DNA, 432 bp, Heterodera glycines
  Genomic contig location: Contig_ID=SeqID_7699; Location=2376..2807; Strand=+
  SCN-specific regions: Sequence locations=1-142,169-432
atggaactcattaaccaattctggcgcgatgatagcgaaaagcagtttgaagactaccaaattcccgaatctccgccctattggtccagcggtttcctgtcgattcagtacgcaattgacaaggcgttcatcgaattggtccgttttaatatatatatttttgaaaatggacttattgttagtttgtcgtttttcacagtgtgcccaattaaaaaaatatatagagatttcacttttttacgtgcttttaaggccaaaggtgacgatgctttggcaaatgtttcgctccgtctccaccgtttgcccattccgtcgtacatgaacaagcaaatggccaccataacggtgcccctttttctgaccatgcttttgtttgtgttcgccttttccatgctgaaggacattgcggtggaaagggagtccggcatcatg

SEQ ID NO: 65668 - DNA, 616 bp, Heterodera glycines
  misc_feature (591)..(591): n is a, c, g, or t
  Genomic contig location: Contig_ID=SeqID_36322; Location=11..626; Strand=-
  SCN-specific regions: Sequence locations=1-78,143-163,209-221,251 -288,310-320,539-616
atgattaatagaagaggcttaaatgaatatatggagtgttataaaaggaatatattcacgtaataaggagctattggctaaattaaattaataataagaaaagttcaattttttaaaattgaaaaaatgataataaaaatttgtaaatgctttggcaaaacagtaaaatatataaaaaagatttaaatttaaaaaatttttaattaaaggcatcactacagatttaaagaaaatttaattaaattaatatcagtaattctgcttcaagggatggtaaaagcatatgacaatttaattaaatttaaccataatcaaagaacaaatttaataaaaatatcaatttaaaaatgaaaaatacaatttttgaaagaaataaaaatgtattttttaagaatataaattaacaaatcatattaaaaataatataaatgaaaaaattgtattaattattaaaaataaataaaaatgaaacagtggatgaaatagtggaaggagataagaaaataaaaatgctaataataaataaataaaaatcaaagaatgtcgatacagaaaagaatgtgcatgcaatgatatttaccagattctctnggactcaacatgaaaatttaataaa

SEQ ID NO: 65669 - DNA, 740 bp, Heterodera glycines
  Genomic contig location: Contig_ID=SeqID_36324; Location=45..784; Strand=-
  SCN-specific regions: Sequence locations=1-740
ttgtacctcttctaatcactgttgtacctcttctaatcgctgttgtacctcttctaatcactgttgaacctcttctaatcgctgttgaacctcttctaatcgctgttgtacctcttctaatcactgttgaacctcttttaatcactcttctaatcactgttgtacctcttctaatcactgttgtacctcttctaatcgctgttgtacctcttctaatcactgttgaacctcttctaatcactcttctaatcactgttgtacctcttctaatcactgttgtacctcttctaatcgctgttgtacctcttctaatcactgttgtacctcttctaatcgctgttgaacctcttctaatcactgttgtacctcttctaatcgctgttgaacctcttctaatcgctgttgtacctcttctaatcactgttgaacctcttttaatcactcttctaatcactgttgtacctcttctaatcacagttgtacctcttctaatcgctgttgtacctcttctaatcactgttgtacctcttctaatcgctgttgtacctcttctaatcactgttgtacctcttctaatcgctgttgaacctcttctaatcgctgttgtacctcttctaatcactgttgtacctcttttaatcactgttgtacctcttctaatcactgttgtatctcttctaatcacagttgtatctcttctaatcactgttgtacctctgctaatcactgttgtatctctt

SEQ ID NO: 65670 - DNA, 1124 bp, Heterodera glycines
  misc_feature (710)..(710): n is a, c, g, or t
  Genomic contig location: Contig_ID=SeqID_36327; Location=491..1614; Strand=+
  SCN-specific regions: Sequence locations=1-432,454-655,678-793,821 -1124
atggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaaccaccaaaatatggatttatatggactaaaaaccttcaccaaatcaaaaaattttaacgcagaaatgctatttttaagcccctttcttcatagcatatgcgcagaaaaaatatgttaatccatataatttacaaccctaattattaatgaagacaaaaccgattttaaataatctttttgttcctgccacagccgagaattattaataaaaaaatttttgtttgcatgacacaagaaggcatacacaacccnatgcatgtgcaatgggaaacaatttatatcaattcataagtaaatcatctaaaaaaattctaaatgaaaaagacaaaaagttcatttattttaaatatattttaataatacagaaaaactgaaatgttctaatatcaatttataatatccatcaattaccagaaaaagaatttcagaatgggtgttaaaagtccgaatggacaagtgtcttttttcaaaaatgaaatcaaatatttgggtgtgatcattgatcaaagtggacgtcgaccggatccaacaaaatcacagccattgctgaaatgcgcattccttcaaatgtcagcgaattgcgctcatatttgggcatggtcaattattaccaggaatttgtacgaaatttccgattcattcgacagcccatggatgaactgctaa

SEQ ID NO: 65671 - DNA, 247 bp, Heterodera glycines
  misc_feature (119)..(119): n is a, c, g, or t
  misc_feature (165)..(165): n is a, c, g, or t
  Genomic contig location: Contig_ID=SeqID_36331; Location=422..668; Strand=-
  SCN-specific regions: Sequence locations=1-58,81-81,104-169,203-218
atgctcagcaatggaccaatgtgccgctacgcctctgacttgccgttggcacttgcggtaaatttcaaaggaaaaaatgacaaaaaaaaataaaaataaatttctccaatcaaattttntaattagcagaaaaacaattagggctctaatattagccaaaatgtntaagttttatataaaaatttttttaaatttaaatattggtgtaaaaccttttgtattttttttgttatttaatttaaataaa

SEQ ID NO: 65672 - DNA, 646 bp, Heterodera glycines
  Genomic contig location: Contig_ID=SeqID_7701; Location=1475..2120; Strand=-
  SCN-specific regions: Sequence locations=1-222,244-383,422-646
atgaatacacaaattctctgcacgccgctctcagaggactccacacagtcggctacctccactgcaacatcaagtcgagcaactcgaccatcggacgtccggaatcaaacgaacatcagggacgacgtgagtttgaatgaagcgctttgaaaaaaacaaaaataattttgttccctttcctttttcagggccagcaacaccgcccgcgcacttcgtttttccaaaattaaaaactaacaaattaaattttgcatgacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagggggaggagacagctacttcaactgatgagccgtgcagcagcagcagcagcagaagaatcgccaagaagcgtcaccgtgcagaattgatcatatgaccactattactgtattgtatgtattattttgtgtccatgctgccatccccgatatacacatgtattgtattgttgacatatgtattgattgaaattgttgttgcataactgtgtttgtacatatggcttttgacgaaataaa

SEQ ID NO: 65673 - DNA, 647 bp, Heterodera glycines
  Genomic contig location: Contig_ID=SeqID_36333; Location=195..841; Strand=+
  SCN-specific regions: Sequence locations=1-1,43-134,183-554,577 -577,599-625
atggacactcgagaagttgagggaagactttttgaaattaaattgatcagagagggcaaaatgggcgaagtgatcagagaaacccaagcggatgtggcaattgtttttgacaaaggcttggaaaagtgaggggcaatttaatttaaaacataaatttaaatttaaaactaaactttaaatttgaaggatgggcaaagaagcgggagggcataatgccaagcagcaaatctttcggaaaatgaacccgctacagattaagttcactgacacaaaagttggccatcgcacgaaatttctgcttttctttttgcgtctgtacagaaaaatgatcggacaaattggggcaccataccaaggcagtgccgaactgtacgcggttacggtaggcaccgcggggccaaaaatggacataaaattagggagaagcaaaacgaaattagcttatttaaaacaaattaaggaaaaagtgaaacggacggaccgcgaagctttgctaattttgatgagcatggcaaaagacgaaatcatggcctattttgggggatatttgaacattaatgcatttaagcaacacaaattggtaaataaaattttaatgctaggaaattcagaaaaatattttcctaattaaaaatttcattttttaa

SEQ ID NO: 65674 - DNA, 197 bp, Heterodera glycines
  Genomic contig location: Contig_ID=SeqID_36340; Location=1..197; Strand=+
  SCN-specific regions: Sequence locations=1-2,25-59,82-86,117-197
tttctttttgattattttaattgtatttcatccctgaactttttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccatacca

SEQ ID NO: 65675 - DNA, 1213 bp, Heterodera glycines
  Genomic contig location: Contig_ID=SeqID_7702; Location=620..1832; Strand=+
  SCN-specific regions: Sequence locations=1-540,562-662,706-1074,1096 -1103,1141-1213
atggcctgcgacgtggccagcaaaaacgcaaagctccttagtggaagagtcttgcagaaaagtaatgggccgccaaaaacattatgtgacaatgtcttgtcatccgttccgattccgacggtcagtgcggttttaatcaaagaaagatttttatgagaccctcactcatcctgttggattgcaaattatccattaacaattttaatggttttgcgttgagttcacataggaataaaattttcggtcctaattatttagtggaaatgagcttgaataataacgcatttttgacatttaatcaatttctcaggaggtatggaatcaactcgtcgacgtcactttggactttggcataggttctgccgttaaacgcgtaaaacgacgcaaggaaaaggaggcaaataaattggcgcttaaaaacattaataaataaactgcccacatttgaaagatttattaattatttgatgaaatgtctttaggcccgggacgcccgctaaatgggatttttttgaccgggtagctcgagcctggttaatactcctaacaataaacccggggccggcattttcaaaattccggtctctagttgattaattattcagtgcaataaggaattaaccaaattaataatatcataaaagaatttgcacttattttgcattattatttattttatttttttaaatattttttgaattatttggtttttgtcgaacacataaattatttgtgggttaatcctaacaaaaagagatagaatttatttggcattatttttatttgctcaaaatttcagaaacttgttgacccgttggcctatgtcggaatgctcgcaaaacgcgcgcttggtagtgccttgaaaataagcgaaaccccaacaaagtgcggtggcagaccaagcgatggtctcttctgttcatcattttgggaagatttcttttcttcggttaagacggtcagtgcttttgttggttttacaaagcaataaatcgcatttttaaagtaatgctggtcgagacccaaaatttcctgagactcgagactgagatcagcagaaaaacatgactttaaaaaagtttaaattgtacacttgaaacccgattaaaacttaattaatttaaataattcttttttattgaaatttcaaacaaattttgccgttgcgaattttggttcaattacaatttatcaatcaatcgttattttaaaa

SEQ ID NO: 65676 - DNA, 53 bp, Heterodera glycines
  Genomic contig location: Contig_ID=SeqID_7702; Location=2654..2706; Strand=+
  SCN-specific regions: Sequence locations=1-53
atgctaaaaaatcagctggcggcaattcccccaaagaaggaacatttccaaat

SEQ ID NO: 65677 - DNA, 747 bp, Heterodera glycines
  Genomic contig location: Contig_ID=SeqID_7703; Location=2074..2820; Strand=+
  SCN-specific regions: Sequence locations=1-747
  Gene Ontology: Mol. function=protein binding
cgaagttactcaaatcggctaatggcaacaccgaatcggcatcggctaacggcaacaccgaatcggcatcggctaacggcaacaccgaatcggcatcggctaacggcaacaccgaatcggcatcggctaacggcaacaccgaatcggcatcggctaacggcaacaccgaatcggcatcggctaatggtaacaccgggtcggcatcggctaacggcaacaccgggtcggcatcggctaacggcaacaccgagtcggcatcggctaacggcaacaccgagtcggcatcggctaacggcaacaccgagtcggcatcggctaacggcaacaccgagtcggcatcggctaacggcaacaccgagtcggcatcggctaacggcaaaaccgggtcggcatcggctaatggcaacaccgagtcggcatcggctaacggtaacaccgagtcggcatcggctaacggcaaaaccgagtcggcatcggctaacggcaacaccgagtcggcatcagctaacggtaacaccgagtcggcatcggctaacggcaaaaccgagtcggcatcggctaacggcaacaccgagtcggcatcggctaacggcaacaccgagtcggcatcggctaacggcaacaccgagtcggcatcggctagcggcaacaccgagtcggcatcagctaacggtaacaccgagtcggcatcggctaacggcaaaaccgagtcggcatcggctaacggcacaccgagtcggcatcggc

SEQ ID NO: 65678 - DNA, 506 bp, Heterodera glycines
  Genomic contig location: Contig_ID=SeqID_7703; Location=1493..1998; Strand=+
  SCN-specific regions: Sequence locations=1-94,117-152,174-506
atgtgccaaaaaagggatgggggagaacatagtaaaatgaaagtgaatcgtcttaataaagaaaaaattattaaaatttcagaaaaaacctgaagacgcacattttcttcttcttccaccttctgattttggcgtcggcaaacatgacaatgaaagtgcaaagaaaaataagatggacaaagaaaggatggataacagggccaagacatttgccaaagaacagaagccgaaaaatacaaaaaaacgtgccaatgaatgggacgcggaaaaagcaaacaaagctaccaacaagctaatgaggaaaatggcagaggaaaaaacaaaaatggcaaatgcaatgctttaccctacgaaaggcaagaaggatgccatgtacaggtgaagagcggggggggagggggggaagcaaattgcaacatttggccatgaatttgtccggaatttcggattgcaaataatttgattcaaaatggcttactctatggtcaaatgaaaatttttcgaaa

SEQ ID NO: 65679 - DNA, 172 bp, Heterodera glycines
  Genomic contig location: Contig_ID=SeqID_7704; Location=77..248; Strand=-
  SCN-specific regions: Sequence locations=1-94,116-172
cagcacaccatggaattggagcgaatcatcagcaaatcgggcaaagtgtatgagcaattagatgctgcatttagtcgtaacaatatgccaagaaaaagtattaaacagcaccaagagagttgtaaacatggcctgtcaccggtgtttgaaaaatttgaaactggcacatcgc

SEQ ID NO: 65680 - DNA, 688 bp, Heterodera glycines
  Genomic contig location: Contig_ID=SeqID_36343; Location=59..746; Strand=-
  SCN-specific regions: Sequence locations=1-56,86-235,257-389,412-688
atgttttttattggaattgacagaatgattggaattatatttggcgaaatgtaaggaatatattcaaaaaatatatattttaattccactgttttaaggcatagcaaatgcaaaatccgactgtatttggctacgataacaattatttgctgcacttttagtttaggttcatgtctgacattttatcagaatattgaattgaatggtgatcaaatgatcactggcacttatgccgattttttcatggtaaataaattcttggtcacaaatcaacaaaaaagaatattttagggttcttctcaatacagtttaatatgtctctttctcatcgtaattaccatattcatttatttatttgtcggactcattataagaattaaatcggcaggtaataatttttaaaataataatggtgaattagctattttatttaatgtttaggtttgccttccgctgatcagattaattatcgtacgtttcgatcactttgttgcatcatcgcagtgaatattggaggctattttatctgtttgttttttctcactctcatcaagcccttaattccatcaccgatcactgcttggtttgcccactttttgacctcaatcccaatgaacattggtgcggcatcaaatgcacccattttgtacgtcacaaggtattagaataattacttaaattaattaaa

SEQ ID NO: 65681 - DNA, 471 bp, Heterodera glycines
  Genomic contig location: Contig_ID=SeqID_36343; Location=785..1255; Strand=-
  SCN-specific regions: Sequence locations=1-36,79-96,118-471
atgaatgacaactcaacgaacaacaacacggtagtcattaattgaaatatttaaaaattacttttttaaaatttttttgcagttttatttggccttcaaagatgtccatcccagctggtcattaattggatgcgcactgatttttggaatcattgcggtaattggcatcattttcaattcttctgtcattggtgtaacctttttaacaaagtgcgtgaaattaatatcgataaaatcttggaaaagcattattaattatttttaattgaaccttaattaaggtcattccgtggcaccgttaattaccttttggcactttgttccttttttgaaatgctccatcagtttggccattttttatttgtttatacagcattttcgggacaaaatttcattgagtatcgtttggcggcaaagattttaatgattcctttgtttgggttaggtaatttactcaaactaataattaaa

SEQ ID NO: 65682 - DNA, 697 bp, Heterodera glycines
  misc_feature (301)..(301): n is a, c, g, or t
  Genomic contig location: Contig_ID=SeqID_36344; Location=315..1011; Strand=-
  SCN-specific regions: Sequence locations=1-61,90-697
  Gene Ontology: Mol. function=choline-phosphate cytidylyltransferase activity; Cellular component=cytoplasm; Biological process =phosphatidylcholine biosynthesis
tgaatggagacgaggacaccaagaagtacaaagggaagacagtgaccaacgagacggtgagctgttcatttatttccaaaaggaattttatttttttaaatgtattttctgacaggaacgctatgaaggagtacgccactgtcgttacgtcgacgaaattctcccaaattccccttggtatgtctcggtcgatttcctcaagcgctataaggtgagaaattcattttgaaataactgttaaaaatttgcaggttagcgggaggaagggaaacgtagtccattctcgccagggatggcaggngcccctcgtcccacgcactgactgacaattccccgtcgattttcagacattcgaatcattcaaaaaaaattggggattagttatttcattttctatttaggcttgatgttatttatgagttttggatggtaattgtcaaccatggaaatggtatcggaaaatttttagatcgatttcattgcacacgatgcacttccctactcggcaaaggacgaggaggacttgtacgagaaattccgtcgcgcggatatgtttgtggtcagtttaaaacgcggggattatgattgggttggaaaagaagatattataagatatgataatggattacctcaaaatttcgccatcgaaattttaaaaaaagaattgaataattctagctttttcgaaattttttaa

SEQ ID NO: 65683 - DNA, 228 bp, Heterodera glycines
  Genomic contig location: Contig_ID=SeqID_36345; Location=442..669; Strand=-
  SCN-specific regions: Sequence locations=1-228
atttatcaaaaaaagagatagccatttttctgggataacctctaaatataaaaatcctctgtgaaataaaatggcgattgtgcacagccctccgtctcatacgcaagcgcttttgtgaggtaataaatttcatcaaaaaaagagatagccatttttctgggatagagtataaatttaaaaattccctcaaaaataaaaggtctattgcgcaccgccctccctatcatg

SEQ ID NO: 65684 - DNA, 488 bp, Heterodera glycines
  Genomic contig location: Contig_ID=SeqID_36347; Location=101..588; Strand=+
  SCN-specific regions: Sequence locations=1-365,387-488
tggcagaaagtgctcaacgaggaagaagaagcggaagggacacagcccgggacagagccgacgaatcagtacatccaaacgacgtttatccaccgggacgcgaatagttggagagagaatcggacccacaaaaatgaacaaccaatgccaccacagatgatgaccgcgagttcgcgcagttcacccgccttatgttggcctacgttcggccccatctgttggcgcttgcccatgtgactgtggacaacgaaaacatcgactgctccgtggacgatggtcatccccgttgtggggaatatccaatggaaaagcctttccattttttggtggtcgaagactcgtaagttggcacaacatttgagtgacataattttttcattttaaaggcgttccggtgccgctgtgtatagcattgaacgcatgcggaattggcacgccggcggaagccgagcgcgcacaatggcacggattgaagctgcccttttgga

SEQ ID NO: 65685 - DNA, 198 bp, Heterodera glycines
  Genomic contig location: Contig_ID=SeqID_36348; Location=766..963; Strand=-
  SCN-specific regions: Sequence locations=1-60,83-87,118-198
ttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccatacca

SEQ ID NO: 65686 - DNA, 358 bp, Heterodera glycines
  Genomic contig location: Contig_ID=SeqID_7705; Location=1..358; Strand=+
  SCN-specific regions: Sequence locations=1-47,73-76,98-358
ggaattttttttgattttttttttcaaaaaattagcaatttttatacaattttctgttaataaattgccttgaaatttttaaaaatttcccggcggcgcctatcggcaccgccggacctaaaaatccttaattttcttgaaaatatgctagaaatcgctaaatttggccattttcgtggacaaatctgttaacaaatcgcattaaaaatcactaaaatttttccagcggcgcctatcggcaccaccggacccctccccctattacccaaattttctaattttctttggaaatgcgcgccgcaaaaaagggtgtaactgtcccaaaaaaaaaatcaaaaattgtataattacataaaaa

SEQ ID NO: 65687 - DNA, 471 bp, Heterodera glycines
  Genomic contig location: Contig_ID=SeqID_7706; Location=523..993; Strand=-
  SCN-specific regions: Sequence locations=1-204,226-471
atgggtgcacagaaaaagaagtatcgcgatgccgacgcacggattcttcgtctcgtccaacgctataacgatatcaataacaatattgccctcaaaatgatcacaattatgccaatgccaatgtcaatcccgaaaaccttaacaattttctcgctggtattttccgaaaaatgagatgcgacctagtttgtcccggattttgttattattataaagatgaattttctacaaaattttatgaatgggaaacgaaaaatgataaattttggttttattagttcttaagtttttctatttgaatctgacgcttgtacaagaactcgtaagaaaatgtcccccgtacgaaaacggcggtatgaaaacgaccctgaccgcttgcttggtaatgaaaaatttcttcagctctcattttaacaagcgttgtgtaccgctataactgtaaagaagtcatatttttagaatctgtattga

SEQ ID NO: 65688 - DNA, 520 bp, Heterodera glycines
  Genomic contig location: Contig_ID=SeqID_36352; Location=39..558; Strand=-
  SCN-specific regions: Sequence locations=1-200,241-335,364-520
atgactaccaccgatgagaaacagcttcaagtggttgttgctggcaatgagaagaaacaaaataagaaatcagaagtcgtggcagccaacgagaagaaacaaattaagaaatcggaagttgactttcccgtggtattgaagcgtggggtgcagggacgtggtctgtggtttttggcaatttgtgaagatcattggtcccgaaattttttaattaatttttttttctaaaaattttttaaacacttttataggggtgttttgaggcgctgagcacgaatccggacacaatttcggccaattccgtatccctaacctgaactcgaacatttttcgagaattaaattttaaatttttttaaaatttctcttaaaacattgttttgtgttttcggggtcgttaaccttagacaaaaaccgtttcaaaaccaaaaaatggtcaatctgtaaagatacgaacaaaaaatgaattttcgattttttgttcgagttcggatccggtattcgaaattggtcaaaataaa

SEQ ID NO: 65689 - DNA, 507 bp, Heterodera glycines
  misc_feature (42)..(42): n is a, c, g, or t
  Genomic contig location: Contig_ID=SeqID_36353; Location=775..1281; Strand=-
  SCN-specific regions: Sequence locations=1-259,282-426,457-507
atggctcaatttcccaaatcattgttccggtgttcgttttcncaagtgagcagaatttgtctcacttcgtcttgaaggtgtgacttaaacgtagattcctcatgattcgctccatgcatccgctgctgcctcattggtaacattttgtatctttagtgagctcttaaaaatgtcatgtacattgactcaaaaaagttactattgccacaattgcaatagccgcgccggaccccgaacccggattcgaacatttttcaagaaataaaatttttttattttatggaaaattgcagagcgtcaattacataatagtgaaaatgactttcaaagcgatgtcacggaccaggcgagtatttttgccaagttattgtgataaatatatggcaatcgcttagatcattggtcccattttaagaatttgggcccaaaacgtgcaaaaagagaaaatttattttttcggatacttcttaacacaccgtccgaaaaaacgagatgtgtaccaataaa

SEQ ID NO: 65690 - DNA, 76 bp, Heterodera glycines; identical to SEQ ID NO: 53815
  Genomic contig location: Contig_ID=SeqID_36353; Location=736..811; Strand=+
  SCN-specific regions: Sequence locations=1-76

SEQ ID NO: 65691 - DNA, 185 bp, Heterodera glycines
  Genomic contig location: Contig_ID=SeqID_36354; Location=202..386; Strand=-
  SCN-specific regions: Sequence locations=1-31,92-164
atgttgcaggcaccgacagcaccaatcgatgtaaattaaaattgaaaaaaatcaaaatgtaaatgtaaatttatatttttttttatttataggcctcaaaatttgttgcctatgtgcatgagagacgaaagaagaggatattgttcaaaggcgaatttttggtgaatttttatttatttttttaa

SEQ ID NO: 65692 - DNA, 703 bp, Heterodera glycines
  Genomic contig location: Contig_ID=SeqID_36355; Location=91..793; Strand=-
  SCN-specific regions: Sequence locations=1-206,239-403,430-537,575-703
atgtcgacgagcaaaaggggaacaattacccgtaccgtattcagggacaggtaaatcggacttaccctttttaaactaattattttcgttttcagctataaattgattccaatcaaattggcatcctttgtgaagacctttggcttatcgattgaaggagtggagaataaaaaatatttcccgcacgggttcaacaaggtttgagctaattttaaatattcaaataattattaatttaggcggaaaactacggaaatgtcttggacaatttgccgcccatcgaaagttaccaccctggaagcatgttgccggacgacagaaaggccctcgagagctggtatgcggaaaaccgtgagactcgctttgatctgcgagaggtcatcgccgactactgtaaaacaggtaaaataaataaataaataaaataatgatttcaacatttagacgttcaaattcttgcccatggactgattaagatgcgtgaactcttcacccaaaagacgggtgccgacattacggattcaatcacaatcccggtaatttttttgtattttatttaaataaatcaatatttcagtctgcttgtatgaggttcttcgtgacattggccatatgggaaatgaacgcattgctatcgttccccacttgggatacgagaagcgagggaagcaaagcaccattgcgcggaaatatctcaaggtaa

SEQ ID NO: 65693 - DNA, 531 bp, Heterodera glycines
  Genomic contig location: Contig_ID=SeqID_36358; Location=450..980; Strand=+
  SCN-specific regions: Sequence locations=1-350,372-465,487-531
atggacgaccgaagcgacgcattcattcggccgacagccgaggcacagaggcggaaaatcgccgcgccaatgccatcggcggtgatgggatgtcgccatgtgaacggacaattgaatttggccaattactgcgatgacttttggccattaaacggtcagcctaatcggattcgcactttcattagtcctcgtcccatcatcgattggcaattgccattctttcgaattaatttccattcattttttcagtgttccgatcgattgctttcgaagtgtccaatcgcaaggaaaagaaagggaagggacagctgtcctcggaagagtttttcactgatctgctgattttcacgcacttcccatgtttttgcccattcaccgcttaaaacaatgggcagcgatcaatgcgatgaactgatcacacccccgcgggttggcttggatcatccgcggcggaagacagatcaattccaactcattttttctttctctctgtttattcgttttatgtatgtttcttccttacaaattaaa

SEQ ID NO: 65694 - DNA, 88 bp, Heterodera glycines
  Genomic contig location: Contig_ID=SeqID_36358; Location=112..199; Strand=-
  SCN-specific regions: Sequence locations=1-88
atgacctcgtccccctctgctatagccccggcttttcatccgctgatccacccaccaccatcagaagcaggcagaaagatcacacaaa

SEQ ID NO: 65695 - DNA, 80 bp, Heterodera glycines
  Genomic contig location: Contig_ID=SeqID_36361; Location=606..685; Strand=-
  SCN-specific regions: Sequence locations=1-80
aagttctagttatggaccgcttatacagacgcgttatcgaatgttggtgactaatttgtcatcacgctgttcatggcagg

SEQ ID NO: 65696 - DNA, 3913 bp, Heterodera glycines
  Genomic contig location: Contig_ID=SeqID_7707; Location=266..4178; Strand=-
  SCN-specific regions: Sequence locations=1-502,524-1158,1180 -1368,1390-1431,1485-1668,1691-2549,2571-2724,2746-3453,3489 -3712,3734-3913
atgcagcaacccgtaccaatgagagccgtgccacaattcctccaccctccgccaaatgctccggtaatcttgagtctcgttttcggttgttttttcaaaatcccgagtgcattgtttttcaggaaattggtgtgggaccaattcatgatgggcaacaaccactaccactaagagcgttgccacaattcgcccaacctccaccaaatgtgccggtaattttggctcgtttttttgttgctttttttaattcccgaatgttttttcaggccgttcgtgtccaaccaattcaacaaccgataccattgagagacgtgccgctatttgtcaacccaccaccaaatgtgccggtaattttggctcgcttttgttactttttttcaagatcccgaatgcattttttcagataattcatgtccaaccgatgcctcaaccgttgccgttgagagacatgccgcaaattcaccattcaccgcgaaatgtgacttcaatttggatcaaattgtggttgctttttctcagtctctgggtgtttcttcagggaattcatgttcgacaaattcaacgggaatacgccgtaccgcaatttgctcatccgccgccaaacgtgccgtatcatccaccagaaaacgttccggtaatgttgggtcttgtttctcatatttccggatgtttttcagccagtgcaaccacggcaacgaccgcgccagctgagagacgtgccactattcgaccacccgctgccaaacggacaggtaatttcagaccctgtcttttacctaacaccgaaacatcttttcttaagcaaatgcatcccaaccccccgagagtgctggaagtgatccgacggctgggcgagtggagaggaagaccaagggacccaagacgtccgcctcaatgaatgaatggaatttggattttgataaaatttgttgttttaatttgttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatggattttttttcatgtgcattattttggtgttagtaagatattgccgaatgaattaattggttttttctcttcattttaaaacatttcacgtccccatgccctgcccacttcccgcggaactgatcaaggaaataattgacgctctcccccctccaaaaacacatcggcttttgcacgtaaattttgttttggcatactttgttaaatgtcggttttattccatgatgagaagattgtttcgcccagagcatatatcaataccaatggcccgaagaactggaatttatttctttttcgatgttcttactccccctatttattttccactctaccaataataacatttaaataaaattataattttttattttttatttgattaatttcgatcaatattttttgataattaaacaaattgtatttttcaaaaaagacctttctcgcagtagcaactcatcggcttttttttactcccttcataaaatgtctcgcttttgccccctcgcccaaatcaatgaatcgggtcggcttaacacaccaaaggggaaatttagtgagttccaaacctatcaaattaaaaaagaattttgatattcgttttaggtcttttttacgctttggaaattgctcgaacctaccaactcatagggaaaagtataacggaaaacaaattccgttatctgatgaagacggagaagaaacaaagggaaatggccatggaattgatggaaaaggcagggataagcacagatgacaaaacttttggtacccaacaccttgaggctgtacaaaaatactgggacagggaattcccggatatgtttcgcattgtggcttttgaaatggtaacaaaattcgcttgaaaaatataaagttacatatttttagaagaccgggcttaggccaattttcaagggagagggtgttcgtaaaaatgaagtgggtgtgataagagaaggagaccattgggatgggatcaaatcggcttcttggttttttggtgttcgatacttctgtgtcagctgtgaagtgacgtacgatcgacctgaaagacacagaatggagtgtaaggaacgctgcaaaaaatgttgtcggatggggttcgggtttccatgtacggatgtctgcgatgagattcactgcggtgaatgcaatcttaagttctacaacccggaatgttttgaagcacataagaaggcggcttgtaatgagtacaaaaagtgtgacaaatgcggagaagtttaccaaacacgttcgaaacacgtgtgcggggaaaaattttgcaaactgtgcaaagtttgccacccagggcggcaatgtttcatcaaaaaaattcaagtgcgaccgcagaaagcctacagaattgtggcctacgatctggagacgactgtagatgggggagaacaccggcctaatcttgttagtgctgcacgtacttgtaacatttgtgcgggagaagagcgggaatgtgagatttgtgaaggccccagtaaaatcacatggtcagtagcggatggttttgacccaatgagcgagtttgtcgtttggataatgggttttcaacgatttgaaacgattgcttttgctcattatgctgggagattcgattcccactttgtcttgtcagagctaacaaagaaggaaatcgcgacggaactgatgatggctgatttgaaaatttatcaaataaaggcgggaagagtgtactttcgggatttttggatgcttagtcagaataaattggcggaccttccaaaaaccttgggcttaaaaactgcagctaaattgtattttccacacaaatacaataagaatgagaattttgggaagagattatccaacctgccacctttggaagactattgcccggacaatatgaaggaggaagaagccgtaaaattggaagcatggcacaatgagaattttcaaaaggaatttgaactaggtagggaaaatagcattttttctttgaaaataaaatttaaggggaacaactcaagacgtattgcgaaaatgatgttgaaattttgatggaatcaattttgaagttccggcggttatttttggggataacaggagatttggatgtgatgaaggacagcgtgacaatcgctggtgttgtgatgaagatatatagggcaaaatttttgaaggacaggcatattccgatcatgcctgaggtagggtatgagagagcagagaaccagagcaaaatagcggtgaaatattttgagtggttagcccaaaaaaagggagtaaaagtgcggcatgcgtgtaacggaggagaagtggaatttggtggtctgaatgtggactgtgtgattggggcagagaaaaaaataattgagtttcaggtaaaagaaaaaatattttctttttaaacaatacttaaggggtgtgcatttcacgggtgtccgagatgttttttaccttggactatagcgccaaacggacggacaatggaagagaatcaaagtagaaccgaaattcgcatggaaattttgagggaaaagtgcaaaaatttttcaatcggagaagtttgggtagaataaaacatttagaaatatttttattttttggtttataggagtgtgacgtgaaagaggaattgaagaaaaataaggagatgaaaaagttctttgaaagtgtgccggacaagggaccgatcaatccgagggatgcttatgccgggggaagaacgatgccattttgtttgtacgcaaagactaccgaagaaattgagatatcaatgttcgacatcattagtttgtaccctttgttaattatggtaaaaatctgcttgcttttttgttag

SEQ ID NO: 65697 - DNA, 303 bp, Heterodera glycines
  Genomic contig location: Contig_ID=SeqID_36362; Location=680..982; Strand=+
  SCN-specific regions: Sequence locations=1-303
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaagtctattgcgcaccgccctccctatcatg

SEQ ID NO: 65698 - DNA, 383 bp, Heterodera glycines; identical to SEQ ID NO: 51114
  Genomic contig location: Contig_ID=SeqID_36364; Location=264..646; Strand=+
  SCN-specific regions: Sequence locations=1-20,42-275,297-383

SEQ ID NO: 65699 - DNA, 919 bp, Heterodera glycines
  Genomic contig location: Contig_ID=SeqID_36366; Location=366..1284; Strand=-
  SCN-specific regions: Sequence locations=1-20,47-85,114-155,178-919
atgcaaataggctacggtagagcaccagcagcagcagcagcagcaggtaattcacagcggaacaacaacaacaacaaagatgacagcggcggcggcggcggcggcggcagtggtaatgaccgccgaagcgaagcagaaaacaacgccagcaatccggaagctgatgatgatgatgaaaaaggcggcgctactgctgaccaattgtatgaagagaagcagcactatgtgcatcggctggagcgtttcgcactgcagcggcacgtcaccgagtttgtgctgaacggtcagcatgagaggccggacgaggctctccgcgacgcatttgagcgcatcatcaaacgagcaatacgcaatgcggagcagcagcagcagcagaacgaacagcagtctaggaatcaggaggaggagcagccacaagacggtggcggcgccgctcaacaaaacccaagacgacgagtgacaaagattggaatttttctggatggaaacggtactcattttttttttttggcaaatgtccccatcgaacatccatcatcatcatataggcctgactgaccctattgtgctaccgatacggccacctgagcagaacacagccgacactctgatgggtgaactggaaaagctgggacagtcggacggagacgaagacgtgcatggcggaggaatgagcaagcgatccctgttgctcagtgaaccggttcaaattgtcatcacctgcattgcaccgccggttggagcagctccgcgcttccaccattatcagcactggggttacaacgagaggcagttgatccgaatacggaatgtcggtgaccatttctgcctgttccacgcgttgattgccgcccgttcttacactgatcatgacttgacaaaaatgattgcaacacaacaacaatgccaacaaggggac

SEQ ID NO: 65700 - DNA, 141 bp, Heterodera glycines
  Genomic contig location: Contig_ID=SeqID_36370; Location=68..208; Strand=+
  SCN-specific regions: Sequence locations=1-141
atggcggacaccagcgccctgtacaacaccagcgacatcggcgaacgcaaatggctgctcgatttgctgatggaggagtcggacccggactcgggcggcgaggagcacatcacggagcaggacttgaaggaaattgtcaag

SEQ ID NO: 65701 - DNA, 1037 bp, Heterodera glycines
  Genomic contig location: Contig_ID=SeqID_7709; Location=707..1743; Strand=+
  SCN-specific regions: Sequence locations=1-279,301-451,475-705,727 -793,822-938,970-1037
  Gene Ontology: Mol. function=calcium ion binding
atggcatccaaaaaaccacaggaattgggcgtagcgatgcgttcgttgggccaaaatccgacggagcaagaaatactggaaatgatcaacgaagtggacattgacgggaacggacagatcgaattccccgagttctgcgtgatgatgaagcggatgatgaaggagacggactcggaagtgagaagccaaggggaggaggggaattaccaattaattagggggaacaaaacaaacaattagaggggaaattaagggacaaataggcgacaaataaggaccaattaggaggaggtaagtggaccaagaactaattaggtgagggactaattaagggaagcaaattgaccgccaattaattaataacaaataattaatgaaaacaaaaggaccacaatcatggattaatttattttgcatggacattgttcagatgatcagagaagcgtttcgagtgttcgacaaggacggcaacggagtgatcacagcgcaagagtttcgctattttatggtgcacatgggaatgcaattcagtgagcaggaagtggacgaaatggttggaatttgaacggaatttaaatttataactttggctttgcgttgaacagatccacgaagttgacgtggacggagacggagagatcaattacgaggaatttgtgaagatgatgagcgatcggtgaagaatgacaaaacagcagacccaagcggaggaaaaagaagaagaaacatatcgccaaaagcgccaacggtggaaaaacgaaaaatgaaacggacggaaagaaagcgccggtcgaaaaatttaaattttataaaaattttatcaaaatacatattactacctaattgattgatggtggtgttaagcatgaaaatttgaaagcaaattactaatttaaaggaaagaacatccgtttttcattgttacaattaaacaccacaattaattaattgatcaattaattaattaatgtttctcccatttttgtctgttttttcacattccatttaaatgaattatcaaaaaaataatttgataa

SEQ ID NO: 65702 - DNA, 2736 bp, Heterodera glycines
  Genomic contig location: Contig_ID=SeqID_7709; Location=1836..4571; Strand=-
  SCN-specific regions: Sequence locations=1-44,66-334,356-486,523 -646,674-1197,1221-1277,1300-1310,1482-1562,1584-1743,1766-1776,1799 -1799,1822-2300,2324-2348,2380-2489,2512-2736
atggtgaccattcggcgggacgtatcgatcttcgcaccctacactgctcacgagagatagttcatagtgattggggagagagaatacttaaattaattagggggtgggcaattagagtaattggaatgattggggagagaaaacattgaaattaattaggtggtaatcgagtaattagaatgattatgtcaaaactacttaattatttgaccatctgactgactggtcaattaatcatttacattcgcataactttttcacgttcagatcagtgttttctcctgccgaggcggtcagtgatcaatcactttttgagactcaaaaaaacgatcagaaaatatttatcctggaaattctgattgacaaatttagtgaagaatgagctgaaattgactgaagaggtgcgccgtccatttcgttgtcaaatttagcaaatattttaatgcttttaggacgtgcaaattgtcaatgaaaaaggcaataaggtaattaattaattaccgagtaattaattaattgattgtgcggcagtgattaattaacctttgcaatcattcaaaggtttatttcataagagcacctggcaattactcaattagcttcaaacgtatcaatgtgctcaacaatttggtgggtgatgtcaaagtttcaaatttattgaaaattaaaaatggccataaaataggcccatctgagcggagagttgggcatcactttgcaagtgccaatcctcgaagggcccgccggtcagtcaatttctgttttggcattccccttcgaaattggcatttttcccccaaaaggcattcggtttgatgttccgtacacaatggttccggaaacgggtcttttgaaccagcaatgtgacgaattcagtggcattgtggagcgcgacaaacggcagtattggtcagtgaaaatgccaatgccaatggaacgggggaaaatccaaaaattgccattttttataattgaaaatgaaaagactctcatttgtcagttccactttcttccattaagccgttactgcgacttgtgcggactgactgatcaaattgagaatcgattaacccgcactgattcggacggtcaccgatttttgccggctttggcggcgggcgaagaggcgccattctcaccgcggtgcgaaaagatcgacgcacgcacttacgaatttcgtcggacaataaatttaccgggaaggcgcgagttggaacaaaaagcacggcagaaaatcagcggagtggacgcagaaattcggaagagactgaacaaaggggtgagaatagagagggagtgttgattgagaggagggtggcagagaaagagagcgacgagggaggcatgggaagaagatgatgagagagaaagagagtgacgagggaagcaggggaagaagagggtggaagagaaagagagcgactagggatgcttggggaagagaggacgaaggaagagaaagaggggaacgagagagagagaacaggaaacttgcccaggggtgaatatcaaattgtgaccaatacgattattggccccgaaaatttgtttagcgaggccgtttccaagtgtttctgaatctgatcagtgctgatcagccgccgatcactcaaaaggcgtggttcgacggctccgaacaatgccgctgctgcggccgcgacaagtgagataatctaagctaggatgactgatcagtgaatgactgccgataatcaatcgaccctaccgatcacccctagggacccaaagtgccacaaattgccattctcccctaaattgccattctctcccccaaggatccaaagtgccacaaattgccattctctcccccaggaaccaaaatgccacaaattgtcattctcccctaaattgccattctctcccccagggacccaaaatgccacaaattgtcattctcccccaaattgccattctctcccccagggacccaaattgccattctctcccccagggacccaaattgccattctctcctccagggacccaaattgtcattctctcccccagggacccaaattgccattctctcccccagggacccaaattgccgttctgtgctttctttcctctactgcaatgtcgaagactgcaaatcagcttatgcgcagcagtgccttcacaattcggcaagaatagttgcctgttatacggtggaattcaactacagaatgaccacgcggagggacgaagtccaaatgtttctacggtaaattaaacttcggcgttttgctaatgccccgcctctttcagtgaaaacaattaccctgatcaggatgccccgggcactgcgccaccctcgccagcgacaattagcgctaatgagtgcgataattaaaaatgaataaatattttttaattgctttcattagcgcgtcttcgagccaacgaagcgcggcaccgccgcggttaaatgtaatcggagacgaacaaagggcacgccagccgaaggagctgagcacgctctgtgtaattaagtttaaaagattaattatttttttcagtcccattttaccgtatgctctttccttctccaaaccgtatactcttttctttttgcttttattaccgtatccaatgtcccttctttcatttcatcctcataccgtacccctttttcaggtctctcaaatggaaactcggcttacgcatttgcgccgttactgtacaattttttggaatgaaaagttgtgctgttcgcactgtcccggcatttgt

SEQ ID NO: 65703 - DNA, 682 bp, Heterodera glycines
  Genomic contig location: Contig_ID=SeqID_36373; Location=100..781; Strand=+
  SCN-specific regions: Sequence locations=1-372,394-397,479-682
atggccgcgccaaaatggccgcgccaaaatggccgcgccaaaatggacgcgccaaaatggacgcgccaaaatggacgcgccaaaatggccgcgccaaaaaagctcgcgccaaaaaagctcgcgccaaaaaagctcgcgccaaagtgggcggattgcgaaataagtaccaaaaagtcacgtgacgattgcgaaatcaatagggatattacgaaaaagagaaccaattaatcagttttgattgacaggtgacctaattttgggaccatattgcgaaatatttggaccaaaaaaaagtcacttgaagattgcgaaatgaacagggaaattgtgaaataaggaaccaatcaatcatttttggtgataggtttgcaaaattttttgagagttttttccgtcctattttatttattcattttcaattttatttttaaattgaatttaaataattaatttattgtcaattcattaatttatttatcgtgctgccattataaattaaatttgcacttacaattccattatcgattaatttgcgctgcggcggcatcgcggcgcggggcggggagggagggcggggagggggaggggatgataaaaacgcacggttttatcaaattttcgaaataagttttaatttcaggatcagaaaaacatcattaaaaaaatctaatgatttgagaaa

SEQ ID NO: 65704 - DNA, 639 bp, Heterodera glycines
  misc_feature (615)..(616): n is a, c, g, or t
  Genomic contig location: Contig_ID=SeqID_36380; Location=269..907; Strand=+
  SCN-specific regions: Sequence locations=1-54,92-206,228-639
atgagttcgaatgccaatgaacagagcgatggtttgtcgttgtgtcctttttacattttaatttaattaaaaatttttaaattaaataattgtccaaatatcaaaaactatgaaaagcgtaattttgcagaaatattcgccaccatcacaatccatgaccaccaccaaaaacaacggaatgagcagcggcaaattgacattcggctgatgcgtgccgaagaagtgcaagcatgtgccgaaataatacgagatgcttatttgggtagcacagcacaaaccagggatggcatggaattccgacttccagtttctggcatttttggtgtcagaattccgatttccgagaaattttagatataggacttccaatttttgaaaaaaaaaaatcggaatcgaatttttttttttgacaattcaaaatgtttaatttaaaaatgtgaaaaattttcttaaaaaattggcctaaaatcgcaaaaagttagcaattttcttacaaatgtactaaaacaagttaattgatttgaaaaagatgatgaaaattattgaataattttttcaagcaaatatatataccaaaatatttttgaaatttcacctttcactttttaatttatnnggttctattttaaaaattgccta

SEQ ID NO: 65705 - DNA, 1312 bp, Heterodera glycines
  misc_feature (1274)..(1274): n is a, c, g, or t
  Genomic contig location: Contig_ID=SeqID_36381; Location=358..1669; Strand=+
  SCN-specific regions: Sequence locations=1-902,924-1312
atgaccgaacacaacttcgagcagattcgccggactaattcgtcaattatacacgaaggaaatgtgcaattcgccaacgaaatggatgaaaacgaaattcggcgtcgacttcttaaagtaatgatgagacaagatggaagtgcagatttggcgagacatggcaatcagaacattggccacggagaaaacgaaaggccactttttgatgaggcccaacggccagcaattccgcgacggacaccaccaaatccacactcattgatgcagagtggcaaccaaattcatcagcgacataacagtcaaaatattgccacaattaaccatcggccaaacggattcgaagacaacgagcgacccgttccaaatccagggcttatatttgacggcatgatggcacaggccattcgaagcatggatggtttttcatacacaatgacgctgaacacaattccgaatttggacggcagtagaggctccgattcggtgaacgcctttttcaagcaatttgatattgcgaatgaagaatggcctgaacagaagcgagttcgggcgctgcgttccaaatgttttggcaaagctgagagagctttcaattccgcggttgctgaaaatcgccatgactaccaactgatcagaacatcgatcattcggcaattggacgacacggacgccaaacaattgacggcgtttgaccaactgatcaaaggagtttggcttcggccgaatgaaggcattgatcagcttggcgaacgtgtttcgcgcttggtccgttgtgcatatccggggctcagcgaacagctctacgacgaatattcggccatgcatttcattagggcactccctaactcagaattggcaatgactttggagatgactcgtaaaccgggtgcaacattcgatgagttcatcgcacaagcagcacgagccgaggcagttcaaaatgccgcacgaaattcttggcgaaacagccaaaacaacggctgtttccaaaaccaacgaaggcatattgtttgctataattctggccgagtcggacacacttctcgaaattgctattcacagccaacacatcagacgcatcagttcagtaaaaactgcaatctccggtcgacaccaccaccactattgaatcaacaaaatgacgaaccgccgaaaaagggaaatttgttagttggcgccataaacttggaacaccgtcccgagattgagaaattcttcggaaaagcaacgaatgagtcggataagggtcgatttttggaagaaagcccggcggntggtaaaattttggcgaccaaagtttccggtgttggac

SEQ ID NO: 65706 - DNA, 478 bp, Heterodera glycines
  Genomic contig location: Contig_ID=SeqID_36386; Location=80..557; Strand=+
  SCN-specific regions: Sequence locations=1-150,180-238,260-453,475-478
ccgatcatttggcacataagcaaaatgagcagaaggaactttgggttaaagttgacgaattggaacagagacaaacagcggattcggaacagtggaacaccgccaaagaagggattctggtgaaaattgatgaggtcgacacgaatgggcaatttaattttaattagaaatatttaaatgatttcttagagatcgagccagaccggatccggtaccggattttccggaatccgttccggcgattttttggaaatagggattgactggattatgagagaccggatccggaacccggtcgtttttgaaaataccagtccggtctggtccgacagatttggtaatctcagtctctcatatttctattgatgattccaattttgttcagcggttgcttcaagcggagttaaagcatcagaaactgctgaccgaacacaacgcactgatggtgaaagtggccgagatggaaaaggaaagaaat

SEQ ID NO: 65707 - DNA, 60 bp, Heterodera glycines; identical to SEQ ID NO: 52045
  Genomic contig location: Contig_ID=SeqID_36387; Location=471..530; Strand=+
  SCN-specific regions: Sequence locations=1-60

SEQ ID NO: 65708 - DNA, 721 bp, Heterodera glycines
  Genomic contig location: Contig_ID=SeqID_36389; Location=211..931; Strand=+
  SCN-specific regions: Sequence locations=1-420,443-721
atgcgcgacaacggatggactcttcgccatgtggaaagccctggcggcgagtacaaacatggcaacttcctgctggacggcatgctggagcggatcggcgaggacaaaaacttggcgattgaagtgaacgggtaaagaaacacttgccaaacttatgctaatttttctcccttcaggtgttattggcacgcgtgcccgcactgcttccccgaggatgacgcaattgttggcggtggagagacggccggtgccattcgagcgagggatgagaagaggattcggcaaattgcgcgggatttcgaggtggagatcgtgtgggagtgccagctcggccgaatgctggaagtggacccgccaatgaaggcattcttcgacaacacgcccgactccggcccgattgacttccatgatgccttcttcggaggtaatttttcccatttttagttaaaatatgcaaattttgtttacaggtcggactggcccagagtggctcggagcatcgatcatcccggacaaagaaggacaggctgggcgaaccatcaaagtcaaggacttcaacagtctgtacccgtccaggtagaaaataaattaaataatcacaaataatcaataattaaggaacatgttcaccaactaccccgtcggtcatccaaaggtcatccaaatggacaagggacgtcactggactgcgaaggacacattgtggacgacgacggcgtga

SEQ ID NO: 65709 - DNA, 1502 bp, Heterodera glycines
  Genomic contig location: Contig_ID=SeqID_7711; Location=719..2220; Strand=+
  SCN-specific regions: Sequence locations=1-156,184-346,397-465,487 -565,651-679,707-849,928-936,963-1502
atgccgccccaatcgaaggaaaggcaccatgaagtcaacatcgatgatgccaacgttcatcggaaatacatgctgatgcgcggaacgggacactataaccttttttactacaactgcaagcactgggctgaagaatttgtgataaatagtgagtttaattgaaaacattttaaaaattgaaaagtctattaattttttgaataaattcagttttggccaagactcggaataaggacgaaaaatgtggctgtctgcagtttcacttccgggcaaaatcaattgaaggtgaggaaacaatataaaattgaaagtcgtcaaatcttagggcaatttttcgaattgaaacaaaaatgaaaagcacattttgtgttcagaaaaattaaggaaattaaaattaattctatttaaatgtaaaatttcttgcaaattttcagctcatcgaaattcccgtgattatgtcaaccttgtgcgatttgagtgcaccaactgtcggcgcgagaatatgatcatcagcatactttatacagaagtcggaaaaggaactcggtaagtaaagcacattttactttctctctcactctcttcttttctcctttgactctctctctctctctttattcttttatctctcccactctttctccctctcttctcattcatgctggtatgcacaatgtttctctctcccccttctcttcctctctcgttccactccgaaacgtgccaactccgtctgagccaactttgagtcaactttttaaattgttgactctttgatatcattggaaagctcttgacaggctctattagcctaccaataattacagagaatgtcgaactgtaaaaaattctcctcttcttttcttccctctatttttattttctgctcccttattgtctcccgctccctttctctcctgtcccttttatcccggcaaaattttatatttatttatttttttgatggggctgttatgtcgatcgttatgccggacaaaggcaccattatattgacatgccttttaacgaccttcgagctgtttatgatgcgatgccggaccgggagtcgtatgctaagcatcactacgatacttttcattgggcgagagccttttacaagaaaagtaattattttgaatttgtagcgcgtccctacattttcggcccgacttttacggctgtacatttttgacctgttggaaatcgaaaattaacgccccacgccaaaatcggattttttctgccaacggaaaaaggatgataatttggcattctgttggtcgcgaaaatcagattttggcttgggccgcaaatgtcggggccgcctccgattggcgtgcataatcaattttcatttaaaatcgattatttaatgtttagttacggggttctggtgatgatacaagccgagctttggggcccaatttcaaattcgaattggccagtcgctgatgaaggacatttgatcatgttatgttttctttgattttttcttttcatta

SEQ ID NO: 65710 - DNA, 159 bp, Heterodera glycines
  Genomic contig location: Contig_ID=SeqID_7713; Location=992..1150; Strand=+
  SCN-specific regions: Sequence locations=1-159
atgcacatggtttctctactgctcatcagcaccataccaatgctgcttctcatcgtgttcacagctgtaattggggcgcgtgtaatcgacggaaccaccgccatggatttgttggctggcgatagcgaattgaaacaatcgcagtcaaaacaatttgca

SEQ ID NO: 65711 - DNA, 304 bp, Heterodera glycines; identical to SEQ ID NO: 55978
  Genomic contig location: Contig_ID=SeqID_36400; Location=372..675; Strand=-
  SCN-specific regions: Sequence locations=1-304

SEQ ID NO: 65712 - DNA, 287 bp, Heterodera glycines
  Genomic contig location: Contig_ID=SeqID_36400; Location=752..1038; Strand=-
  SCN-specific regions: Sequence locations=1-287
aaaggtctattgcgcaccgccctccctatcatgctcgagagcatttgtatgtgtataaaattttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 65713 - DNA, 1493 bp, Heterodera glycines
  Genomic contig location: Contig_ID=SeqID_7715; Location=1..1493; Strand=+
  SCN-specific regions: Sequence locations=1-474,508-665,698-934,956 -1046,1068-1493
  Gene Ontology: Mol. function=neutral amino acid transporter activity; Cellular component=vacuole; Biological process=alanine transport
acagattggaatttgcagtgttttttacgttttttgtgcaaatcacataaaagaagtgagtaaccattcactgatcacccatcgaattggtcgactcaaatggccaattgtttaatcactgctgatcatccaaaagtgacagtggaaaaccactgatcatccactcccaaaatgtccaaataatcagtcactgattaccccaaaaatgacaaagtgatcggtaattggtcgtccaaaagtggccaaataatcgggcactgatcacttttcaagaaagtgtgaatttttaagtttgtcgactttgaattcccttccttcacttatccgaaatacatctggatgttctccatctttgtgcccatggttctgatcacttttgtccgttctcttcgtgccattgccgtgctcagttccattggcaatgtcttttgtattgccgcgctcacttttattttccaggcaaactcttcaaattatatatatatatatatatttatatgtaaatattaaatattctttctttagtatctcttccgagcaaaacaccaaaatttgtccgactttccctcaaatacaaattttgacggcgtaatggccgcgtgcggtgccgttttatattcgtacgaaggacaagcgatggtaaacagagaattgaaaaacatgaaaatcatttttaatcaaaataaacaattaaaaacactcacttttatatgttttttaggttcttccgcttgaaaatcgtttgaaaaaaccgtcacaaatggtcggtttctttggcattctgtccgttggcatgaccgtagtcactgccgtatattccgcctccggcgttctcggttacatcacttacggctctcaagtgaaggggagcattacgcaaaatctgccacaaaatgaaatgttcgaccaaatgccaaattggcgaaatgtgcttattaattctaaatgatttagccaatttgtgatcgtccgcttgcttttcactttggtcatgtttttcggttttgctattcaaatgtacgtcgtggtggaaatgctgtggcccgaatttgtcaaatttctgcgcaatttatgtccaaattttggggttaataatgagaatgatcacaaaaatatggtcggcattgaattgctcttccgtgccgcgctcgtcaccgtctccagtgagtggtgccattgtcttccttttaattgcctttaattgctcgttcaattaattaccccctccttacttccaagtgctaattggcctcgctgtgcctgaattagagaatatcattccgttggttggtgccaccgctggaatgcttttggcactgattttccccgctcttctcgaccttctcgtttttctgcccattcatttacaacggcacagaattcgtcaaactttttggcttctccttgacaattggacacttgtcaccattggagtctttggtttaattgccggactgagggcgaatttgcggaacatttttacaccggcagaa

SEQ ID NO: 65714 - DNA, 1099 bp, Heterodera glycines
  Genomic contig location: Contig_ID=SeqID_7716; Location=627..1725; Strand=+
  SCN-specific regions: Sequence locations=1-162,187-429,451-654,687 -689,711-975,1010-1099
atgggccaagaaaagggacaaaacatgtttaggccgagggatattcttgccgatgtaagccgggatttgccgatgtgtcgccccaaaacggaaggcccggcacagtgtgccgaaggcagcagaacgaatgcggcagcccaagcacatacggtggggaagggagcagcagaggaggggcaaatgagcagacaaacgaaggggcaaaaggaacgaatgcttttcagccgtcgattgcgaccaaaacgcggcatgcgttgacactgccggtggttatgagtgccgatgccatccggggtatacggacatttccgagtcattcagtcagctgccgggacgaaaatgtgtggtggcggtgaacgagtgcgaagatcggtccaaaaatgactgttctgaaaatgccatttgtaccgatgccaaagaagggtcagtgaaaggggaagggcggaggaaatcactttgatcagtgtcaaattcactcttcagttacacatgcacttgtaatcccggctttgttgacgcgtcggccaatgttggcaaatacccgggccgaatttgcaacaaaccctttgaaaagttacaatttgacactccgacaaatcaatgcgacccgaatcaatcaaatccatgcccagcaggacaagtgaatggatcgaaattaaaccaataaaattacaaattttaagatttgcaagcaaaactctgccgggcattacaattgccaatgtggcgaaggggcgacatttgtggacggaaaatgccaaatagtcgcggcatgtcaggtgaatgagcagaattaattaggaccgacgaggcggggggaagtgaccgatcagtgagtgagcacattgtgaaagccaaacgatcaggtggacccggaatgtgacaagaatgccaactgcatcaacgtgctcggctcctactcgtgccaatgtaaacccggctttttcgacgtggacaaagtgacgccgggcagagagtgtaaacaatgtgagaaaaagggatgaaaatgccgaaaggacggcagtgatttgtttgtctgaagtgtcaaatgaatgtgccgatcggcacgactgttcgccgttcgccaaatgcgtggaca

SEQ ID NO: 65715 - DNA, 643 bp, Heterodera glycines
  Genomic contig location: Contig_ID=SeqID_36406; Location=421..1063; Strand=-
  SCN-specific regions: Sequence locations=1-49,71-133,156-181,213 -372,398-472,494-643
atgatgttatactctagccccaaaacggaaaagtaccattgtttgttatgatgactctggcattcagcaggctatgaagaagaagcatttataattttggctacaaaagcgggtctcgaaagcgtagtttttcatttttttataaataaaattaacgcaaaatggaaaaagttatttgctgttttttggaatttaaataaattaaccattaaacaatgtagcttctttgcacttttaatactttgtcatagcactgtttatggataaccaaattttcaatttttttgtcaatttgtaagctaatagaaaaccttagtgctatctaagatagtaatatttaaaactttggttgattttgaacaaaattataggcaaaaatttttattttgatggatttttaaataacctcatacaaaaaacccagaaaacagcggaaaaaagacaaaagcaaagcaaagaatgggacgacggagagaaaatggaaataattaaaaagtatgacgaaatgattcaagagtacaaagacaaaaaaggatttggtggagaaagtaaaatcaaaatagaatgtgccattgccaagcaattgggcacatcacgtgccatggttttcgaatagaagagggaattttgtaagtgaaataaa

SEQ ID NO: 65716 - DNA, 525 bp, Heterodera glycines
  Genomic contig location: Contig_ID=SeqID_36407; Location=32..556; Strand=-
  SCN-specific regions: Sequence locations=1-102,131-196,224-239,264 -282,304-525
aggttaatcccaaaaaaaacggacaatgtcagcgccagacggccccgtttgatgtccgctttgatggcgttgaaaatggagaaaatgaattggtgcaaatccgtctccgccaccgccgccgccgcaccacagcccttttgcacgcattcgttgtactttttgcgtgccttaattagtttttttttttttgcatgagacttttgaagaaaaattggccgggaaatctcgaaaattttgactgacccttaaaaatcattaaaaatccaaatttttaacggccttaaaaatataaagcaaatttttctcttaaatttttcttttggagcaacttaaatttgaatagcgaagcaataagcgaacaaaaaaattattcaaaatcagtggggaaaaaaagatttttttttgcgtttttaaatggccaaattaattctctgaaaattacttggcaaagtgtgtgcagcgcacggacagttgaattggcggcatccatcagttgttgctggaataggcacaaaaagaaataaa

SEQ ID NO: 65717 - DNA, 814 bp, Heterodera glycines
  Genomic contig location: Contig_ID=SeqID_36410; Location=208..1021; Strand=-
  SCN-specific regions: Sequence locations=1-365,387-501,523-654,681 -763,806-814
gaaaacaaaaaaatcgattttttcagtgtctgttggggtctcatacattatgggagcaaaaatccaacgcagattaaagtacaggctataggaagctatcccggaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcgtcggttcggggggactgccccgaaaacaaaaaaatcgattttttcaagtgtctgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 65718 - DNA, 306 bp, Heterodera glycines
  Genomic contig location: Contig_ID=SeqID_36411; Location=326..631; Strand=-
  SCN-specific regions: Sequence locations=1-306
atgtccgagtatgaagtggttgtggagtatttgccggacaaaaaattcggcaaaaagtacattatggtcaaaagaacggacattttggcaacattgaaacacaaaatcagggaggcgtacaccaaggcttacccaacaaaaatgccattcagcatagttcaactcgtcaaaaaatttaaatgtgccgaaaaatgtggacaagaaatgcgtgtggaggatgttgagcaatggtatgatgatgctgacgccgaaaaaaccatggacaaatgtggcattggcgaagggtccattgtgttcatgttttag

SEQ ID NO: 65719 - DNA, 611 bp, Heterodera glycines
  Genomic contig location: Contig_ID=SeqID_7717; Location=11..621; Strand=+
  SCN-specific regions: Sequence locations=1-337,371-471,598-611
atgcctttgcctgttccacacttctctgagctgaaaagcgccaaggaatgcgtcggtggtttcggcatttggcttttccaatttgcaggccttgaaaaaaacagggaaaatttcccaaaaccagggggttgggttggttatatggtatatcaaatgtattacggtcaaaaatgcgtttctgagcatttcattggcaaacacggcgccgtccgtcaggtgcgcaaaccgtgccaatgccaccaccaccggtggggcgttgtcggcgtcgacggcactggcgctgtgttggcccttggcggccaattggtcgcggaccgaaaaattgggaaataattttgagaatttatttatttttgagggattttctttaccagttgataaagtcggcacaacacggcagttttgccacagcctgattggccatggaattggacaaacagtccggcacttttttgccgaatttcgtctctgaaattttttttttatttttttttaaataatacaaaataatttaatcattaaaatttttattaaaagaatataaagcgattttaaattctttgaatattttaattaaattatttttgtattaaatttgaaaaagtgaaaaa

SEQ ID NO: 65720 - DNA, 749 bp, Heterodera glycines
  Genomic contig location: Contig_ID=SeqID_7719; Location=6..754; Strand=-
  SCN-specific regions: Sequence locations=1-671,729-749
atgtcggtccgcaaatgtcggtccgcaaatgtcggtccgcaaaagtcggtccgcaaatgtcggtccgcaaaagtcggtccgcaaatgtcggtccgcaaaagtcggtccgcaaatgtcggtccgcaaaaagtcggtccgcaaatgtcggtccgcaaaagtcggtccgcaaaagtcggtccgcaaatgtcggtccgcaaaagtcggtccgcaaaagtcggtccgcaaatgtcggtccgcaaaagtcggtccgcaaaagtcggtccgcaaatgtcggtccgcaaaagtcggtccgcaaaagtcggtccgcaaatgtcggtccgcaaaagtcggtccgcaaaagtcggtccgcaaatgtcggtccgcaaaagtcggtccgcaaaagtcggtccgcaaaagtcggtccgcaaatgtcggtccgcaaaagtcggtccgcaaaagtcggtccgcaaaagtcggtccgcaaaagtcggtccgcaaaagtcggtccgcaaaagtcggtccgcaaaagtcggtccgcaaaagtcggtccgcaaaagtcggtccgcaaaagtcggtccgcaaaagtcggtccgcaaaagtcggtccgcaaaagtcggtccgcaaatgtcggtccgcaaaagtcggtccgcaaaagtcggtccgcaaatgtcggctaaccattttgaatttagtttttttaaaatgttttaactaatttaatttaaaaatatttttaattttaaattaatgccatttcaaattataataaa

SEQ ID NO: 65721 - DNA, 363 bp, Heterodera glycines
  Genomic contig location: Contig_ID=SeqID_36413; Location=201..563; Strand=-
  SCN-specific regions: Sequence locations=1-44,66-363
atggatttgcttttccgtctttacgctaaagacaaggatacacagccaatttggaatgcttttgccgctgaaatttggcccatttttgcaccaaacattcgccatttgaagtttaatggtgatcttgaaaatttgcgtcgccacatttcgccgacaattctctccgacctcaaccaattgaattcaatcaattccgatactttggggcccacggcgattggtgatgatgggccaaatgcaactgatggccaagcgctgtccaaatggttgcacactccgacaaaagatggacagccaaagcaattgtctttttggcatttttctgagtgtggaaccactaaattgctgaacgatttcaaagag

SEQ ID NO: 65722 - DNA, 279 bp, Heterodera glycines; identical to SEQ ID NO: 58736
  Genomic contig location: Contig_ID=SeqID_36419; Location=186..464; Strand=+
  SCN-specific regions: Sequence locations=1-153,196-279

SEQ ID NO: 65723 - DNA, 273 bp, Heterodera glycines
  misc_feature (214)..(214): n is a, c, g, or t
  Genomic contig location: Contig_ID=SeqID_36419; Location=1..273; Strand=-
  SCN-specific regions: Sequence locations=1-86,116-273
gctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaatttggggcgatttgaaagagaatagaaagaaccaggntcgatgaagttttggtaagccaaaaaaaatcaaacatttaaaaatctataaaaaattta

SEQ ID NO: 65724 - DNA, 917 bp, Heterodera glycines; identical to SEQ ID NO: 36421
  Genomic contig location: Contig_ID=SeqID_36421; Location=1..917; Strand=+
  SCN-specific regions: Sequence locations=1-551,573-917
  Gene Ontology: Mol. function=protein binding; Biological process=cell adhesion

SEQ ID NO: 65725 - DNA, 1290 bp, Heterodera glycines
  Genomic contig location: Contig_ID=SeqID_1000; Location=908..2197; Strand=-
  SCN-specific regions: Sequence locations=1-418,440-563,649-852,903 -938,968-1096,1118-1125,1147-1260,1288-1290
atgccaggagcgccaagtgatgttctttggttctttgatgcggaagagcaaaagatcaacccacggtgggactcgaacccacgaccccagctttccgtgctgtgctctaaccaactagctacgcaggcatcctctccattgctctcttctctctcctatcttaggaggagaatcactctcttaatctccttcactgccgtcttggcacaaggggagagagtgaccgcatttatcacaatagggtttgttcgaacattcatacttggtaccaatttcaaatccttcctcactcaaatttccaaaaaaatttgctaaattattagaaaaattgttaagatcgccaaaattacaggtaatatttagtgaaattaccggtaaccgcttttattctaatatgaaattataaacatacactgactttgaccccattttgcagagtaatgatgatacgcatacttgttcatcaaatccggtattaataaattatagaaattggaaatgattgtttcataaaaataaaggtagttggaattctctgttatcctagaatctctgttttttcttttaatttattttagtttctaatttcattttttttaattttggttgatttttaaattttaaataatcaaatgaatttattttaatgatttttatcgagttaattccacaattttggtgccctcttttttgacacatctggatttgacgggcagcaaccgagcttcgcccgtccctggtgcccatgcccgtatttttgaaattgcactcggacgataggaactctttaaaacaataactcaaaaagtccataaagcccgcagatgcgatcgcgggaacgttatgacgatctataatagatttaaatttaaattttttaggtttatttttttacaatttatcgcaaaaccgttgacatcattgacattaaatatgaaggtaaaataattttaaatgtctgtaaattgttttttgttcgggacgcaatcccgtcccgcatctgctacaggtttcaatgaaacttacagtcattctgatggttctggaattgtttgttctgtttaattgccagaaaagaatagcaaatttaatttcctaatttatttttatttgtatagaaatttccacttttgtcgatgtgccaggtggacgatggagattttggaatggcacttttatacccaaaattggtctccagtgctcgccactttggagcgaattggaggcggagcagtggattttggtaatagattttggtaaattgatttaaaatttgagtttaaaaataaa

SEQ ID NO: 65726 - DNA, 1717 bp, Heterodera glycines
  Genomic contig location: Contig_ID=SeqID_1000; Location=7350..9066; Strand=+
  SCN-specific regions: Sequence locations=1-34,56-671,693-828,856 -933,1023-1072,1094-1717
atggaacaatacggttggccacaatttgctggtgaagaagaaaaaattcgtcaagcagttcaatttccaaataagaaacatgtggtggaaagcgtttggcccacgattcctcttcctccttctgccgttccatctcaatcgaagcactcttcattaatagcaatgatatttttaggatctaaaaactgccaaacaaataacatttgggactaaaaaatggactgaaaatgagaacaattggtccaatatgatcgagcaaaatggggagctagagagggcaaggtccgtagttcagctggtagaacaacaatggtaaggaaagccaaagccactgacaccggttaaaagtagagaccggacaagaaggtcggtcggtcggtttcgttataaaaaccgaaaaaaaccgaaaactcaaaaaattttcggtcggtcggtttcggttaaaaaaccgaaaaataccgaaaaaaaccgaaaaaaaaccgaccggtccgatctctagttaaaagccagcccgccccatagtttttccagcaaaagcttccccagctcggaatggggccaactgcgtctcaggcaagtttggaattcgtaacttttttaaaagttgcccaatcgaacaaacttggtatcattcgaaagctcttaacaagctctatcggctctccaaaaatcacaaagattttccggcatataaaaaagttataaagaaatatatgcaaaaattctgacttttttgcggttttcgggttgcagcttttaataatttgttcaatcgattagaataaatagcttatcaataatttctaaacataaagagctttcgattgatgttaaacttttaaaatttgatcaattgagaacaaaggttataacttcttaaagttgcctgagatgcacttggccagacgcatttgcccctaccgtctacagctcatttatatattcataaataaattttttttatgaaaatattgcaaaaaaattgatttttactatgtatttttcaatttttttatatttttcatacggaacgggtcagttccgtcccgccagttttccgtaaataggccctaaaaagtttcagatttaggggtgtttttgggccaaattttttagcttcggagtcgcgttttagaaaaatattatttttttttcattttaaggcacacagtatttttgcctacaaagaacagacaccgtcatatgctttacaacagcgacgctattcacttctgaagaggatggcatccttttacaaaattggaacttccgtgagtaagcagctcccgccaaatgaatttttgtgtcttttgaacaactttatgtgaaaatttatttaaacaattcaggcgcttccttattatttgatttgctttttctttaaatttacacaaaacaaataattagggatgccaatcatatggatggataccatatttttttcctggactgttgagggcctgaagcgcacgaaaaacatgtttttagcttggtttgaagcttgtaggatggatttctatatccatatttttccatatttcgcaatttatgtcaatattttagcattttgatccatattttatgtccatattttggcatttttcaaaaaaacctcaattagaacagcccccagcagctaaattagcctttttgagcccaaaacccgaaaaatttttcaaaaaataattttttcgccaaaatttctcgagaatattga

SEQ ID NO: 65727 - DNA, 1762 bp, Heterodera glycines
  Genomic contig location: Contig_ID=SeqID_7721; Location=185..1946; Strand=+
  SCN-specific regions: Sequence locations=1-18,44-244,266-320,368 -516,597-852,874-1218,1240-1441,1463-1629,1651-1762
atggtaagtacaaaagggaaatgatggtgatggtggtggtcatgtttgtgattgtttgttcttatgccgacctccccccgcccttcccagcagacatcccaaattttttcacttttgaattgccaattgtcagtcaattatggggttgtggttgtgatgcgattcgtccttttcccgcgaaatgctgcgtcactttaattgtttcgtttcattgccctttgtacacagtcacatttaaagttcgcttttttcaaaaatataatttcagataaggcttcgttttctcatttttccgaatgtgccgtactgattgcccttgccctcctcttcctccgtcctcctcccctcctcccgccttttcttcctcggcccttcccttccgtcgttctcaaatgccctccccatcgtttgcaatgttttcagtctcttctcgctttgcactttttctgcccttcaaaagttccactttaaaatcgcttcattcatggtaaggataacaaacaatgcaaaaatcagtttctcttttcttttttttcaatgatctgctgttttttaaattattttttgtttcttttttctctgatttttgtctttttaggcttcccttctttctcttgcgaaagttttcccatcggttgctccatttggttatttcattgacttttattttgacaatttggcacttttggaattggcacgtcgaacggtggaccaatcgaacgacagttattatcgtaagtaattctgaggggcgtcttaccccctcccctttcgcttattaatttttgttttaatttgtttttgattacgcccactcataaacgacctgaacgtcttgcggacatgaccaggttctttttcccttttctctctgttttctcattttggttgggattttcagattttcgcaaactctgatgcatatttctgacctccattggtacaattttagccatcctaaaacgattttcatcgttttactcactccgctgttagggtcgtcatcgaagatgccaatgcgacttcggatgccgttcagcgtatcctcgtccgttccggtattcccttcacttacttctccaccaccacgaagcccggcttccccaaacgcggatggagccatcgcaacgtcgggttggacttcgtccgccaacactacgctctcttccctcacaatggggtcggtccgtctctccgttcgtccgttgcctctctttgcctttgaaattggtttttcttccgttcgcaggtcgtttattttgcggacgacgacaattcttatgacattcgtctctttgagcgctacatcaaaaaagtgagaacgattggcatttgggcagtcggtgagtcattttttgtgccttttaatttttgattttttttttcttaggcctcgccggttctgcgattgtcgaagcgccgcacgtggagaatggcaccatcacaaagtgagttgtcaattcccctcacatttgttccactttccctttcttcagatgggatgtcgtttatgctccaaaacggcgtttcgctgtcgacatggccggctttgccgtcaagtgaatgtgttgccttttcattttgccaattaccctttaatttgattcaattttcagtcttcggctgatcttaaacaaaaagtagtaactgtttccgtcccttcaatttctttctttctttttgcttccctttttagtgcctctttcaatttgggctgtgtccgcttttcgcctgagtcgtgttttcttgcgcaggtaattta

SEQ ID NO: 65728 - DNA, 1093 bp, Heterodera glycines
  Genomic contig location: Contig_ID=SeqID_7721; Location=2550..3642; Strand=-
  SCN-specific regions: Sequence locations=1-24,52-226,267-473,506 -853,875-1093
atgtgtcagaatatgctgctcattctgttcgtcctcctcctcctccattgcgtttccgtcgtccgcttggatttgcgcctgcgccttccaatagccctcgagcaatgggaaattggccattggcacgagagcaattggctgatcagtcgggaacagatcggacagtggcaaaagcagggggaaatcactctcagcatatttggaagccaaagcctccagcgaattgcacgcgtccggcagaagggagcacagagaaaaagaactgaaagggcagagaaataatccaacgaatgaatgaatcatttcgaaattcaccaaaaatcgtcggacaaaaaggcactttgacttcgccctttgtcacaaattcggcccacccaaacggagttttgctccaaagtgagagacaaacgaagggacgacgcattcagtggaggcaaagggcgcgaaaggacaatttggccgaaaacgaaggcattggaaaaagaaaaagggaagggcgaaagaataccggacaaaatgagcaaaaagccgggcaatcggacggccgaatggccctcagagtcgcaaaaggggcgcatattcacatccaaagaagcgagggaaaggttcagcaaacggaagggtactgtacatgggagagggtacggtaaagggggagaggcgaaattcaaaattaaacaatcgccgttttttgaaatggaaggcaagcccaaaatgccgaattgtacctctttctttggctttggttaaatcgctcactctgagcacactttcgctgcattccatcgaagccaaagcgacccaaaaaagagaagggacaaccaaagggaggaacagacgaaaaagggcagaatataaaattggcattttaaaatcggacaaattttatggggggggggggggaaattaattaaatgggacactaattaacgaatggttgacaggtgaggtggctcatctgctgatttgaaaagggcgatgggtcggtcggtgggcttttttgaaaatgcaggagaatgattgacagtccattttcagagagaaaattaaaaaatattatcaaagcaacattaattaaaagaatgaaaataaa

SEQ ID NO: 65729 - DNA, 520 bp, Heterodera glycines
  Genomic contig location: Contig_ID=SeqID_7721; Location=4099..4618; Strand=+
  SCN-specific regions: Sequence locations=1-40,62-216,239-413,436-520
atgccaatgcctttggttcggttggctttcccccgcagtgtctttttgttggccctcttttgccggttcgcctccgccgaattcaggccccatttcagccaatggctcgctcaacgctttggcgaagacgtgcgcaacaacttggagaggtgtgtcgtacgaatttgactcccatttggtgccgttttcagacgcgacctcggcatttggggctcttttggggggcgcaccgccgcggaggagccaatccgaaaccaaccggtggtgttcgtgcacggttgtctgttctgttactgttgcaattcaattggaatgccctcaaacttttgaaggtgtttcaaatcgcgcgtgcgacaaaatgaaacaatccgccgactttttcttgcaagtgccaaaattaacataatttggcaaattgttgttttaaactaaaaacaactacagtaaccacggctacactttttctgagctgtacggtacaacgtatgccaatggggaccaaggcaatccgctacagtaa

SEQ ID NO: 65730 - DNA, 363 bp, Heterodera glycines
  Genomic contig location: Contig_ID=SeqID_7721; Location=3340..3702; Strand=+
  SCN-specific regions: Sequence locations=1-37,78-252,280-363
atgattcattcattcgttggattatttctctgccctttcagttctttttctctgtgctcccttctgccggacgcgtgcaattcgctggaggctttggcttccaaatatgctgagagtgatttccccctgcttttgccactgtccgatctgttcccgactgatcagccaattgctctcgtgccaatggccaatttcccattgctcgagggctattggaaggcgcaggcgcaaatccaagcggacgacggaaacgcaatggaggaggaggaggacgaacagaatgagcagcatattctgacacattttggcactgaaaattggcattttgtttcgttgggcaatgatttgcatgaagacctttaa

SEQ ID NO: 65731 - DNA, 288 bp, Heterodera glycines
  Genomic contig location: Contig_ID=SeqID_36426; Location=29..316; Strand=-
  SCN-specific regions: Sequence locations=1-90,112-117,139-239
atgactgtaattgcctttattttaccatgggtccaggcaaaggcaaatgtaagcctagaagcattttgcattaaacttttaaaagcaaatttaaattacagaaaatgaaatatcgcaaaatgtccaaaaaatttatgcggcacgaacgggaattggcccgactcagatttgaatgtcgaatgtgcggaggacttgaagattcgtccgggacaatagcatgtttcaagtgaacgcaattcattttaatttataaatcataacaaaaatattgaaattaaattaaataaa

SEQ ID NO: 65732 - DNA, 544 bp, Heterodera glycines
  Genomic contig location: Contig_ID=SeqID_36428; Location=210..753; Strand=-
  SCN-specific regions: Sequence locations=1-112,134-444,467-544
atgagtttatttaagaaatcaggacaaaatttggtcgggtacctccaaatcaggacaaatctgacaaatcaggacactttcattttatcagatttgaaccctccaaatcaggacaaatctgataaatcaggacagatcgcacccctggtttaaccccacttctttccacttctttttaaaccagggcttccatcgaaaaattttcaaaatataaacaccaagcccaaaataagattttagtctcaaaaatatgaacatttagcaacatttttccaatcagttatttttccaatttattcgatcaaattttatatttttagtctcctattatcaattttgataattttggggaggaaaatgcaaaattataaatttcagtaaattcgggaccaaaagatcaaaaaaattttgcggcagaccttaaaatttcttgaaaaatgtgacattatgccataaaatttcaaaactataagtatatttaagaaatcagaatatttagtcactacccccccccccccaaaatcagaatattcttataaataaa

SEQ ID NO: 65733 - DNA, 436 bp, Heterodera glycines
  Genomic contig location: Contig_ID=SeqID_36431; Location=243..678; Strand=-
  SCN-specific regions: Sequence locations=1-121,179-232,256-326,348 -353,384-415
atgagaaattggtggcgagaatggattccggacgagaactcgtcgagaattagaggcccaacatggcggagtgagcagtggcgagatcgcgattgtggcattcatgtcaagcataaaaggcaattaaataaatatttaaatgtaatatgttattaaatttatattttaaaaaataatacaatgaactcggaaatcgacttgcagagtcatggtacaagagcggttcggtgtatacaaaagttagtacaaaaagagctacccatgtgttaagaaaatgtgatcaatttcaaatcattatgataaataatatgaactaggtgtttctaaaagtgataaagcatcgagagtgatagtaaaatagaaatataaaaaaaatataaatagtaaccaattatatggaacaaatattacatttaattattataagaaaaataaa

SEQ ID NO: 65734 - DNA, 279 bp, Heterodera glycines
  Genomic contig location: Contig_ID=SeqID_7722; Location=1226..1504; Strand=+
  SCN-specific regions: Sequence locations=1-177,203-279
agcagcgctcattgactagcagctcttgcgttattcaaattaatgctttaacaaccaaatccgaagcaataaacaccaaaacaacaacaacaatcaaacaacaattttttgttgttcggtcattcaccaacaaatacataatttttttaattgcgtaaatccgtgcatcgcaaattgtgcaaaaaagaagaaaaatttgaggaccgaccacaattttgcgttttatcttgcggcctttgttagcaaaatgctgtcacctgaccaattgcctgacgaggt

SEQ ID NO: 65735 - DNA, 959 bp, Heterodera glycines
  Genomic contig location: Contig_ID=SeqID_7723; Location=1519..2477; Strand=+
  SCN-specific regions: Sequence locations=1-484,509-588,611-637,659-959
  Gene Ontology: Mol. function=hexokinase activity; Cellular component =membrane; Biological process=glycolysis
atggtcattaattattgcaaaatgattaagggcgagttggcggatgtgttgacatcgtttgaccacgaaattgaccaggcatcggtgcaccgagggaagcaaatgtacgcaatatttgggacatttgctttttttgggcattacaaactttttcatccggcgatgtcgacaggcgccgcagcggaaatttttaccgaattaaaaaaaactgcaatccggggcccatcccatctagatggtcctaaatggttttgaaatttgtcattaagaattgataaactgaccggcgccctgtaccttggcgagctgatccgacgcattcttgcccagctggtgatggaccgtctgctgttcagcggcacactcgtggaggcgttggaccggccggacactttccccaccaaatacatctccgaaatacttgggtatgttggtacaaatgctgatttttgataatgtaaggttttacaaaacctattttcgcaattaaaatattttaaatttaattcgaaattcgaattttccatccatattaccgaagaggagagtttaaccaggacagggagtattaaatccgtaattaaagaggccttcttcaattaacaaaaatgagtaactcgcaattgcggtgtacaaaaatgtaataaacatttgtgtaatcacatctaacccaggagtaaatgacacccgaaaaatttgaccagaaaaattatgcaatttgatgtactagtaacagatttcgttctacagttgacatttttaaaactttcttcggtgccgtccgtttttgccggcaccgccggactcctttttttgaacatttcgttcatcaattaattgattgttgtcgctcttttcatttcagcgacaacagcggggtgttcaaaaattgtcgtcgcatttgtgacgagttggaggtgccaagccacgggagcaacgactacctgatcatgcgcgag

SEQ ID NO: 65736 - DNA, 554 bp, Heterodera glycines
  Genomic contig location: Contig_ID=SeqID_7723; Location=251..804; Strand=+
  SCN-specific regions: Sequence locations=1-147,169-192,214-507,530-554
ccatttattgtctgttacttttagcccagaatttagttaagcaaaaaatctataaaccaagttttcacttgataccataataaactgagattgtcattgtttgaacgcgtgaactcgaacattgtttaaaatgatcatttctctggaatttttcagttatatatttttgtttattaaagtctcgtaaaattgccaaaacaattcttttcatgtttaagtccattcttcgcaaccgaaacgaacggtcgccaattaacaacgaagaattgcagaaaatgtgcaaaagagatattgtggagtttcttcctactccgaaggaggtaccaacaatttaaagctattaggccttattttaattagattttgggtgatttcgttttcgagaggagcgccgggaacaacagagagaaaaggaagccgaggaaagggaggccaatgtcagcgtggaaaagtaggaaaatggacttgtcgagcagtgacgaggagagaatttaattcgcgaaatatttattgtatttgtttttgttatcacccattttgcaattatttttttc

SEQ ID NO: 65737 - DNA, 243 bp, Heterodera glycines
  Genomic contig location: Contig_ID=SeqID_7723; Location=3374..3616; Strand=+
  SCN-specific regions: Sequence locations=1-126,151-243
tttttccttctccttttgtttctctgatcagaccgttgatctgcggcatcaaattgtacacgacgaaaatggtcatttgtttggtccatttttgcgagtggcctcctccacgttgtgttgttaactcctcctcattctccgcctcctcccaccatatatttaattataattatcacaatcgtttttttatcacactcttaacatgttttttgtggttgaccagcaaataaatttttaatctgc

SEQ ID NO: 65738 - DNA, 213 bp, Heterodera glycines
  Genomic contig location: Contig_ID=SeqID_36432; Location=4..216; Strand=-
  SCN-specific regions: Sequence locations=1-213
atgcgcgccttcgtctcccattgcggttttaacagtgtcaatgaggctgtccaatttggagtgccaattttggccattccgctacttggagaccaactgtacaatgccattatggcacgtgtgaaaggcatcgccgtacaattggacattggccaactcaacagggagggggccgaacagctgctggttgatgggcttgacaaggctaattag

SEQ ID NO: 65739 - DNA, 65 bp, Heterodera glycines
  Genomic contig location: Contig_ID=SeqID_36434; Location=29..93; Strand=+
  SCN-specific regions: Sequence locations=1-4,27-65
atggctatctcctttttctcctggggatttgaccgcaaacttggtaccaacatttgccttctcta

SEQ ID NO: 65740 - DNA, 59 bp, Heterodera glycines; identical to SEQ ID NO: 52422
  Genomic contig location: Contig_ID=SeqID_36434; Location=207..265; Strand=+
  SCN-specific regions: Sequence locations=1-59

SEQ ID NO: 65741 - DNA, 59 bp, Heterodera glycines; identical to SEQ ID NO: 52421
  Genomic contig location: Contig_ID=SeqID_36434; Location=337..395; Strand=+
  SCN-specific regions: Sequence locations=1-59

SEQ ID NO: 65742 - DNA, 59 bp, Heterodera glycines; identical to SEQ ID NO: 52421
  Genomic contig location: Contig_ID=SeqID_36434; Location=467..525; Strand=+
  SCN-specific regions: Sequence locations=1-59

SEQ ID NO: 65743 - DNA, 59 bp, Heterodera glycines; identical to SEQ ID NO: 52421
  Genomic contig location: Contig_ID=SeqID_36434; Location=597..655; Strand=+
  SCN-specific regions: Sequence locations=1-59

SEQ ID NO: 65744 - DNA, 59 bp, Heterodera glycines; identical to SEQ ID NO: 52422
  Genomic contig location: Contig_ID=SeqID_36434; Location=727..785; Strand=+
  SCN-specific regions: Sequence locations=1-59

SEQ ID NO: 65745 - DNA, 59 bp, Heterodera glycines; identical to SEQ ID NO: 52421
  Genomic contig location: Contig_ID=SeqID_36434; Location=857..915; Strand=+
  SCN-specific regions: Sequence locations=1-59

SEQ ID NO: 65746 - DNA, 130 bp, Heterodera glycines
  Genomic contig location: Contig_ID=SeqID_36436; Location=1436..1565; Strand=+
  SCN-specific regions: Sequence locations=1-130
atgcaatttttatttacgaaaatcacaatttttatttttgtttccgttgcgttttgtgccaaggattctaaaaaagcaggcgaattggctgttgctttgttcaaattcatctacaacaatgaaaaattat

SEQ ID NO: 65747 - DNA, 454 bp, Heterodera glycines
  Genomic contig location: Contig_ID=SeqID_36437; Location=229..682; Strand=+
  SCN-specific regions: Sequence locations=1-88,111-180,204-209,232-454
atgacgaagttttgtgcggtgccattgctaacagcgaatggtggtggtaatggtgaggcttttgaatgcgatgatgagcagcagaatttggcggcggcggcgggggacaatggcgtgaagaatttggtggcagtgggcgcgatgaacgcatttcaaattctataataaaaatagagaaatattaaaatttgaatttgaaaaatcagtgggattttgtaatatttttaaatgggaatgcaaatgaggaggttttcgacatttaaacaaatatcaacagaaaaattgcaatgagaaaattcggaattcattgaaaataatttttttatctgttgccctagcccagaaattagttatataaaattctatagactttaagcttcaagttgataccaagaatggaggttatggccttggaaataggatattcattgtttggacgcataaaatgaactag

SEQ ID NO: 65748 - DNA, 179 bp, Heterodera glycines
  Genomic contig location: Contig_ID=SeqID_36437; Location=185..363; Strand=-
  SCN-specific regions: Sequence locations=1-25,48-179
cactgccaccaaattcttcacgccattgtcccccgccgccgccgccaaattctgctgctcatcatcgcattcaaaagcctcaccattaccaccaccattcgctgttagcaatggcaccgcacaaaacttcgtcatttgaagcgcccacccaatcggagttgaagcaaatgctggacgag

SEQ ID NO: 65749 - DNA, 405 bp, Heterodera glycines
  misc_feature (386)..(386): n is a, c, g, or t
  Genomic contig location: Contig_ID=SeqID_36440; Location=502..906; Strand=+
  SCN-specific regions: Sequence locations=1-405
atggccgatgaaattcaacaaaaaattgttcagggaattggtccggattttttttctgtgacctctgatggatggtcgcaaattacaaaatcacccgcactcttaaggttctctattccttttcatagtttataaaaacagactttagtgttactgtacaccatataaatcaacaatttgtacgcgccgattttgtacttgatgtgattccaatgacaaatcacacaggagcagacatagcggaagaaattggaaacgctcttcggacaaatggattaaacccagaaaaaattatttgtttggttcgtgacaacgcaaaaaacatgataagggccacaaatatttgcctgagttggcaggactcatttccaaaattcggtcttggngtactttttttcgtacaaa

SEQ ID NO: 65750 - DNA, 231 bp, Heterodera glycines
  Genomic contig location: Contig_ID=SeqID_36441; Location=123..353; Strand=-
  SCN-specific regions: Sequence locations=1-231
atggagattttgttggaagtaattttgggcagttctgtcgaagaaatgacagaagttttgaaggtttattctaaacaatatggtggaaatttgtcggaggatattcaaaaaattggggagaaggcccaagggaaaaactcaaaaggaaaaaatgacactgaggaggcaaaagctgtccgagaaattttgggtgatcggcttcaaaacttgaaggaaagagcggcaattaaa

SEQ ID NO: 65751 - DNA, 1103 bp, Heterodera glycines
  Genomic contig location: Contig_ID=SeqID_7724; Location=479..1581; Strand=-
  SCN-specific regions: Sequence locations=1-167,189-262,293-508,530 -614,646-742,769-1076,1098-1103
atgaaaatcgaaaaatccctaatttacaccgagtcgtacgtcgccggcctttcttccgttggcgtccgtaacatcgggagagcgactgtgaaactaggaaatgtaagtagacgtaatctcgttctggaaaggcgctctcttctggaaatgtacgccgactttttcggtgaacagaatgaattttggaattttgaagagcacttcccatttttcagcccatccagacgaattggtcagcgcggcttacgaaaacacacccgaaaaaaggtgttttcttttcttttcgctggacaaaatcaccctaattcttttacagattccttgccgtcctgaagtactatctgaactccttcttcccggctcgcaaaagtgtcgtcgccaagaagccgtacaatccgattttgggcgagacatttcgctgccgctggacgctgccgggcgtgccgttgaccacggagcggactgccggtggaccgttcccggaattgaaaaatcgcttttaaatagccattttaaacaatgaaaaacctcctaaaaaatgcgcaatttcaatcgacaaattgtgtataaaaggacgaaaaagacaaaaattcacttataatgtcgaggctcacaatattttatagtttatataatttttttattgcaggatcgatggctttcatttttgtttccgagtatttgtagtttttaaacaaaaaaatggatgtcagtcagtgcatgatcagcaacctcgaaattctttaaattattttctaaaataagttagggctgacattcggcgccagcccagtttttggactataactttttctttatcaaccaaatctaacttttggtatcattcgaaagccctaagtgttctctattagagaccggcgcgggacgggatcccgcgcgggattttgcgggatcccagtccgcaatcccgcattttttggaaaatgcgggatttgcgggattaatctcgcgggatcccgtcccgcaaagaattttgagttccaatcccgcagcgggatccgcaaatttgattttttgtgcgggattttattgatttttttgaaaatttttctaagacagaatgccaaatatttttaaataaa

SEQ ID NO: 65752 - DNA, 128 bp, Heterodera glycines
  Genomic contig location: Contig_ID=SeqID_7724; Location=123..250; Strand=-
  SCN-specific regions: Sequence locations=1-78,107-128
tatggcacggaaagacttccggtttccgacatttttggggtcggaattccgacttccgaaatttttgatgaaaagtcgtaaattttttaatttttttttttaaaaactagtaagttttgtacaatttc

SEQ ID NO: 65753 - DNA, 61 bp, Heterodera glycines
  Genomic contig location: Contig_ID=SeqID_7725; Location=1839..1899; Strand=+
  SCN-specific regions: Sequence locations=1-61
atgagtcagtcatttcgccggcggagggaaggagaaacatttgatggaccaacggaaaatg

SEQ ID NO: 65754 - DNA, 406 bp, Heterodera glycines
  Genomic contig location: Contig_ID=SeqID_36446; Location=111..516; Strand=-
  SCN-specific regions: Sequence locations=1-11,34-230,254-406
atgaatgtaaataaagaagaggaacgactggaaaagaaagtgaccaaatgggctattatgctaaccagtgaagacaaggtgagcatgggcattcctcagtatgggattttgggtaatacataatactgaaaaattgcggtaaaaaggtaaaacagaaacccataaataattcgatggttttgcaaaatctaagtcagattcgcaatttagcaattttttttactggatttatttcagagaaagttttaacttggaatcgcaattctgcaatactaccgggcccattctgcaatattactggattttgaatcttttcttatagattgaacatgccttgaggcgattggatcatgttgagattaacttacaacttttgtcttcgactggttggagttttttaaataaa

SEQ ID NO: 65755 - DNA, 126 bp, Heterodera glycines; identical to SEQ ID NO: 54981
  Genomic contig location: Contig_ID=SeqID_36449; Location=287..412; Strand=+
  SCN-specific regions: Sequence locations=1-126

SEQ ID NO: 65756 - DNA, 564 bp, Heterodera glycines
  Genomic contig location: Contig_ID=SeqID_7727; Location=55..618; Strand=-
  SCN-specific regions: Sequence locations=1-87,108-173,197-564
atgctaacgaagccgacgacggcaaaaccgcaacaacaagcatcacaacatcgtcatccaccgtcctcaacatggttaagcaatggccaacaacaacaacaacaacaccaccagccgccgcaacaggggacgcctcctccgccaacagctgggcgggcagcaccggggggaaaagccgccgccggcgccgagaacggcaatagcaggaaaacctcggcaaatccggcactactaccaaagatgtcgacgacaagctcaacagcagcggcggcggtaccaccagggccaaaatcgtcttcaagcagttcaacagcagcagccgtggcgggcggcaggccgaggccgccgccaacgcagcgaacgacaagccgagattcggcgtcggcggcaccggaccgcaaggtgtccaagcaatccagcgggagcaggggaactgcaaggtcggcagtggtcagcaagcggccggaactgcgcagggcggtgttgctggcaaatgcggaggaacattcccacccggacgggctgttcaaggtggtcaatcagtcagaaagcttaattaagtga

SEQ ID NO: 65757 - DNA, 316 bp, Heterodera glycines
  misc_feature (313)..(313): n is a, c, g, or t
  Genomic contig location: Contig_ID=SeqID_7728; Location=1..316; Strand=+
  SCN-specific regions: Sequence locations=1-316
tcgggaatagcttccctatagtctgtactttaattctgcgttggatttttgctcccccataaatgtttgagtacctcaaacggacacttgaaaaaatcgatttttttgttttcggggcagtccccccgagcgcgatgcgcccagatttatggggagaccgaatccttccggaatagcttccctatagcctgtactataattctgcgttggatttttgctccccataactgtttgagtaccccaaacggacacttgaaaaaatcgatttatttttgttttcggggcagtccccccgaaccgatgcccccagatntat

SEQ ID NO: 65758 - DNA, 1006 bp, Heterodera glycines
  Genomic contig location: Contig_ID=SeqID_36452; Location=160..1165; Strand=-
  SCN-specific regions: Sequence locations=1-166,209-229,251-318,340 -394,446-521,551-667,690-715,737-1006
atggaaatatgcgaagaacggcaaaatgatcaccaaaaaattgatcaaaaattcacggggacaatttgcaaaacacctttttctgctgttgatgaagggacagaaacaatttcaaacggtggaaaatgcagaccatcaatttcccaaccgaacgcgaaaaagttggaaaaaaagaaaaaatatttaaaaaatattaaaaataaatttagaacaacacattcggaattgtaaagaaaaggaagaaattgtgaacaaatttagacaaatgaaaagggaatttgccgcggcaaaagacaaaagaccgtacgaagaaattaatagggaaattgcgaaggaattgggcgtaagcattcgcacaatttcactgtggcaaagggaattgggagtcggtaagttaaaataacaaattttaaagaaaaaatttaaaaattaacaattttattttcgctaagaaatggtatcatgggcttttcgtggtgcttattgtgaacactaatctgatttcaagtcgtttgtacttcaaaaaaaaaaattttttttgtattttattccgaaaatttaaaaaaaatgaatttagatgacgtaacaacataaaacaaagttttacttcatgctcagtaccatggaacccattctttaggattggctaattctttataaagaaatatttcttgtttttcatatctttgtgtctcattcattcgtgaatttcagcaaaaaataataattaaatatacggaaattttccataaaaaatgattttttaattttctaatttttcgtgagaaaaatcatgagaaattttaatttgaaatttctaatctgagaggctatcaagtctttcatttctaatccattcttttaaaagtcaaataagagaaaaagatacaactttctgaggagagggtcaaaaaacatttctaaactcagtatttgttttaatgacgaacctaaaaacaaaaaccaatctacaaataaggcttatatttttagcctctaaaataaa

SEQ ID NO: 65759 - DNA, 387 bp, Heterodera glycines
  Genomic contig location: Contig_ID=SeqID_36453; Location=493..879; Strand=-
  SCN-specific regions: Sequence locations=1-97,119-222,244-354,383-387
atttcttgcagattgaaagccatccatgcctgccggtctcggcacagcaaagcactaatagggtgtttgactcacttcaaaaaataattccatacccaaaagttttttacaaccacttattgccaatataatttcttgcagatttaaagctatccattgcctgccggttctcggcacagcaaagcactaatagggtgtttgactcacttcaaaaaataattcattacccaaaagttttttacaaccacatattgccaatctaatttcttgcagatttaaagctatccattgcctgccggttctcggcacagcaaagcactaatagggtgtttgactcacttcaaaaaataattcattacccaaaagttttttacaaccacttattgc

SEQ ID NO: 65760 - DNA, 891 bp, Heterodera glycines
  Genomic contig location: Contig_ID=SeqID_36454; Location=80..970; Strand=+
  SCN-specific regions: Sequence locations=1-49,156-452,474-584,606-891
atgaggaggaggaggaggagaagaagagggcaacagcaacaacaacaaaataataataacgatgacgaagacgatgatgataatgatggtaacgaggagggagacgacgatcacggtcatgatgctgataatgaggaagaagaagaagttggaacaaatcggtcggtcagactttgctttttcgacgctgaaacgtcccaagatttgccacttcaactgcgtacaaaggttgtacagaaacatgttccgatgctcattattgccgaaattatctgcgaagcgtgtataaatgaaggaatttcggttcattctggtgttggacaatacgcaaatgggtgcgtgtgcagtcctcctgcgggaccaaggggacgtcgctggtgttctcctccgtttctgaatgcacctggggatgacagtgctctaccagccaatgtccactacaatccacgaagactgtttttccatagttttgacgacgctaccaacaatgacccggtggatgattttatcaattttctcatcggaagtggcccacatggtgttaaaacaatttgtttatcacacaatggcggaaaatacgacattcatttaatactggaggcacttcaccggcgcaatttaccaccaaagcgtatttgcacaacgggactaaaaattttttcgatgactttgaaagggaaccatcaacgacacgtgatctttaaagactcgctgaactactttttctgtgaattggatgcactgccacggacatttggattgaacgctgaagttgcaacagcaaaaccttttttcccttatctgttcattcggcgtgaaaatttacatcaaagattgcgtggtttaccggccaaagaattttatcagcctgatcacatgaaagcatcctag

SEQ ID NO: 65761 - DNA, 223 bp, Heterodera glycines
  Genomic contig location: Contig_ID=SeqID_36455; Location=240..462; Strand=+
  SCN-specific regions: Sequence locations=1-223
atgcagaaggcaccacgtcatgaacagatcgagcacgaacaacgaatggtgaggaaaggtcaacaagaagcaaatcgacatcttcaaccgaaaaagcggcagcaaaaagaaattcaagaagtgccacattcaacaacagaagagcaacaacgagaaaccaaacgccaacaaatcgaaagacaacaaaatgacgaacaacgtgccatcaatcaacaaacacgca

SEQ ID NO: 65762 - DNA, 56 bp, Heterodera glycines; identical to SEQ ID NO: 52733
  Genomic contig location: Contig_ID=SeqID_36458; Location=475..530; Strand=+
  SCN-specific regions: Sequence locations=1-56

SEQ ID NO: 65763 - DNA, 621 bp, Heterodera glycines
  Genomic contig location: Contig_ID=SeqID_36459; Location=339..959; Strand=+
  SCN-specific regions: Sequence locations=1-621
atgtctctccccgtcccttggctaatgaaagtgttttctgttgtggccaatcactcggctgtccggcaaatgtctgttggccatgttttcggctctattattctccagttggccacatacgccagcccaacacaggtggttttgcctatgagtcggtcggtcggttgtccaatggccatttggccaaatgatcgattcgcttgtcatccgtcgtcagatgtatggccatttcgaagtttgcaatttgaaatgaaagaaggcatcgctttgatatatttatgataagctttaacaatgtttataagcgaatgcttttcggatttgtgctgaatttgtaaatggtcattctgtaaaattcaaaaagtgctgaaacgaaagatactccaattcatgcgaattttgaaaagcagtcatcaaaaatatccgtaaaactttgaccaactcatttttgaccaacttatttttattgttccaacccattgtttttttttggattggaacgtgaaaatcgaggtcaaatcgatgaattttgaggatttttttggtgtttctcaactcgggaatgcttttttgtagacaattggccgcgtttctcgccgtttaacaattttatcgttaaaa

SEQ ID NO: 65764 - DNA, 472 bp, Heterodera glycines
  Genomic contig location: Contig_ID=SeqID_7729; Location=1609..2080; Strand=-
  SCN-specific regions: Sequence locations=1-281,323-472
atgtacactaaaaacgtgaaatacaattcattttttggtttttacacaataaaacgtgaagtcgcgattaggtaattttctgtgtttttgtacactaaaaacgtgaaattacaattttgtgggtctaaaacgatttaacctttacgtgcacttgtacacaagaaaacgtgaaatacaaattacaattcatttttgggcacttttacgtgcacatgttcactaaaaacgtgaaatacaattcattttacgggattttgcacaagtttttcaggtaaagaatgaaaaaaaataaataaactaaaaaaataaatatatttatttagctccaaatatcatgaaataatgaaaaatgaatttccttgtgtcaaatttttgctgtgctcaaataatcataaaccgccggtcgttgttgtatccgtgtcataatattatgaattaagaatttagtttttttagcaaaattatgaataaa

SEQ ID NO: 65765 - DNA, 127 bp, Heterodera glycines
  Genomic contig location: Contig_ID=SeqID_7729; Location=705..831; Strand=-
  SCN-specific regions: Sequence locations=1-127
tacggtaggggtcaactccgtctggccaactccgtctcagcaatgttcaaaaagctataacttttttctttgttggccaaacttcacaatcatggtatcattcgaaagccctagatgtttagaagat

SEQ ID NO: 65766 - DNA, 767 bp, Heterodera glycines
  Genomic contig location: Contig_ID=SeqID_7730; Location=1410..2176; Strand=+
  SCN-specific regions: Sequence locations=1-354,376-767
atggctttgctgaactcagttacatcagtcaggtgccgtacagcagaagtgtcactcgcagcaattatcacactcataatcagagtgatcagtctctattctctcaataatcatcattcttttgtctatctcatttgtcaatgccaatcagtctcagcactggtcagaatactcgctgatcagtcacttattcaattcgctgatcggattaaaggtcgtccatcccatttcaaacagaagcgtggcgtgtcaaatttcgtttcttcacccttttgccttttttttaaattccttcgatttttcctactcgaatttcactttttattacacaacaaagttgaaatatcaactttaaactgtccttttggcctttatccgattgctttccgttggcggggggacaaatgcctaaaatagggaatgccaattttgtttaattctgtccgaaatttcattttgcatttgcctttcagcttcaaattcgcgagtgccggattggccgcattgacgagggtgccctcgggggactgttcacggtcggctctgtccaacttcagtccaaccaaattgtgcgactgtcgcccggttggtcttccggcatggacaatgttggcaaattggtgttcacttacaacaccgtgcgtgagccgatggtgtcgccagaatgccttcggcacgacggcgcacagcgattcgaatttgcggacaatacgctgcactgctcatgcgcactccaatggatgatcaacgcaccggaggaggagcag

SEQ ID NO: 65767 - DNA, 1188 bp, Heterodera glycines
  Genomic contig location: Contig_ID=SeqID_36462; Location=1..1188; Strand=-
  SCN-specific regions: Sequence locations=1-215,240-338,364-744,767 -869,891-947,970-1188
ctatataagctgtgtaaaatcgacccacaaaaaggggcactttatgatagcattagtttacacataaaaatacaaaacaaaaaaatttcattctcaacttgaacaaaaggctatttcaaagggaaaaaattcaattttttaatatatacaaaaatatgatgttaatccctttgaaatatcgaatttggtttctgaaaacaaatgctatcataatgaccaagaaaaatgtgaattatttgccaatttatttgtaaattcgtttaacaattctgaagttgatccaggctttctaagcttggacaacacttttgttaatcaaagctttatatcagatatagaatttaacatcattgagacccaaaaacttttaagaaaacttccgaataaaaatggaacttctccggataatattagctataaaacattgaaaaattgccatccttcattagcaactgttattactgaccttttcaggatttcattagactctggttctcttccagatatctggaaggaatcaatagtttttcctcttttcaaaaaaggggacaaatttaatcctgaaaattataggcctatttctataacctgctcactttgcagggttatggaaagaattcttagccaaaatatttacaactttctcctaaaaaacaataaaatttcggaataccaatttggttttgttagaaataggtctacgacaagtcaactaataacagttgtggaagattggtatgatgcaattattaatggaaaaaatgcggactgtatttatattgattttcagaaagcttttgactcagtgccccataacttacttttatacaaattggaaaaaattggtatacggggcaaacttttaatgtggataaaaagctttttgagtaataggacttttcgtgttaaaattggggatgctttatcctcaaataaaaaagttggctctggtgtcccccagggctctgtcctgggccctttactatttttgatttatattaacgatcttcctgatgctttgccatcaggagtgaaaataaaattatatgctgatgatgttaaattgtatatatgctataaagcaagagcagatacagaaattatgcataaagcattgcataatttatcagaatgggcaaataaatgtagaaagaaaagtttcagttcaaaaaacttttgtattatatt

SEQ ID NO: 65768 - DNA, 231 bp, Heterodera glycines
  Genomic contig location: Contig_ID=SeqID_36468; Location=119..349; Strand=+
  SCN-specific regions: Sequence locations=1-231
atggcagaatttacggaaaacttagaacagaagaatagaaggggtgccaaaggattttacgttgaccctgcccttgaattacggtttttgtccgcgggcgatcgaaacttcgaactgatcagacgataccgctttcctgatgaagaaattgatttcatttcaagtcttgtaaaggatgaccttcagccaaaacatggcaataaaggaaatccaattcctgttaaactacag

SEQ ID NO: 65769 - DNA, 413 bp, Heterodera glycines
  Genomic contig location: Contig_ID=SeqID_36470; Location=47..459; Strand=+
  SCN-specific regions: Sequence locations=1-48,155-413
cagaaaagaaaaaattggaggaaaaaacatttgacgaaatatttggagaaaaatgggaacaaaaagaagaagaaaatggaaataaccaaaataaaaatgaacagaaaaagcgagaaattattgaaaaattcaataaaattaaagagaaaattaagcaaaaagggggaaaatattcaaaaaacgaatgggataaaattaattcgaaaatagcgaaaacattggggacaaatcgccaatacatttacgaatggatcaaagaattacgattgtacaaatggcacaacaaattgaaaacggatgaacaaaaaattgaatgtgtgcaaaaatttattacaatgaaaaatgaatataaacaaaaaggaagaaaatactcgaaaaaacaatggaacaaaaattatgcagaaatgtgaata

SEQ ID NO: 65770 - DNA, 546 bp, Heterodera glycines
  Genomic contig location: Contig_ID=SeqID_36471; Location=220..765; Strand=+
  SCN-specific regions: Sequence locations=1-231,260-279,356-366,423 -428,456-498,521-546
  Gene Ontology: Mol. function=structural constituent of cytoskeleton; Cellular component=insoluble fraction
atgactggtggctttacaattgttctgttcgattcttcataccgaggcggtgactcaagtatcggtgaaggttttggtggtgttttttgtttaggaggaggtggtggtggttttggaaccgttttcgcgggctttagcttagacgcgggcgtagtctttacgggagaaggctgttttactgctggtggaggagaactaggtttgaccagcggaggcggtgtttttgtcctggtagtagtggtagtagtagtagtggtaggaggagaagccgttttagatggaggaggagaaggaggagaagccgttttagctggaggaggaggagaagccgttttagccggaggaggaggagaagcggttttagctggaggaggagaaggaggagaaggcgttttagctggaggaggagaaggaggagaaggcgttttagctggaggaggaggagaaggcgttttagctggaggaggagaaaccgttttagctggagtgggtgttgttactgatttagcagtaggtgttggaggagcaacaggagcaatcggttga

SEQ ID NO: 65771 - DNA, 1042 bp, Heterodera glycines
  Genomic contig location: Contig_ID=SeqID_7731; Location=1197..2238; Strand=+
  SCN-specific regions: Sequence locations=1-151,173-1042
  Gene Ontology: Mol. function=glycine-inhibited chloride channel activity; Cellular component=integral to membrane; Biological process=cell surface receptor linked signal transduction
ccgcttccgtcttccgtgttggagccaatcctcgaccgaggcaactacgacccgcgcagtgcgcccgcctttgtggaggggcgtccggtggaagtgcgcgttggcatccacgtgcaatcgattgccaactttcagctggccacaatggttgcctttttgtgtctttcccacttcaatccctcccccccggcttcaggattacgacatggacatgtggtaagtaagcatcaatcacttcaaaatgccattgatccttctgaggttgcgcatgagttggcgcgacccgcggttagcgcaaaatctgagcacgcccgttctaatcaatgacgagcttttccttcggtttgtccccacttttggtggcccttttttgcatttcgtcacatttccaagtcgaatttggcgtccggatgccttttttgtgaatgcccgtgacgcgcttttccatcgcgtgacgcgtttaaacttttacgcgtttgtttttccgactggcggcgaagtgttcatggaggcgcggctgtacttgaagccgaagagccaattggttctctgcaaatacccacacgacagtcagacactgcgactgcgcatcagttcaagtgggagggcgaagcaggggaaggcctactgattagagcaatggctgatcagcaggccattcgattgatagccaatcattgggcattttcatggtcggaaaatcatatttagtccttaattacctcaagttgcttccacctacggttcggtgcgctttcgttggttttccgccccttccaatgccatccgggtccatggacagctccaactgcccgacctgtacatcgacgggttgcaaagcggagagtgccgcagtgcgagaaaaaccggtgaaaagggagcggagaagcaaatggacaagcgaaactcattttgttgctgattaaggcaacttttcttgcttggaagcgcgttttttgatgaaaaggagcatcggataccatctttggcagacttatgtgccgacagcacgtgaatgagggggggggggggggggaaaaaa

SEQ ID NO: 65772 - DNA, 1023 bp, Heterodera glycines
  Genomic contig location: Contig_ID=SeqID_7732; Location=1..1023; Strand=+
  SCN-specific regions: Sequence locations=1-231,255-626,649-1023
  Gene Ontology: Mol. function=extracellular ligand-gated ion channel activity; Cellular component=integral to membrane; Biological process=synaptic transmission
ggggggggggggggaccgtaagggaagaaacaaaaggtatcaaatttgtttttgttcagagattgtcaaagacaaggacgggatcagtagaatcactgatagctactgcttttctttctccgttaattgcctctccccactctctttctgtctaattaccgttaattgcctctccccactctctttctgtctaattaccgttaattgcctcctcataccacggttaatccccgcttcctccctccctcctccataggcgttttgttctcttggatcagcgtttggctgcccgaagagttcgtcgaggggcgcgtgttcgtcgctctgaccgtctttttgacattgagcgctgagagcagctcggccaaagagacacttcccaaagtgtcctatgtgaaggccatcgacgtttggtttggcttcaccgccgtttttgtctttgtaagcgatgcgaaaaaagtgagcgaaatcatttcgagagagcaaaccaaacaaatcttctaaggacgggccgaaattcttaacaaaggtccctgcgcaattcggcacattttacagtcattttggccaccatttgaggaaaaaattaatcgttttacgattttactgcaaaatttcgtcgccgctaaaagccaattaatttgtaagcaaacgactctcatttcttcagttcacaatgctccaagcactgctcgtcatcggtttggaacacatgagcggtcgcgcggtgacaaaacaatgaaattcaaacgaaaaaaggttttaaaacagcgaaagactgtggtggaacaagcgggcgaactaagcgcgccgaaagcgatcattttgatgatggactgtcgccgttaccatcggatggcaaggagtttggacgactttttcaaggtgtatcagcaacaaacgatgtgcaacaatgaatgaaaaatgttgaataaggtgatgtacccggtgatattcgtcgtctttctcatcatttacattttcgtggtgatcgaaggagaagaacagaagtgtcttcagcag

SEQ ID NO: 65773 - DNA, 484 bp, Heterodera glycines
  Genomic contig location: Contig_ID=SeqID_7733; Location=598..1081; Strand=+
  SCN-specific regions: Sequence locations=1-199,221-306,331-484
atggcggacgaagcgtcggaatacactgacgaagaatacacatacgaatacgaggcaaaatgggggggggaaatagggggacatggaaaagggactgttaattgatgttaattgagacaaatggaaagacaaatagagagtgacagacatgagtcaacacagatagagaaacaccgacacagccaaatgaccactcacacattaattaattattaattaaggatgaggaagaaccggaagccaacgagaacgctgctcccgcgccagttgaagagctcgtaagtcgagaaagaatgccaaaatgggcaattttaaattttggaaattgcagccaaaggacgaaccgaaaaaagcgggcgaagacgcagcagcgaagaaaaaggaaacatcaccaccaaagtcgctgaagaaggaggggtcgccgccaaagtcgcctaagaaagaggcgagtccgaagaaagaggcgagtccggacaaatcgccg

SEQ ID NO: 65774 - DNA, 564 bp, Heterodera glycines
  Genomic contig location: Contig_ID=SeqID_7734; Location=176..739; Strand=+
  SCN-specific regions: Sequence locations=1-450,474-564
atgaagtccgagggcatcatccccatccaggccggcaccaacaaatacgcctcccaacgcggaatgaccggcttcggacggccacgtgacgtggtggacaaagtgaaaagtgagaatttggcagaaatcacagacgaagagaagttggcatcgctgaagggcaggtcggttgacagtttggccaaatgcgcttttttaaaaacattctccgtccttttcagtacttggcttcagtccggcaccaacaagttcgcctcccaaaagggaatgaccggtacggcaccacgccaattcacacatttaaacaacagttgatcgaataaaagataatggcactttaaggaattggaacaccgcgggacgttaattaccgcacgaaagggacgggaggggcgggcgaagtgccggaggacaaagcacgcttaacggacggtgacatggggaagggaggaaatggaaaggaacggaagccatttaaagggattgtgccgcttcagtcgggcaccaacaaattggcgtcgcaggccggcatgacggggatgggaatgccacggatcatcgacg

SEQ ID NO: 65775 - DNA, 416 bp, Heterodera glycines
  Genomic contig location: Contig_ID=SeqID_36474; Location=25..440; Strand=-
  SCN-specific regions: Sequence locations=1-376,410-416
atggcagggtttggaaacaaagtttgtcgaaaaaatcatccttatttggattttttggcccggccttgccgttaagggcacctaggaaaaaaattgaaaaattatgtcaaaaaaggacaattttaaaaaacagacggcttaacatactccataattttgatgctaattttatgtgaaaatagtctataattacaggcatgtttcgaccttttcatgccttatggaggccattcgcttgttgcccgctgcaaagactgtgtcaaatacagttgtgagcaaaagtgtgtgtacagtatcgagggatgccaacgctgcatcagagggaactgtgccaatatcggaatggccaacagttttggaacgttttgaaaaagcgaaattttcaaaaatttatttaatatttaaaaatgaataaa

SEQ ID NO: 65776 - DNA, 49 bp, Heterodera glycines; identical to SEQ ID NO: 51181
  Genomic contig location: Contig_ID=SeqID_36476; Location=765..813; Strand=-
  SCN-specific regions: Sequence locations=1-49

SEQ ID NO: 65777 - DNA, 656 bp, Heterodera glycines
  Genomic contig location: Contig_ID=SeqID_36476; Location=85..740; Strand=+
  SCN-specific regions: Sequence locations=1-656
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctcctcataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttt

SEQ ID NO: 65778 - DNA, 401 bp, Heterodera glycines
  Genomic contig location: Contig_ID=SeqID_36478; Location=348..748; Strand=-
  SCN-specific regions: Sequence locations=1-12,35-401
  Gene Ontology: Mol. function=protein tyrosine kinase activity; Cellular component=integral to membrane; Biological process=receptor guanylyl cyclase signaling pathway
ccctcccttccctttcaatttggcattccctcccaaattggcattttcagggccagcagtcggcggcgtcgtcggtctgacgatgccgcgctattgcctttttggggattcggtgaacaccgccagtcgaatggaatccaacggaaaggataaaattgtgggggataaaacaaatccattcatatttcatcgagttcaaatcgctttttgaccagcgtaatcgaaccaagtggcgaagtgattataaaggtaattagggggaattattttgctaattaattgcctaattaattcattagggcaaaggtgtgatggagacattttagttgttgggacgaattggcgaagtccatttgcccaaggggacatccgtagcggaaatgcgctgattgatgggaaaa

SEQ ID NO: 65779 - DNA, 436 bp, Heterodera glycines
  Genomic contig location: Contig_ID=SeqID_36480; Location=450..885; Strand=+
  SCN-specific regions: Sequence locations=1-61,83-319,341-343,365-436
atggtttcgtctcatttgttttgtattggtaactttatggttgtttttctggtcatgtttctggttttgtcttttcttttgtctaatcataacaacggtggaaaaccagaaattaatgaacagtttctggttaggctcatttctttgtctaaccagaacaacggtggaaaaccagaaattaaactgaacagtttctggtttggctcatttcttttgtctaatcagaacaactgtggaaaaccagaaattaaactgaacatggtttcgtctcatttgtttagtattggtaactttatggttgtttttctggtcatgtttctggttttgtcttttcttttgtctaatcataacaactgtggaaaaccagaaattaaactgaacagtttctggttaggctcattctttgtctaaccagaacaacggtggaaaccagaaa

SEQ ID NO: 65780 - DNA, 1265 bp, Heterodera glycines
  Genomic contig location: Contig_ID=SeqID_7735; Location=448..1712; Strand=+
  SCN-specific regions: Sequence locations=1-747,769-829,1009-1265
  Gene Ontology: Mol. function=structural constituent of muscle; Cellular component=sarcomere; Biological process=signal transduction
atgtcaaatagtttcttcgtgtttttgccgagtaatgtgacggattatccggacaatcaaccaaacaagttccgggtcaggcttccaaaacctttgcatttcaacgggtcttgggtgtgtgggctgcacagtattagctacccatactcatggtcaacaattggtacattggatgagcagtggatagacatccacttcacggatattggggttcctgaagaagacaaacaccgcatcgtacgcgtgccggtaccgagatcgtcacacaatcgggttgaacagctgagagactttttgacgacaacgctgagaaaccatgccaatgctaaactaaagccgcttcctcgagaggaagaggcggaccgtaataggacaaaaccactatattctccaccgcctgctaaaagaagtataaaagatgtgaatgatttgtctttgtttccttcacccccgagagttgatgagccggaaaagccgcctaagtctcctccagcacatgtaccacctactgaaccggtaactcctcctccggcatcacccccgagagttgatgagccggaaaagccgcctaagtctcctccagcacatgtaccacctactgaaccggtaactcctcctccggcatcacccccgagagttgatgagcctgaagagttgcctctgccccttccagcacatgtaccacccactaaaccgataactgctcctccggatcataaactagaatcaccacctccaactgtaaaaccttcatcttccccacctgatacaacgctcccttcttcaactccagttgcaactcaacctccggcacccataccacagccaactcctcccaaaccttctgctcctccccctgcttcaacacctcccaaaccttcagctcctcctcctactccgacggctcccaaaccttcagctcctccccctgctgcaacacctcctaaaccagcatctcctcctccccctgttccgacacctcctaaaccagcatctcctcctccccctgtttcaacacctaaaacagcatctcctcaaaaacctcctaaaacgaagctagctcctcctccacctccagcacaaacacagccatctcctgtcaagaccacacccgcatctaaaatattgacggctaaaactattcctagaccccctcctcctaagcaaaaaacgtcgcctccagaaattcctacacgaccatcaatttctccaacactcgagtctccgcctcggattgatgagtcgaatagaacaatagtaaagcc

SEQ ID NO: 65781 - DNA, 227 bp, Heterodera glycines
  Genomic contig location: Contig_ID=SeqID_7736; Location=2643..2869; Strand=-
  SCN-specific regions: Sequence locations=1-227
aatccgaagaaggaataaaatgacgccaacttttttggaatacatgtttatcgttatggaaaaaatgaaaataagtgtgccttaaatagtgatgtcagtgctgatcgatcgattcttatccaacatcaccagcgagtcgcactcgcccatcaccaccaacattattcctccagcgggcaccgcctgattaaatttgatgctcactgctgtggtcccgttccttatca

SEQ ID NO: 65782 - DNA, 534 bp, Heterodera glycines
  Genomic contig location: Contig_ID=SeqID_36484; Location=304..837; Strand=-
  SCN-specific regions: Sequence locations=1-49,71-217,248-277,309 -338,370-534
atgagtgaacgggtaaattttttcctaaattcattaaattttcaggttggcctgcatcttcctggcatctgttccgaatatgtgcctagtgcaattgaaagtttcaatgccagcgaatttgaaggtgcattttaaattattaattacaatttgaaggattaatgccaattttaattggaacccacaatttaaaattgctcaatcaaattagcaatagataaaatataaatatttaattaatttaaaaggtgtcgaaattgagggcctaattggcgtcaatattttaattaattattttttaattaaaaggtgtcgaaattgagggcctaattggcgtcaatattttaattaattattttttaattaaaaggtgtcgaaattgaaggcccaattggcgtcaatatcactgcgctgttggcagccggtgtcaacttgacagagttggccgaaaaattgcgcaatgatactgaagttgatcagattttgtctcgcactcaggacattaatcggtcggttgtggctcagcataattaa

SEQ ID NO: 65783 - DNA, 622 bp, Heterodera glycines
  Genomic contig location: Contig_ID=SeqID_36488; Location=76..697; Strand=-
  SCN-specific regions: Sequence locations=1-194,217-622
atgaataaaacagttttcttaatactttttggtttcgcaatcggccaagcaaatagcgattgttgttgcctatctaatgaagaaaaacagcaattgaatgctgcgagaaaaaccattgaaaaagcatttcgggatacgctcagattaaatactgaagcccgagatttcgcggctgcatctcatagggcaattacggaggcagaaaaaattaaagttcgtcatcctgaggcaccgagtatgaaaacatggttcggtaggctattagaaggggtgagaaaagtacaaggaatttccgaaaaaattaacgaagaaaaaaagaaaataggacacattagaaaagaaatggacaagtgtttggaccgaaaagatgtgttaatatgacgagaattggctgacgaagcaaagggggcatttgaaattgttaagcagtatagacaagacgtcggtactgcgtaccgtaacgcctatacacaatctgacctcgggatcggggaattggccgaaaaagttaaggaaatgcttaaagaatatttatcccgccccggaccctccccaagacctagctttaatgatgaatttatatctgcttaatgtataaaagagaaaaaaagataataataaa

SEQ ID NO: 65784 - DNA, 338 bp, Heterodera glycines
  misc_feature (95)..(95): n is a, c, g, or t
  Genomic contig location: Contig_ID=SeqID_36489; Location=633..970; Strand=-
  SCN-specific regions: Sequence locations=1-61,83-338
taaaattcgtttgaaatgccaaatttcgacccgaaaatgccgtctccgtttcgccttccatttttgctgctccttttcggcactttcctttggtntgcgctgttttctcccatttaaaggcttatttcgccctttgtcagtttcgtcccctttttcccctcttcggctgcccaaaggttcgccagtcagtcgaagcagcagcgaagtcgccaaatccgtccgtttcgacccctttttaatggccaaaaaatgccgaagttttgcagatgcccagtcccaaattgtggccaatctcttcgccaattacgacccgaaccaacggccccccgtccgaggtc

SEQ ID NO: 65785 - DNA, 446 bp, Heterodera glycines
  Genomic contig location: Contig_ID=SeqID_36490; Location=185..630; Strand=-
  SCN-specific regions: Sequence locations=1-56,78-219,277-383,405-446
atgccgagcactagacaagatggtataaaaacaaatcgaataaaatgaacaatgtcagcagaaatctttgaaaatgaaatgaatcggtggagaatggagcaaaaagcgtggaatttaatgattggtcaaaaacgatgacatgctcagagagatgaaagccatttggcgatagaaatagagaaggaaaagaaagaaagaaaaaattttaaacaaaacgccaaaaaattaaaaaatatataaaacaaaaacgccaaaaaatttaaaaaataataataactagcgcaggcggcgctatgtaatttcgacactgggtaaattcgacactgagtattttcgacactaagtaatttcgacactacattttcgacacaaagaaatttcgacactgaagtatttctaaatctttcactgttttcctgcattttcgagttagtatttataataaa

SEQ ID NO: 65786 - DNA, 190 bp, Heterodera glycines
  Genomic contig location: Contig_ID=SeqID_7737; Location=703..892; Strand=-
  SCN-specific regions: Sequence locations=1-159,181-190
atggaagtttttaagaaacgcactatcattggccagaacagtgctcgagattctaacgccgatattaacgggattgactttaccattattgttgttcgacctcaaccttgggccaactctcactctcgactttattggccaaattatcgattctatagtgatcaggaaaatgttctaaaacttaggcctg

SEQ ID NO: 65787 - DNA, 91 bp, Heterodera glycines
  Genomic contig location: Contig_ID=SeqID_7738; Location=1059..1149; Strand=+
  SCN-specific regions: Sequence locations=1-91
ctaaaaatccaggtgctctaaaaatggaagagctcaaaaatatcgccattatttttttgtaatgccaaaatatttcgtaaaatttgtatga

SEQ ID NO: 65788 - DNA, 1356 bp, Heterodera glycines
  Genomic contig location: Contig_ID=SeqID_7738; Location=1199..2554; Strand=-
  SCN-specific regions: Sequence locations=1-652,687-1001,1023 -1148,1172-1356
atgtgggccacaacaaatgccgaagaatattatggcgtgccgttgggctcacttcgcaacggcactcttggaatttctggcaatgtttggctggccaattccagtgccattcaaatcaccgatttcaaattggacaaaaatcaaagtgtagatgggttaggggatgtatttttcacaaaatttcaattttcatttgcctttaattttttggcacttttggttttcatcctaaaattttgcttcgcttcgtttttgatttttttaatgtggcaaatcgtgccgacttaattcagtcagactttcgatcccaaaaaatgccaaaaatcggaatttctagcccaaaaaatgtcagaaatcggacttccgtgccaaccctgctgtgtaacatttggcatattttaacacaataattgtaattggcacttttttgagcaaaaaaaaatctttggcaccgccaggaccttcccttaaaaaatttcttcttattttcaacaaaattttgcatgaatacaatttttttgctcattttaagagcatgaaactctgttcgcgttcgcctcgcctgacgcaaagattgaagcagtcaaatcgctgtacaaagtgatcactgatgataatggtgaagaagcactgacaccaatgtcggggtgggtttaattttaaaaattttaattacataaatatatcctactctaaaaattgcaaaattattactgtattgaagcaaacaaaaattcctgactcctccccctgaataaaattatataatatcttttgttaaaagatttcatctaaaatcttagccgcctaaagatttttgtcgacaaatttcggcattttcttgagtgccgaatttcaccagaaaattacaaatttttatgcattcttatcaagctaaagttagttcaaaaatcatgcccacaccacattttttttccattgaaaatttaaaatgccaatctgtgagagccgctgataagtgatcacgaattcagcacccgaaaccaaacaaaagtcaataagttttcttttccttcgaaattcctattttatggttgaaaaccaaatttatgagaatcgcttattgtcagtctaaatgggatgccggattcgtgatcagcggccatgaaagccccccatatattggcatttttatttaaaaaaattatttccctatcccctcgggcatcggcattattcagaaagaaaaagcatttgggcgccatcagcgaaacggctgaagagccgcagcaacgattggtggtgatggcaccggccggcaaaagcatcaacgattttggacagtttggcgtagtgaacggcaaaacgatggtgtgtttgtttggcacaaattag

SEQ ID NO: 65789 - DNA, 645 bp, Heterodera glycines
  Genomic contig location: Contig_ID=SeqID_7739; Location=627..1271; Strand=+
  SCN-specific regions: Sequence locations=1-263,371-410,433-645
atggattggatttgcactgatcactttgtttgttcagtcagggttaagcgatcgctttctgctctgcttatcattcatttatccctttgcacattcattctctcgaataccttttgcacatcaatcatttgggcatttttctgggtcatttaaaaccgatcagaattgatggatatgagttgatcttttttttcgacactgatcagccatcattttcttctccgtttctgcacttttaatcagtatcaattcgaaagtgttacaaaaaaaaaataaaatagtaaaaacggaaaaaataattaaattagattcgaataaaaaatagttttttttttcaaaattttcttagtttgtaaaaataaaataaaatgaaatttgagactatgtattttcagtgccttccaaaagctaaatattttgtttttcaaaaaggagttctatcatcgaagtattacataacgcccttgaaacccgaaaaatgggcaaatttttgaatgtcaaataattcttttaccgttacaataggtattaaaattataaaaaatagttgccagcatcaaaaaaatgctcaaattttgcatttttggtgttgttgcacaaaaagccaacaatcggcgtagatgaaacggaagaaaaaggaaaaca

SEQ ID NO: 65790 - DNA, 838 bp, Heterodera glycines
  Genomic contig location: Contig_ID=SeqID_36494; Location=26..863; Strand=-
  SCN-specific regions: Sequence locations=1-288,337-838
accgaagaaattctgccgaccgtaccgccggtgccgggcattgatttggacgactactgtaagcagattcaacaacgatttggtaacccaaaaaacggtgacacaattcgacgactgtgctttgatggcacaaatcggcagcccaaatttattgtgcccaccattgagtattgccttaaaactggacaaagcattgacggattggcattggtaaaaaaaattgagaatttctgagattaactttttcaagatagatctagtctttggaccaatcaaattgttaagaagaatttaataaataaaataatattaattaaatattttatttaattttttgagaaaaatagtaaaaaaaacctgtagatacttaatgataatgatttgatcagatctaaccacatttagataaagggccaaaagttagatattaaataaggccattaagaagctgacctttgcaaatttactaatacttttccaacatttttccaggtttgcgcactatggtgccgctactgttatggcaccgaccagaaaggacaagcagttgagccaaatgacccggcctggccacaacttcaggccatcgcatcccgcgcccgggacaacgatgagccgaccgtttggctgtctatggaacacatttatggcagtgttggccaatcagacgcatttcgtgtcgtttttgccaaaacgcttcgtcacctgtggcaatttggcaccgaaagtgcgctgaagcgctatttgggcaacaaagcaagtcaatgaatgctgcgataattatgatcattttcggatatatcattgaatagaccatggatcttaaaaaactaataaa

SEQ ID NO: 65791 - DNA, 730 bp, Heterodera glycines
  Genomic contig location: Contig_ID=SeqID_36495; Location=216..945; Strand=-
  SCN-specific regions: Sequence locations=1-647,670-730
atgagcgacaagcggggcttgctccgacaaattcttggcgaagcggaaattaccgtgacaacatcgggcctgacgattagcggcccccgtctgtccactccacggttcctgccgtttgacgagagtggccgctgccgctcatgtaaggcaactgaagtggaggtcgacacaatggttacgaaggagggggtcacgatttggtgcacacgcatcgacaaagtccaattcgtgccattcgatgtggtctacgaattgccaggtcactgcttcttccgactgaaaaacaagtcgcgcgtgttcaaccttccatatggcgacctgccctctgagtcgtgtgaaattccgctaattcaacacgtggacgaagaacgggacctcaagcgaaaggcaaaagctgcgctcgaattggtggaggccggactgattgcggacagcactgtgcaggacggggcccgtttgaaaaaagccaaaactgcgatgaaagtgatcagtgacattctgctctctgaaccggtgggagatgatcaaaagaagacggttgaagtggcagttgtcgacaagcagccacaagagcagcaaccagcccctgtacaagagaagcccgtcacggcacccgctgtggaacagaacactgttgaagtgaagacggaagaagaaaagaaagatgatcttggtgacattgacaaaacactcgatgaattttttgcgagccttaaagccgcaaccacca

SEQ ID NO: 65792 - DNA, 419 bp, Heterodera glycines
  Genomic contig location: Contig_ID=SeqID_36496; Location=72..490; Strand=+
  SCN-specific regions: Sequence locations=1-385,407-419
atggctcaattgaaaaaagcacggcacgaatatctggagctggtgaaagtgtttatggacgaattggaagaggcggatttgtttgaagaacaaaatgtggcaagagtgtgcatacacgaggccgggcacaccctcattttgtggttcttaagaggatcggaaaaatttttggaggtaattgaaaatatttttgtacgaaaataagctttgtcgattagatttgcgtagtgccggacccaaacggagactatgatggctacacggcgagtgagccacgtgccgaaagcacgcgcagccagattatggcagaaattgcgtgctattatggaggcaagttagcggaagaattattttgcgagaaaagtatcggccacagcgacgacatgagacaagccaagaagctgaagaaatggcgttaa

SEQ ID NO: 65793 - DNA, 2757 bp, Heterodera glycines
  Genomic contig location: Contig_ID=SeqID_7740; Location=891..3647; Strand=+
  SCN-specific regions: Sequence locations=1-44,66-371,393-1534,1556 -1603,1625-1691,1715-1756,1779-2757
  Gene Ontology: Biological process=DNA replication
atgtatccggtagagaaccaaggacggggactaccgcacatccatttgcttttgacattggcggagcaagacaaattgattaatggtgaagatgttgaaaagaaaggaattagtgcgagaataccagacaaggaattagaacctgatatgtttgatttggtgaaaaggtttatgatccatggcccatgtggtaatttgaacccaaattgcccatgcatggaagagtttgttgacaagaatggtatgagcggaaggaaatgctctaagggatatcctaaagcatttcaagaagagacagttgttcttgaaaatggtttggctgggtatgcaagaccaaatgatggaagaatagttgaagtatttgcaaatggaagaagacatgtattagacaacagatgggttgttccgcataaccaatacctgttgaaaatgttcaagtgtcacattaatcttgaaaaggttaatagtgttagttcagtaaagtatttgcataagtatgtgcataaaccaccagacagagcaagacgggaactagaagagaaaaatgatcatgatgaagttaaagagttcattgatgcgcggtatgtttgcccgcaagaagcagtgtggagaatttttgaattgcctatgtatgatagaagccattgtattatgtccttgcctgtacacctacaaggtgaacatatttgttattttgacgagaatatggaagaagaagagattcgtgaaagaattgcgaatggttctgagttgatggcatattttgaattgaataagacaaatgttttggcaaaaactttgttttatcaccagatacctgaaaagttttgttttaagaaaggaaaatggacagagagaaagacatattttaacacaattggccgaatggtgaaggtgtcaccggctgagccggaacgataccaccttaggctgttgttgttaaatgtgaagggagcatgctcctatgatgatttgaaatcagtttttgatactaatggcaatgctaaagtttgtgaaactttttcagccgcatgtttagaaagaggtttgattagaaatgatgaagagtggaaaagagcattagaagaagcagagagttttgagatgccatggaaattgagagcgttttttgcattgattttagtccattgcaatccggccaaaccggaagcgctttggaatatgtttaaagactcattgtctgaagattttagcaggaattttagaaaagaagtagcttatgctaaagcttatagagaaattgcacttagcattatgaaggctggaaagacacttgccgattttccaaccatggaacagataaatgttgatgatgatgttgaacaagtgtttgacctagccgaagaattggatttgggacaaagaaattatgctttgatgtatgatgaacagaggaatgtttgtgatgccattttgcatagaatatggaatcctgtaaatgaacccgcgttctactttcttagtggaccgggtggaacaggaaagacacatgtgaacaagacaattgtacatatgctgagaggtcagaagaagaaagtttgtacaatggcttttactggcatcgcagcaactttgctgcctgctgggagaacattgcacaatagatttggattgactttggatatgagtaattcgagtattagtccgaggtcaaaggcatggcaagagttaaaagaaacagatttgtttgtttgtgatgaagcgcctatgataaataagcgcgcaatgagtactttggatgagaaattgaaagagataatgaataatggaatagcatttggtggcaaggttatgctttggacgggagactttcgtcaaacccttccaattcagaaacatgccacgagagctgagatggttagttcgaccataaagagaagtgcgtactggaggttggctaaaagatataaattgacgaagaatatgagagctcttgcaacggagcaagaatttgcgagagatttgttagagattggcagtggaaaatggaataatgaaaatgatgagataattttgcccgaggattgtattagcaatggtgatttagcagaagagatttttggtcaatgcattgtcttagaaaattggaatgaaatggcaaaaagtgccattttagcaccgaagaatattgatgttagtgaaatgaataataaagttttagaaatgttgcctggagaagaagttgtgtacacgagtatagacttagctcaagatgagaatagacaaagaccagatgattatttggatgagtatttgaatgctttaaacccttcggggtttccacggcataagttgagacttaagaaaaatgctattgttttgttaatgcgtaatttgaatatagaaatgggcctttgtaatggtgcgagaatgaaagttgagcaaatgcaaccgaatttgattgtgtgtgagattttgactggagataaggcaggtcagactgtgtacattcctcggatcacgctttgctgttctgaagattacccttttgaccttcacaggcaccaattcccgttggtgttagctttcgcaatgacaattaataaggcccaaggccaaacccttgagcaagttggcatagatttgagaaaagatgtgtttagccatggtcaattgtatgtggccctttcgagagcaagagcttggaataagttgagaattagattagatgatggcaatttagagagaaaggtgaagaatgttgtgtacagagagttattagataacagtgattag

SEQ ID NO: 65794 - DNA, 638 bp, Heterodera glycines
  Genomic contig location: Contig_ID=SeqID_7741; Location=1405..2042; Strand=+
  SCN-specific regions: Sequence locations=1-193,215-231,261-361,383 -435,480-638
atgaaaatatttgtcaatgacaaagaagcatgggaagatttgatcggatttgtatcaacagataaacaacaaatcattgacacaaaaatcatttttgaaaaaatcaaaaattctccaattctcagcaacgaaaatgaacaaaatcttgcgacaatgttcgtgcatttaaatgcgggaactgcgataattacgaaaataattaaatgtatgggtttggtatattttaaacacaatttaaatattttaaaaaaattttaattggggctcgacctagaccggatcgaggtctggatttttgttcaggaaatccaggtccaggcatttttcaaaatttatcgagctctaattttttaactattttcccattttaagcaaacagtttcaccaccgcaacaacgacactcatggcaacaaatagaagacgaaaacgtatggataataataataacaaccaaaataacaataatggatataacaatgtgtatgaaatgttgcgtcaagcacagctaatccatggccgaagacgggtggccgataatcagcctacacgtgttgattgtgttgttgtggtcattattttagttggttgtgcgttactccttgattccttgtcgcaatatgttgttttccaattctga

SEQ ID NO: 65795 - DNA, 1164 bp, Heterodera glycines
  Genomic contig location: Contig_ID=SeqID_36505; Location=97..1260; Strand=-
  SCN-specific regions: Sequence locations=1-139,181-554,585-810,832 -905,935-961,983-1164
  Gene Ontology: Mol. function=zinc ion binding; Cellular component =nucleus; Biological process=regulation of protein activity, epigenetic
tctcgttgctcaactttttggagcctgaacagttcgccaattccgaggcttttctccaccaatttggccaatgccaaacggaggagcaagtgcaaaagttgcaggagatactcaaaccgatgatgctccgacggttgaaggaggacgtggagaaggaactgcagcccaaggaggaaacaatcattgaggcatgtgccagcggtgccaatgccaatggagttacaaccgcattccggcacttttcgctttagacgggatcaggatcccatgggagtttctcgggatccttcccgatcctttttttccttctacggcattaatcgggaccggatttcatcgggatccctcccgatctttttcaaaaactatgtatatataccggcattctggcatttttaggctatgttaggggtgtaaccatccgaattaaggcacgttgttggtgtgccaagggtatatccacctgaattaaggcactttttgggtgtgtcaaggggaaccgcccacttcggcgccggccttttcggcgccgttgctaacaacttttttcctgatcaaccaaattaaaaatttttgttataattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccaaagtgaccccgacccgtgtcaagggtgtacccacccacatttcgacagtttttaaaaaatttttggcaaaatgcgcaacttcggtaccacatttgatgtgtgggtgccacaaagacaatggcactactctgcaattttttgtgatgaaatcccctctaattttaaggtccaactctccaacatccagaaaaaatattaccgcgcagttttggagcgcaatttcacccatctgatgaagggctcaaccccgtcactgatcagcctgaacaacacgatgatgcaactgcgtaaatgctgcaa

SEQ ID NO: 65796 - DNA, 191 bp, Heterodera glycines
  Genomic contig location: Contig_ID=SeqID_36507; Location=193..383; Strand=+
  SCN-specific regions: Sequence locations=1-191
gtggcagcattttctctctcgacttccaccctagcggatgtaaactcgcaacagcaggacaggatccttctggtgctggtcttctgattgtgtgggatcttggctttctaaactgcccacccgattcgaaggagttcaattgcagtcaattaccattgacacgaattccccacacaagttgtacactttaa

SEQ ID NO: 65797 - DNA, 304 bp, Heterodera glycines
  Genomic contig location: Contig_ID=SeqID_36511; Location=169..472; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctatttcgcaccgccctccctatcatg

SEQ ID NO: 65798 - DNA, 2310 bp, Heterodera glycines
  Genomic contig location: Contig_ID=SeqID_7743; Location=124..2433; Strand=-
  SCN-specific regions: Sequence locations=1-197,220-1097,1119 -1236,1298-1731,1755-2104,2126-2310
ggttttccgtgtgaagcgccattattcgaacgattctgaggaaagcaaaaacaatgacaaaaagggtcacatcgtccgtcgatcgctgcccactcttttttccaaccgcgttattcccacacgcactgtgatcggattcagcaatttggcttacattgaggtacgtttcacactcattcttttgttatatcaacggaatatgaaatttgtttgaatttgtcaccggaatcatgtcacttttcgtagggtcctttgcaactcgtgcaaaagaaaaggaactgaatttttattttatttttgtgacaattaaacacaaaagatttgggcgtttcacttttgatagaaactttttaagtgtttaattggtcggttatttggtcattccaattttcagatgttgtccgaccctcgagagggtttcgtgttcagtgtccccgattttctccacgtggaggtcgacttcactgtgaaacggacgtattacgtgctcaaatgagtcatttcccatcgtttttaacgcttctaacattttgtaaaaacttttactatctctttttcgtattttttgtcattcatttatccttttttatccaaatccccttttaattctttccgtgctttcatttgcactttttctgaattgttttttttaccttttctcatttatccattgtatttacaacgaatttgaatttaattctttcacttttacaaatttattgttgaatatcaatgtttattgtcttttaaatccgaatgatctttgtaaatgtgttaattattcatttgttagattaaatgagcgacgatttgcgcaaagaattggagggactgaatttgtgcgctgggagaggccgacgacagcgggcgacagtcgtcaccgagtcgatgatcgacgacttctgtaaaattgtctataaggcgatgctcgtcacgcccgagggatacctttacacgtcggacattgcgaataatatttagtgagttatcccttcttttgtcgggttggcatccaaataaacatgggtctggttataatcagggattcttttttatgaaaatacatgttttttttcctggattctctatagcctaattgtaggaaaattttcttttttgtgtttgcgaacaaaaatcgggacttttatagtacttacatattttgggatttttctacatattttggactttttcgcattttttttgtacacattttcattttttgcatactttaagaattaatagaaatttcttataataaaaaaaaaaattttggaaaaatatatctttaaaaaaagcaatttttttctcataaaacagataccaaaaattaattcttaaagtactaaaatgtgattctaagcctattttggtccttttatggcatttttttgcctattttactttttacgacgatttttttttccaaaaataaccatttacatattttagtacatatttggggattttgtacacatattccatacatattttatttacatatttcgcgattttcttacataaaaaagaatccctggttataatataaatgaattaagagtgaaattatcaacaaccattttccaatattcagtgatgacattggcatcgacccgtacagaagggccttggacctcggcttcaattcgttcaacgccttcttacattcggaacacatgaaaaagtacatcgaaattgactcgacgggaaacgttctcaggtgcaacgcggaataaataaaaaacaaacaaaagtttttgattcagttaccatgctattttaacgccggagttgctcctcacaattgatcacattcaaagggagcggcagacttttttgagtatgaagcgcatgtaagcaattttggaggctttaaacgtcagacaattagagaaaactcctttttcataagattctatatcttttttagttacccctcgcgtcgtacaaatggattcaatcaatcggaagaaatgggtcctttgcagtttttgaaggagcgcatgcaaaagagggaattacaagcgcaaatgggtggacagacgcaagaggaagaggttggcatcgttttaaattaagtgggcgaggactaatcataaagcgtttaattttaattaatttgcatgagctcccatcttcagactcaatcggaaacggtgcaggaaccgtcgtttgtgatgaatgagggccaatacggaatcgaagaagagttttttgaagagattggcgaaaatgagcagttgggactcgaccggatcaaatgggttcagaacgattccgacgaagaaggcgaggaaacactcatttttt

SEQ ID NO: 65799 - DNA, 676 bp, Heterodera glycines
  Genomic contig location: Contig_ID=SeqID_7744; Location=33..708; Strand=-
  SCN-specific regions: Sequence locations=1-374,396-676
atgggaaatgagcctcaaaatcaaaacatctcggaactcattgacaaaattaagacgttaagacaggaaatgtgagttaaagcatatgaattttttaagatgatattttaattttagtcagaagtactcgtttatggtattggaggtgcgtcgtaacgaagtccttttgaaaaagaagaatgagaatttggtcattcaacttcaacggagtgaatctgcacggtaacttagtcaactttttatattttaatgtttaaaagttcagcaatgatttgttacggagcaacgaattactggaacaaaagttggctactcaatcggtggaaactgacgaactgaaacggcagatcaattcgctcatagagtcttgcgcaacagcaacttccaattgctttcgcaattcaccgtttaattctccgattggtcgtcgacagaagccgccattgttttcaaaacagaaagtcattgttgggttgtctcctcccacgcctttgccgaagccaattcagaagaccacaacattgacacagtcaggttggtgtgctttcttaactctttctttactatagttgctaaaaatgatcaatttccagcactaaatgcatcaatttgttttgctatccccggattcgtccaattggctgcaaaaaatgaatttatcgtttgctcggagccc

SEQ ID NO: 65800 - DNA, 490 bp, Heterodera glycines
  Genomic contig location: Contig_ID=SeqID_7745; Location=1..490; Strand=+
  SCN-specific regions: Sequence locations=1-4,29-166,188-355,382-490
  Gene Ontology: Mol. function=oxidoreductase activity, acting on single donors with incorporation of molecular oxygen, incorporation of two atoms of oxygen; Cellular component=mitochondrion; Biological process=carnitine biosynthesis
atttattttagttttcttttctgcagattaagattggtattaatttccaatttttgatcagatttaatccatatgatcgcgctccgatgcgcactttgaaaattgccgacgaccaatcgaaggcaatgggtgtgtaaataaatgcattttccattattattgggtctttttatgttttaatacatttcagaggacactgtgcttttttacacggcctaccaacgctttgcccaattggccaatcattcggacaaccaagtgacgctcactcttcggcctggcactgtgcttttcatcgacaatttccgagtgatgcatggacgaaaagcatttcaagtgttttatagggaaagggaaaaacaatattaataaatatttgttttgtattctttgtcagggtgaacgagtgatgtgcggttgttatttgaatagagacgtgtttttggcaaaggcaaggccaaaactgtcgccagaattctaccgaaatgtg

SEQ ID NO: 65801 - DNA, 793 bp, Heterodera glycines
  Genomic contig location: Contig_ID=SeqID_7745; Location=814..1606; Strand=-
  SCN-specific regions: Sequence locations=58-123,193-339,459-475,497 -541,609-653,733-733
  Gene Ontology: Mol. function=muscarinic acetylcholine receptor activity; Cellular component=integral to plasma membrane; Biological process=acetyl choline receptor signaling, muscarinic pathway
gagagagagagggagggcgagagagagagagggagagaggggggggggaagagagaggaagtagaaacacaagaagaagtgaccaatttagtagaacagcaaacgcaacagaacggaacgacgatgtcaaaacagctgatgaagaagagcgacatccttcagttgagggaggaacaggtgaaagagagggggaagggtactaataaactaattaaaagaatgaaaatgtttgcatttaaagtaccactgaaagtcaaaaaataattggcacagatcggtgaattagaagatacaatttgagaatgaatgaatggcattgccaaaggcatttcacttttcacagatgcgcagaagtgaaaaagagaggcggcgaaatgagcggaagcaagaaggaaaagcggccaaaacactttcggccattctgttcgccttcattatcacttggaccccttacaatggtcattactaatcagtaattaatcattagctaattaatcattttgcgtctctctccgctgatttatcccccggtgccctttcagtgatcgtttgcctcgaggctttctaccccaactcagtcccatcatatctcttcacacttagttactgtacgtaccgtacgtcgtcccttggccaatttgttcgcctttcagttctttcctatgtcaattccaccataaatccgctctgttacgcgctgtgcaacgcgcgcttccgcatgacttatttgcggattatcaaatgcaaatggaggcattcaccaatcggtcgacaaatgtacgcggcggacgga

SEQ ID NO: 65802 - DNA, 65 bp, Heterodera glycines; identical to SEQ ID NO: 54797
  Genomic contig location: Contig_ID=SeqID_36513; Location=310..374; Strand=+
  SCN-specific regions: Sequence locations=1-65

SEQ ID NO: 65803 - DNA, 167 bp, Heterodera glycines
  Genomic contig location: Contig_ID=SeqID_36513; Location=1042..1208; Strand=-
  SCN-specific regions: Sequence locations=1-167
catttatgggggagcaaaaatccaacgcagaattaaagtactggctatagggaagctattcccgaaggattcggtctccccataaatctgggcgcatcggttcggggggactgccccgaaaacaaaaaaatcgattttttcaagtgtccgtttggggtactcaaaca

SEQ ID NO: 65804 - DNA, 775 bp, Heterodera glycines
  Genomic contig location: Contig_ID=SeqID_36514; Location=159..933; Strand=+
  SCN-specific regions: Sequence locations=1-524,548-775
atgctttcggagccgaactttttgagccctgcaaatctcgaggcactcgtaagaagagcattcgcatggaatgaatattttttaactaattcccctctaatttcagctgatgtttcgcgtcaatccccagcggtacaatgagagggtgaaacaatgcgtgaaggagtcgaacgtggcgcttgaaagtgattaccgcgatattccaaacgatggaggaggacgccgtgcatcgatctaaccttgaaactgtgatctttttcatatgaaactcgttttgattgtacataatacgaatcacacacattgtccattcgttattaccgcgatattccaaacgatggaggaggacgccgtgcatcgatctaaccttgaaactgtgatctttttcatatgaaactcgttttgattgtacataatacgaatcacacacattgtccattcgttctcatatgtatttattaatcattgtgtaaaattaaagaatttaataacttcgctttttctgataaaaaaattatatatccaggaaaaagcctagaatttgaaaatttgaggttgggaatcaggccgggataggattcccaggattcaaattctggaatttgggtcgaaattattaaaattaacataaaaattctcaagaattttcgaataattcgtatggtcgggaggccttacttacacgcataggtgacattggaaaatttgagatgttgcaattggtggaaaaaagtcgggatctggatcagattccgggaaaatccacatgcggaaa

SEQ ID NO: 65805 - DNA, 382 bp, Heterodera glycines
  Genomic contig location: Contig_ID=SeqID_36518; Location=442..823; Strand=+
  SCN-specific regions: Sequence locations=1-10,33-61,101-236,258-382
atgtcagaccgccgaagagaagcggaggaaaaaatggcaaaagcaatgtaaaatttaaaatgccaattttcaattttaaattttgtttccctttttcttcagtttcatctctgccgactgttggctttcggtgttcgatttgctctctccgcgtaaacttggcctcggagttgcactgatcagtcaccgatttgacttttacgtcgatgaacacttcaaaacgcgcaaatgggcgctgaaatttattggaattggaagcaaaattggaaagaatggcaccaaggaaatggaaattaccaattacaatcgaaaagcattgccaattcctcaaattcaaatgccacgcaaagtcaccggattcgaacgcatcatcatcaagtaa

SEQ ID NO: 65806 - DNA, 568 bp, Heterodera glycines
  Genomic contig location: Contig_ID=SeqID_36519; Location=111..678; Strand=+
  SCN-specific regions: Sequence locations=1-271,296-409,438-511,533-568
atgtccagattctcaaataaccaagtttttttttacattttggttataaatttcttgaaacataactaaatttttgaatttttcaggctatagaaaacacgtatggctaccgaatgaaatatacattaaaaatttggttggtttagaacacagttatatcaaaaaattttttgttcgtttttgactacgtcataacttggactccaatttatagttgctaaaaactttcaaattaatggtgtaaaatgttatccaaaaagcaacaatttattacacttttatttgttttattatcaatagtaaatgataatcgttgatattctaatttattaatgcataaattttaacaatgtaataatatttttctatttaaagctcttttgaaggagtcagttttttccatttgctgattataatatatatttttagaaaaaattggttttttttggttttcgtttgaatacaattatttttttctgttttggttttgcttcattttttatctcatgtcttatagacttttgctttaactgcagattgattcgtatattcaatagatttgtattta

SEQ ID NO: 65807 - DNA, 1012 bp, Heterodera glycines
  misc_feature (7)..(7): n is a, c, g, or t
  Genomic contig location: Contig_ID=SeqID_36520; Location=304..1315; Strand=-
  SCN-specific regions: Sequence locations=1-333,355-652,696-1012
atgaccnaagaggttggaaaatctggttttttgaattcttctggccatattttttttatggcgtgacatccatttgcaccagcaacacaaaagcgcttaaggttcacacttttgagctaggcaaaaagacagtcaaaattttcggtttttaatgtcaaaaaatgctaatgtctggttaatgggggcttagagggactacaagatagcaatgttcttcgaattttgtggcgccaggatgataaacggcgaaatgttgattaatttggtaacgttttttgaaatattgcggggttatttttttttgattggtttgaagttcttaggacggatttgtatatccatgttttccatatttttgtcattttatgtccatatttcgcgatttttgggtgtattttatggacatattttgcgattttatctcaatataattgggaaccctaatgattagcaaaaataagtatcaattcatattcagcgcataaaattacatcaggaagaaaaaaatttaaaaaaggaaagaataaatatttgccactttctgagaaaagtgtttaagaaatcttaccattgcttttttgtctattattcgtttctatttcttctgtcgttataattgttgccaatttttcttcaataaattgcactattcaaaaataaaaacaaaaatagattcaaatattatattattttttgcccatttttttgctttttttgaccaacaaatatatgtatgcacaattcagcaatttcagcagaatgaacctttagaaattttgtacacattaactgccgtgtgcgtgaacagtcggcggatgtggactgggataaaacgctgcgcacttttgaagcttggctacctaaaattgcaattgggtactgaacaggggtgtgacttgtctcagaaaagacgagagcaagagtttggcgagagttgtcacacctctggtacagaagcgattgtgttttttgaattaccgattgacaaaatatgacgaactttactaataaa

SEQ ID NO: 65808 - DNA, 4974 bp, Heterodera glycines
  Genomic contig location: Contig_ID=SeqID_1002; Location=212..5185; Strand=+
  SCN-specific regions: Sequence locations=1-69,91-91,132-222,244 -273,295-860,898-907,944-949,971-983,1005-1060,1091-1113,1171 -1567,1589-1908,1930-2053,2084-2644,2668-4482,4509-4974
atgaattcaatggtaagcatcattttgttgatataatcgtcagtttagaaacttcattaaaacttttataaaatgaaaatatctttgttagaatttatagaatttttggtgttttaatatatacaaaatttactgacggattgtcatggagccaaagactgtgcccaattgtccctgtgccaaattgccgctttgccaaattgtccctgtgctaaattgtccctgctgtgcccaattgtccctgtgccaaattgctgctttgctaaattgtccctgctgtgcccaattgtccctgtgcccaattgtcccccggtcgatcccttttcaggtgttggacaacaaaatcggagagggcgaagaagtgccaaatttgaatgtgattagagaagatgacccggtgaacgaattccttggctttttgcactacgaccaaaaattgggccatcacattgccaaagcgtacaacgaaacagtgttttgtgccgccaaaaatcaaattcccaaaagggtggtcgaccaaattttacaactgaccttctcattggccattcggataacgctttgtgtgatgtgagttttgaaattgaaataatcaaaaagaacaattcctattgtatccttattaaattttgggcttttggcacaaattttgttggcactttttccattgcaaataatccttaattaattgaatatcttatcaataatatttggcaatttaaatatatttttttcacattacaaataccatccttagttatgagaattatttctcgcgtttctatgaagtcggtgggtggcaattggaacaacttttgtccgtttttcaaattttatcggcacaaagaggcggcaccaacgaaaatgggtaaaatatttttcttccgtttttaattttgtgatttgctattaattacttttttaaagaatttaatttaatttacagaatatttccttttcaaatcattcgcattgacgcgcaaaccaaaaaacatttttgggatgaaattaaagctaacagcgcgatagaaccacaatttattggtgggtgaacaaagcgattaaataaaatttaattacaattaaattacaaaggattatgaagctgctttcaataatttaatttttatacataaaaagatttttaatagttttaattagtttattaatgttgtatagcaaaatacaactatattaatatcattggaattgtaagctgtctattggtgatttggcaattattaagaaaaagttctagcattaatatgttcagcaatgaggaaaatcatacgtatctggatcattacttacgatttcgacgtacacagggtcaaaaaagtgggaaatagtttcgaacacgaagtcacctttgcagcggctaccgtcatctgcaccaattgtattaataatggagaatggaaaaactcactagagggaaaacaatgtgctatatgtggccccaaccgtacaattacattctcaccatttgattacaaagagacaacagtagatcaaaaaattgtcacccagcaaactctacgggaatttgtccaatggctactatttgaacaaaataaaaaatacccaactgtagcctttgcacactttgggggtcgctacgacatgacaatgatcatcaaggaagttattgcacaaggtacaatttttaatattcatagattatatattttttaaggtgttcacgatccacaaattatcaaacaaggaaatcgtctttatgaactcaaaattaaggataatgagcatgccccactaacaattttccatgacagctacaatttgatgcctatcaaattatcgggtctcatcaaatcatttggactcaaaattcaagtgattaattttcataaaaattatcaattttttttttgttttaggataaacaacactttccacacatgtttaacaaatcatctaattatgaaaatgttcttactaatttaccgccgcgcgaagaatactgtcccaatcaaaagaaaaaaactgatctgcaaaagttcaacgaatggtacaacaccaattatgaccaacactttgatttaaaagaaaaattgcccgaatactgctgcaacgacgtcaaaattctcacccacgccctcgtcgagttgcgccgggaattcaaacaattaacacaaagagaaggaaatcatggaggaattgacattctttggcaagccatgaccatagccagcgcctgcgtcaaaaactttgcccttaatcatttgagatccaactctctagctatcgtcccggagaaaggctacaccccacaacaaaaccaaagtgcactggccaacaaatttcttgactggtactctcacataaacaacgttcatgtacaaacggccagttcccgctacggagaatatatgttcaagcgcgaagggcaggtttatcaagtggacggctacattaaaggcacaaatgggcagcgggacaaaataattgaagtgaatggttgtttatggcatgggtgtgaggagtgttttgatgatatggatgaagagacgaggatgccaaacgggaagacactgggggagcttaggataagggaacagaggaaacatgaaatacttaggcggtacgtcgacttggaggtggtatgggagcacgagatcaataaacaaatgaagaaagacaaagagatgagggagtatttcgaaaactggaaggattgttcacctatcaaaataagagaggcatttcacggaggacggacaggaccaatgaaactaatccacacagcaaaaccggggcagaaaatcagctacaaggacttcaccagcctctacccgtttaccaacttctctacaaaatatcccctagggcatccaaaaattatttctttcacgaccaatgagcaaacggtcaattggcgttctccaactgacaacccctacaaaggattacttaaagttcttctccaaccaccagacaacaacgtcaaaatcactgtaatgccaataaagtttgatgagcgcctgctattccctctctgtgaaaaatgcgccaaagttattagcaacaaatacccaaaaggtctcaaagacgacaactactcctgcccccacttcaacaccaacgaccgcgccttcgtatcaacttgtactcatcttgaattaaatgcatcattggaggctggctataccgtcagaaaactttttcatgtcctacaatacgaccaatggagtgacaatgtcttcaagtcctacgtgagcgaaatgatggccttgaagatacacgctactggctatccatcatggtgtaataatgaagaggagaagagaaaatacattgatgagtgctggagaaaatttggaattaaaatagaggataacaaaatgaaggctgaccccggaaaacgatacattgccaagctttgcctcaactcactctggggccgcttctccatgcgaaatctcctctcaaaagcaataattgacaacgacgaatgcctgatccgccaatactctgacgataaaaagattgaactaattgatgtcgagctaatggacgaagacaacgacgtgtatatgctcacctataaacctaaggaagaatttgtcgacgaaaacaagtactcaaatgtcgtcatttccctcttcactacttcaatggcgcgactatacctctacgaagctctgaaaaaggtcgctgacgctcctggctgtgaaattctttactacgataccgacagtgttatttatgttcatcccgaggacaacgacccacttcccactggaaaaggacaccttggagagcttacggacgaaaaacctgaccacgatattttggaattcatcagtgctggctgcaaaaactacgggctgaagcttcgccgaaaggacaacggagaaattgaatatgatttgaaaattcgtgggtttactctagacgaacagacggtacaaaagatacattatgatagtgtgaaagatcaaattttacgctatggtaccgaagatcccgctgatcctatcattgttacttatccccattttatccgtcccaatcttatcaaaggcaaagtgtacactcattccttcacaaaacagtaccagcctattttcaccaaaggtattattaataattcattccaagttctagaatttggtcatcgcaaatgaattgtataattttctctcagctattttctttttagaatcaaatctccggatttttattgtctctatttatacctcactcgcattagggacgggatgatccctggttgatcctctccaacactccaggccatccatctgagatgaaggtggatgagctgctcattattgcaatgagcagcctggtgcgtgagtgtttggattggggaccgaaggctaaacccgatttccttggtgcgtttgagcttatatttaattgaatttaaatcccggagaattttgattttatttatttcatttgcatttattcaatttttaactgtacaatttgtctttgtaattaaaatttttaataaaaatattctttgagctcaaccaaatgagtatttaaggactgactgatttgaattagtaatcccaagattaaaaatgtcttcagtgtcctctaagaaagcccttcaatcagtagtcgctaaggatcccgaaatacatagtagtgaaaaaaccgcgcatgagaaggaagcggaaaaaactgtccgaaaatcaaaatatgagtataatttgcttgatcatcaacgcttcttctggaaattggcccgcccaaaatttgctgtaatgaatttcctatgcccaacgtgtcgtcgaattaattacaaacataaggaccagttcaagttgatgggagaagatgagttccactttacccaagtgatgtgccagggatgtgtcaagtacaatatgatgcaaactgatatttacattaaacacactaaaaacccacactaaattgtatttaagacaataatttattattatataagtatcccaa

SEQ ID NO: 65809 - DNA, 1853 bp, Heterodera glycines
  Genomic contig location: Contig_ID=SeqID_1002; Location=6208..8060; Strand=+
  SCN-specific regions: Sequence locations=1-253,284-352,374-540,562 -665,694-709,746-1215,1237-1471,1493-1853
atgtacaaaaatttattaaaaccagacgccggggaaattaatgttgataatgctaaaaataaattgtcttcacttttgaagcagcgaaaattggactccgggacaaaaaatttactttacaaccaggaattgcgtcgtttcttaaaactaaggaaggaaatagaagacaaaccggtaaaggttgagctcaccgacggctcattaatggtttttaatccaagacatcgcgaaaaagacagaaaaattcctacacagattgtgaaggaagatgatgaagaagaattggatgaaacgggatctattccaacgtttgaagacccttatgcgacagctgaagagagtgatgcggagcctactacaacaacaacaccaaaatcaagaccacttttcagacctttacgtattgggacaagtaaatttcgtcaaaagcaaaagtctttcatagataggaaacaacaaaaaattatgtcgattataaataatgaccctgaaaaatttggggttggctctagaggacatatactgagagctgatggtacggcatatttaaaaagtaatattaaacaagcattagagcgaatacttagacggtcacccgagaatgctccatcacccataggtacaaaaactttagagcaacgactgagaaacgacccgaggactagtggaatattaaaacaaaaatttaatgaacaatcgggatcgggccttaaaaataaacaacaaaaatttataattaaaaaatggagaagttactaaacaaattgtataatgacccaaattcacctgcgtgttatgcagggcaggaaagactttacgaagaggcacaaaaatatgactcttcgattacaaggaaagacgttgaacactttctcgagggagacagaacatatactttacataaacctaggcgtgttcgatttaagaagtcaagaactgtgcccgctggattcatgactgatgttcaggtcgacttggcagattttcaaaaattatcaagagaaaataatggattcaattatatattgttgggtattgatgtgttgagtaagagggtatttgctacaccggtaaagtcgaagaatttcaaacatatgagagaagcgtttgacaaattgatcagtcaaatgccaatggttcctcatagaatattttcagatagaggaacagaatttgaaaatagagaaatacataaatatttccaagagaagaacatacaaaagcacaaggctcatactagtacggtgaaggctgcgctagccgaacgttgcataagaacgcttaaacaacgactatatcgttattttagtcaatcacatacaattaaatgggttgacgttttgccaaaaattgtaaatgctttgaataactcaaaatcacgaatcaccggtatgaaaccagttgatattaacccggataatgctcaaaaaatttggaaaaaggtctatggaaatgaattttcacgaaaaacttatagaagaccaagatttaaagagggggatcatgttagacttgcaaagtataaatccagttttgaaaaatcataccttcccaattattcggatgaaattttccaagtttatgatattaaaaaagcaaatccttatcggtttgggataaaagacgataaagaagagccgtttgacacccgattttatgctgaagacttggccaagaccagaaaggacgcggagacaacatacagaattgagagggtgctgaagactaggacaagaagtggacataaagaacatttggtgaaattttacgggtacaaagaaccggagtggattaaagacaatgatattgagagatgaatgtatttaagtgtattgttattatgttttagaaaa

SEQ ID NO: 65810 - DNA, 384 bp, Heterodera glycines
  Genomic contig location: Contig_ID=SeqID_36523; Location=279..662; Strand=+
  SCN-specific regions: Sequence locations=1-384
atgacattccaatctctgggactcaacccaccagcatttcaatctctgagactcaattctcaggctttccaatcactgggactcaattctccggcattccaaacaatgggactcaaatctccggcattccaaacactgggactcaacccaccagcatttcaatctctgggactcaattctccggcatttcaatctcggggactcaaatctccggcattccaaacactgggactcaacccaccaactttcaatgacattccaatctctgggactcaatccaccagcatttcaatctctgagactcaattctccggcattccaaacaatgggactcaaatctcccgcattccaaacactgggactcaacccaccaactttcaatga

SEQ ID NO: 65811 - DNA, 615 bp, Heterodera glycines
  Genomic contig location: Contig_ID=SeqID_36524; Location=61..675; Strand=+
  SCN-specific regions: Sequence locations=1-182,220-615
atgcaatcgccaaacctgcctccagtcaaagtttttgaagatgatttggatgagaacgaacggaagttaagggaacagatcaataaattgaaagaagaattggaaaagacggaagaaaagaaaaaggtgattgagaagagaagaatggagcaaatgaaattggccagggttgatgaagtggtcctggaagatgaagaggatgaagaggaggaggaaccaacctcaaaaaagtcccgtcttaatccgacggcgacgaaagaaattgtgcaaaaaataattaatgaagaattggttgccaatgatttggtcatgatcgatccaagagggatcaatgatcgaaatggaccggaagatgtgatcgaaagtcggagaattgaagatggaataagagcaaaaaataggagtgtaaatgaaaaagcaatgcgagaattcgtgatgacgaaaacatcgctcgatcatgcaaaagaaattaggacgagagcaatgaatgaagtgaaatatgctgaaaagccaactgatccgtcaaggcttttgagaggtgaaattcgtgcggcgaaatggacatttgcgaaaagcaaacgaaggcaattccgcctgaagggaaacgattggtga

SEQ ID NO: 65812 - DNA, 803 bp, Heterodera glycines
  Genomic contig location: Contig_ID=SeqID_36525; Location=1..803; Strand=+
  SCN-specific regions: Sequence locations=1-165,189-331,353-803
gtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgatttttt

SEQ ID NO: 65813 - DNA, 126 bp, Heterodera glycines
  Genomic contig location: Contig_ID=SeqID_36527; Location=1..126; Strand=-
  SCN-specific regions: Sequence locations=1-126
taattaaatccattccttcgggggaccgtgccgggtgccgcggggtaagcagtgctggttcgtttcatcacggcaccgaaccttttgactagtcagcaatcgttgcttaacttgccagatcggacg

SEQ ID NO: 65814 - DNA, 708 bp, Heterodera glycines
  Genomic contig location: Contig_ID=SeqID_36531; Location=26..733; Strand=-
  SCN-specific regions: Sequence locations=1-72,94-480,508-542,578 -581,615-653,684-708
atgacagcacagagaaatatttgggcatttaccttttgtgcgtccctccaacgaatggtgaaaattgagaattttaattgcattaattaattttgattaccaaagatggaaattggagcttcgaatgttcggcaaccctacgaattgtttcacaaaagaacggaacggaggatttaacgaaaaaaattgaccatgtttttaacaaggaagagaacgaccggggattcaaatatttcattacttttacggtgattgtttcacaaaagagcggaacgaaggatttgactttccaattagacagagtttttaataataaattgtggcggttcccacttttcattacttctacggtgagtggcaatcaaaatcctttttcatagtttaataaattagtgaaattaaggaattgatggacccgagcaaaggattttacgacaaaattgaagataaagtgactttggccattgatttgacggtgggagaagaaaaaggaaccaaaaaacgcaaattgaccgatgaataagccaatccaatcacactcattttctattattttctcattttcaaattttatacaatgcatatttatttttattgaaaattttaaaatttttgaatcattctcacaatttaatcaaccaaaaaaatattcgaaataatttttttttattttctattaaattcttttgttcgaagctaacaaataaa

SEQ ID NO: 65815 - DNA, 739 bp, Heterodera glycines
  Genomic contig location: Contig_ID=SeqID_7748; Location=119..857; Strand=-
  SCN-specific regions: Sequence locations=1-739
atggacgcccttctatccgatttaaatcagacccttaaccgccataaaaataatgctgaagttgcacactttgtgcaaaatcttgagtccattctcgccgaaaaccccactgatccccccgttgaatacttggattttgattccgaaaacagcagcgattctacatccaattctgacaacgaggagttgtttgttgaatccccgaaccgtgatccccgacaacaaaaataccccattgaaacgcaaagaaaaatcgtacagcttttggacgaagggacttcttataatcaaattaaacatctctatagaaaaattaaaagcaataacgagattgcgaggtttttaaaatttttggatttactaaattctttgtttaagaattcgtaaatatgttgccagtggggggagtaaacctgaaaaaatatctgtgattgatcggcacgtttttgagcgattttatgaggcaaggagtcgtaatgaggccatgcatgacatagacctagccactttgggcttattaaaagcccgggaaattggactccaagattttaaggttaagaaattgacataatatttgttgaccacccaatttaaggcctgtgccacttggattttggaattcaaaagaaagcacaaaattgtggggcggcgcgtaaccaaaaactatgcatgaaaaaatccgccgctgtttccccaattttaacatttcaaatcgtaaaaatattggtcgtgtattaaa

SEQ ID NO: 65816 - DNA, 70 bp, Heterodera glycines
  Genomic contig location: Contig_ID=SeqID_7748; Location=1761..1830; Strand=-
  SCN-specific regions: Sequence locations=1-70
caaaagatgattagtaaacattttttgaaaaaaacccaaactagcgaagaggcaataaaattttaaaaag

SEQ ID NO: 65817 - DNA, 1982 bp, Heterodera glycines
  Genomic contig location: Contig_ID=SeqID_7749; Location=422..2403; Strand=+
  SCN-specific regions: Sequence locations=1-31,53-174,197-242,264 -273,296-300,357-427,449-539,564-739,761-1590,1619-1982
atgaccaatttttgctcagtgtttcaaggtaatttgcttttattcggcttttgttattattacgattattggatttacaattttatccattttagggacagaaattgggcacttttccgtcgtccaaatgatgctccgtctccatttgcgtacacaatttttcaattgtcgggaaagggccaaggacacagccgaatcagtcagtttcaggaaaattacaaaaaattttcataacacattcaagaaagctattttttgaaaaacctttagaaaaattcatcaaaaatttgaaaatcactgaaaaattttattgaaatttcttaagaaaagaatttttttttgaaattaaaaatattcggcgggtgggggggggggtaaacccgtgcacctaattttgatagggcaaatcaaatacaacttttttttgctctttggtccctaaaattctttcggcaaaggcgttttgggaagattttgtggtccagtggtactgattaggggtggcatggaattccgaaattttttttggtccgaattccgttttccaaaaatttttggggcctcggaatgccatccatttctctggctggtgccaatgagcgcggccgcgaaatttttttttttttgcttactttttttgtttttagtttgggattgtgcctgggcctcggacgcccatttgtttgccacttgctcacgggacaaaacgctgaaagtgtggcgcatttgtgccgcggtggaacaccaacaacaacaacacgacgaagaattggaagaagtcaaacaaattgccaattttgtcgggcctgctccccaaacggcagttgacattgctccaaggaaaatccgagataggttagggggggggggagcattcaagaaatttcgacatttttttactttacccctccccctcgaaaaaaccataggggtatataattaaaccgagaagacataaatgattataggctctatgagaatcactgatcgatataagcactttgccattcttttgcgactgactgatcagaggtccaactccaccgcatgtttgattttgcgcagaaaagtgaccgcctctctgtcgtcgatcaggcgatggtcgtaagtgagtgcggtgtacatcatcagacgaatttcgacctaaaccaatgggttgtattggtggtacaaaacaaactgagttgtccgatctcgacaccctttctcgacgtgcctttgcatccaccgccacagtcagatcaaaaatgccgagaatggccgactgcggtgggctgatgttcggagtgccgagctagcgctacaatttgttttacaaggaatctgaattggggggggggggtctaaatctgaatccaaactcttaatggttgtgcattcgtacacctttctcgtacacgctccacttttcttcattttttgacggcaatgattcggctaaaaacaaaaacaatgttcatacaaaccccaaaaaatgaatgcccaatgttttaacttacgattggaattgtcagccgttaataacacacacataataagtgtacgttgtagatgttgcatttgtaatatgcatacttccaattccccccacaccgccgcaccgggcccccggctcgggcatctttttaatgcgttttcttagcgctacaatttgttttacaaggaatctgaattttgggggggtctaaatctgaattttagtgtttttgtcatggattttaaaaaaacaagggaacgctgccaaaaaaccaatgccccgacaaaacaaacctcaaacaccgagaccaaactcttaatggttgtgcattccaatcctttgcacataccaaacttgttggccttggagttttttgatccgactaaaaacaattaatgcaaatcccaaaagtgaatgcaaccaaacttacgttcggtactcgtaggcacagaaaaagactatttctttctctgcttgcagcgctggtgaatgcgtgcgtcagaca

SEQ ID NO: 65818 - DNA, 825 bp, Heterodera glycines
  Genomic contig location: Contig_ID=SeqID_7750; Location=130..954; Strand=-
  SCN-specific regions: Sequence locations=1-278,301-330,360-717,746-825
atgctaccgtgggataacaatgtgcttaccttttttaaacacgctcaagcgctggaggaagcccgagcggggggcccgatgcggcggtgcggggggaattataagtatgcgtactacaaatgtaccaactgcgagtaccgaacgtaagtttggttgcattcacttttggggttttcattaattgtttttaggaggatccaaaaaatccaaggcgaagaagagagtggcatgttcaaaaaattggaatgcacgaacattgaggtttgttttgttggggggattggtttttaagaaaacgcattaaaaccatgcaaacgttttttcgctctattttttggtttgttctgttttctcattggttttattgttgacgcacgcattcaccagcgctgcaagcagagaaagaaatagtctttttctgtgcctacgagtaccgaacgtaagtttggttgcattcacttttgggatttgcattaattgtttttagtcggatcaaaaaactccaaggccaacaagtttggtatgtgcaaaggattggaatgcacaaccattaagagtttggtctcggcgtttgaggtttgttttgtcggggcattggttttttggcagcgttcccttgtttttttaaaatccatgacaaaaacactaaaattcagatttagaccccccaaaattcagattccttgtaaaacaaattgtagcgctaagaaaacgctgcccgagccgggggcccggtgcggcggtgtggggggaattggaagtatgcatattacaaatgcaacatctacaacgtacacttattatgtgtgtgttattaacggctga

SEQ ID NO: 65819 - DNA, 187 bp, Heterodera glycines
  Genomic contig location: Contig_ID=SeqID_36532; Location=280..466; Strand=+
  SCN-specific regions: Sequence locations=1-187
atgggcttcgaaagtgacaaccaagttcacatgtacaccttttacgaggatagtccgtccatgggattaattgcgtcgacggaaattcagccgaacaatgcgaaatcgcaagaattggccgattgggtgaaggggcaaattgaggggaaatttgctgctaaaatagtgcacgaattggaattggaag

SEQ ID NO: 65820 - DNA, 135 bp, Heterodera glycines
  Genomic contig location: Contig_ID=SeqID_36533; Location=551..685; Strand=-
  SCN-specific regions: Sequence locations=1-135
atgcatcaatcgcttgctttcaaaattattgccattttggctggcattttggcattgttcgggcccatcgattgtcgcgcaacccatggcacgtgtgtccaccaaggcagacaataccgagagggcgaggaatgg

SEQ ID NO: 65821 - DNA, 508 bp, Heterodera glycines
  Genomic contig location: Contig_ID=SeqID_36536; Location=1..508; Strand=-
  SCN-specific regions: Sequence locations=1-84,106-364,386-508
  Gene Ontology: Mol. function=myosin ATPase activity; Biological process=hearing
gttctgctcaattttcgacgacgcccaaatgtttgtgccgattcatttgaccgatggccgagtcatttcactgccaatcgttcgttttccttttcagtttaaaatttatttaatccgtttttattttcggactcgcaatcgaccgcctttgaattgtgcgaaatgttgtgccaacaaatttgtctcaaagatgcgtttggcttcggcctttttcttgccgttggtcgccgttttattcgttctttgggcgttggctccgaatgcgtggtaaaattagataaaactttaaaatccaaaaaaacaatttatcttttacagattgacgcaattgcatcgcttgagacgaaaagcgaaaaaaattggcgaattttctttaagaaagaattgtttagagcccaccaaaggtgcgttgccatcatttcctgacaaatgaagccttcctttacgactgactttccgtttaagtgaatccgacgaccctttggccattgaattgacctttcggcaa

SEQ ID NO: 65822 - DNA, 788 bp, Heterodera glycines
  Genomic contig location: Contig_ID=SeqID_36539; Location=93..880; Strand=+
  SCN-specific regions: Sequence locations=1-474,496-788
atggaagttgatgaacatgatgatataatgatcatcgaaccacagacaagtggacaggcagttgatgccattctcacccaagcccaagtggccggtgaaaaccaagctgacatgcttggtttggtgtcggagtcttgcatcccgcaagaaccaatcgcgcaggctgatgatgtaatcttcgtcagacctaagacgccaccaaggcgatcactgcgcgtgcaaaaaaggctttcagcttctgttagccgttcgccttcaccggcgccaaaacgacccccgccagcaaattcgctgggaatggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgacgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggaaacactcagattcctggttttggccagttgtacattctggaccccagtcgaggctatggaacaacgccaaaacaccccag

SEQ ID NO: 65823 - DNA, 536 bp, Heterodera glycines
  Genomic contig location: Contig_ID=SeqID_36540; Location=66..601; Strand=+
  SCN-specific regions: Sequence locations=1-132,154-205,259-536
gaaagaacgacgagttgccaagacgagtgttgggaaaagaatggtgttgaaacaacggcagatgaacggcagcgaaaacaataacaacgcttatcaaaatcgcgaaggtaaaatctcggtcactgaaaggccagccaaattaattttaattttgttagtgatcgttccccttcttgttttcccacataaatgaaacttgtttaggtaattttttgaaaaaaaaattattttttatcaaaataagcaatttttaaatttctttttggctaagcgatactggtgagaggagcggaatactgcactcgtttttttaatatttgtaattgtttttcagttgaaatcatgcgttcacagaagagaaacattgcgatgcctccaattgctgaggaaacttcgttagtgcaccgaagtgagatactgcaacgattggaccaccaaatgcgcaaaaacccgaacttcgaaaatcgaataaaatcaatgctgagagtttggacggacgacatgtcatcgccggccattggcacttcaattttgga

SEQ ID NO: 65824 - DNA, 141 bp, Heterodera glycines
  Genomic contig location: Contig_ID=SeqID_36541; Location=395..535; Strand=-
  SCN-specific regions: Sequence locations=1-56,79-141
attttgcgcaagcggttggaggacgagcaaaatcaacggccgacgaagcaggccggggtggaggagttggagaagaagtgcaaggaggtcaaggagaagaaccagcagctgatcctgcagaagcaggacctgcaaaaggag

SEQ ID NO: 65825 - DNA, 205 bp, Heterodera glycines
  Genomic contig location: Contig_ID=SeqID_7751; Location=14..218; Strand=-
  SCN-specific regions: Sequence locations=1-205
atggtgattagaagaggtacaatggtgatgagaagaggtacaatggtgattagaagaggtacaatggtgattagaagaggtacaatggtgattagaagaggtacaatggtgatgagaagaggtacaatggtgattagaagaggtacaatggtgattagaagaggtacaatggtgattagaagaggtacaatggtgattagaagag

SEQ ID NO: 65826 - DNA, 3730 bp, Heterodera glycines
  Genomic contig location: Contig_ID=SeqID_7751; Location=1..3730; Strand=+
  SCN-specific regions: Sequence locations=1-475,498-544,566-852,874 -927,952-977,999-1046,1082-1263,1285-1338,1363-1388,1410-1449,1472 -1591,1613-1933,1956-2549,2571-2644,2666-2687,2749-2798,2820 -3020,3045-3063,3202-3218,3434-3730
  Gene Ontology: Mol. function=cell adhesion receptor activity; Cellular component=cell wall (sensu Fungi); Biological process =agglutination during conjugation with cellular fusion
atcaccattgtacctcttctaatcaccattgtacctcttctaatcaccattgtacctcttctaatcaccattgtacctcttctaatcaccattgtacctcttctcatcaccattgtacctcttctaatcaccattgtacctcttctaatcaccattgtacctcttctaatcaccattgtacctcttctcatcaccattgtacctcttctaatcaccattgtacctcttcaaatcatcgttgtacctcttccacccgtggtaaacggttgtgaagagcccgcacaagcttaacaaaatttaaaaaacgggcgcgaagctcccgtttgagttaaaaaaaatttaaaaacgggcgcgaagcgcccgttcgaggccgcgaagcggccgaaaatgccaaacaaaatttaaaaacgggcgcgaagcgcccgtttgagctcaacaaaatttgaaaaaacgggcgcgaagcgcacgtctggtcacaaccaaatttaaaaaacgggcgcgaagcgcccgttcgaggccgcgaagcggcctaaaaatcactgaaattctttaaaaattcaaaatctcttcacaaccagatagctaatctaggtagcgaagctcaagaagcgcgaagcgctttccccagcgccaccctcgcatgcaacacccgctagttataagtttataagacctttcattttaatgtaaataagtgatacattattttataagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattcttatatacgttatattgacaaggagtttcgttgctaaaaccattttctcccggccgaaggccgggagcgccctgaaagtagtggaagggtcttacaactttttgaggagcatccgggaaaactatagagaaaaattcagcgcggacgactgagtcccggggaccgatttctcactttttcttgcagtttagggcctgtaactttttttctaaaacccgaatcaaaaagtgcccgctgtgagggcactccccacaactgtcctctacatgctggtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggtccataactcgtcaggggttgattttagcgaaaaattgtcttagaacatttttgtagagcattttaaatgctatcgaatggtttactacatgatgtaaaattttcaaaaattttcgagctaggccccctagaaattttcaaaaatttttttggggtcgaaaaagggtgtgaaaaatatttttctggggtaaaataaggtgctgagtacgaatatgatgtctattttaagtttcagaattttgggaattttttaaaaattctttattttttggcaattttttggccctcgggattttggcctaatatttgaaaattcataactaacctcagggtaagtcaattttcatacaacaaagctttaaaaatagagaaaaatcaggagaattttatgggatttatttaggttttctaacatcaatatgaaaaaagttattccagaaattctggaaattttagatttttcagaaaaaaattcgtaactgccttctgaaaagctatttgagaaaagtaaaatactacaaaaatccgcaatttttttctctataatataaattttattttaaatttttatcacatttttaaaaaaagatataaaaataaaagtgattttgtgattcgggtccaaaggggggagcacatggtttttgagtggaaaaatttttctcacaaaaatcttccaaaaatatgtctttaggggttatttgggccgctgatcacgaatacgtgatcagattttacttttgacatcgtcaagacctcagaatccctgtgtgattggggattctgaggcatcattttgaggggggggggggcaggttcgaatccggacggtgtaacattattttttttgtgcatttttacgttattttcaatgaatttaattaatttaaaatattttgttgagttaataaataaaaaattatatttaatttaattttttttttgataaataaattttataagtttaaattaattgtttttttaattgatagaatttcatgtatttttttaattaaatttgttaaaaatattttcattttaatttaatgaatttactaatcactgttgtatcaatttatatttaaagatttgttgtaaattaataataaaagaatttatgtaaaaaataacaattatcttttaataaagaatttcatatttttttaattgaatttataaaaattaatttcatattaatttaaatattcaattattgtacatttcaaaattctctttttaattaataaaaggaataattaatttattttttaaaatttataataaattgcattcaatttttgtacctcttctaatcactgttgtacctcttctaatcacagttgtacctcttctaatcacagttgtacctcttctaatcacagttgtacctcttctaatcacagttgtacctcttctaatcacagttgtacctcttctaatcactgttgtacctcttctgatcacagttgtatctcttctaatcaaagttgtacctcttccatttacttttgtacctcttttaatcaccgttgtacctcttctgaccaatgttgtacctcttaaaatcacttttgtatctgttct

SEQ ID NO: 65827 - DNA, 307 bp, Heterodera glycines
  Genomic contig location: Contig_ID=SeqID_7751; Location=3422..3728; Strand=-
  SCN-specific regions: Sequence locations=1-307
aacagatacaaaagtgattttaagaggtacaacattggtcagaagaggtacaacggtgattaaaagaggtacaaaagtaaatggaagaggtacaactttgattagaagagatacaactgtgatcagaagaggtacaacagtgattagaagaggtacaactgtgattagaagaggtacaactgtgattagaagaggtacaactgtgattagaagaggtacaactgtgattagaagaggtacaactgtgattagaagaggtacaacagtgattagaagaggtacaaaaattgaatgcaatttattataa

SEQ ID NO: 65828 - DNA, 653 bp, Heterodera glycines
  Genomic contig location: Contig_ID=SeqID_36543; Location=499..1151; Strand=-
  SCN-specific regions: Sequence locations=1-208,253-653
  Gene Ontology: Mol. function=ATP binding; Cellular component =extracellular; Biological process=reproduction
atggacggtctttccctggacatagtgcttcaatcggtcggtcgcgtcgaggagaaatgggtgggccgaatagcggtggcggtcatcaacggactgacctatctgaaggaacagttcaacattttgcacaggggtcggtccgactttttcggcatttgtgctaaaactgttgtcgttgttgatgtgttttgaagatgtgaagccgtccaatattctggtgaacagccagggcgagatcaaactgtgcgacttcggagtctcctgcatgttaatcgacagcatggccaattccttcgtcggcacgcgctcgtacatggcggtgagaggggatgggtcatgccggaattcatctgttgcatttaaaaagcaaattcgaaagtcatttgttccctttctttcagcccgaacgtttgaccggcgcccgctacagcgtccaatcggacgtttggagtttcggtctttcgctggtcgaactcgtcatcggccgctacccaatcccggccccgtcgcgcagagagtacgccaaacttttcggggtccatccgaacgatgtgaaaatggaaaagaacggaacggaggaggaacagacggcggacgacctaacgccgaagacaatggccatttttgaactgttggattacattgtgaacaga

SEQ ID NO: 65829 - DNA, 399 bp, Heterodera glycines
  Genomic contig location: Contig_ID=SeqID_36545; Location=940..1338; Strand=-
  SCN-specific regions: Sequence locations=1-26,195-237,328-342,365-399
  Gene Ontology: Mol. function=protein binding; Cellular component =axoneme; Biological process=eye photoreceptor cell development
cagaaatttgaacaaaacaacaacacggaagaggaaaaggaagaaaatggcagaggaggagaagaaggagagaatggaggacgaggggaggaggcaaatgatggggaagagaatgaggaaaaggaggaggaagaggacgaacaggaagaatcaattgttgaagaggaggaggaggaagaagagggagaggaggatggaagggaagcatttttggaggaattggaagggacgatggatgaagaggaggaagaagaagaagaaaaggaggaggaatttgtcggagaagagaatgaggtagaagaaaaagaggaggaagaagaggaggaatttttggacgaattggaaggggaaagggatgaagaggagggggcattgggaggaaagaagagcagaattttg

SEQ ID NO: 65830 - DNA, 723 bp, Heterodera glycines
  Genomic contig location: Contig_ID=SeqID_36546; Location=296..1018; Strand=+
  SCN-specific regions: Sequence locations=1-81,115-325,362-526,548 -663,685-723
atgccaaaaattaaatcaaaatcggccagctttcgggaatggattcgaaggatcggaggaactgacttttattcaacaactggcaaaataatttattgtcaattatgtgaacaacaggtaactgcgacaacatccgtcgaacaacaacaactaccaataaaaaattcacagattccttgcacgcaattcgcgcatctcaaacaacacaacgaaacggtaaagcacaaggcaaaattggaacggaacaaaggaggacaacagcagcaatttttgacaacaccaaacaatgttccaaatcaattcaaccttgatttgtgtgaagcctttgtctcagctaacattcctttccaaaaattggagaatgaaaaattcaaattttttttgggaaatgccccatcgttacacacttcaaaaaaattacttgcggttgacttttgaccaggtcattcaaaaaacaaaaccaaaaacagtaattcattttagacaatagagaaaattaagaggtattttaggcatttgcctcttctttaaaaaaaaataattaaatgtaaaatgccattcctaaataattaccagccctagtaatgagcaataagtgtcggtgttttgcctttatgctattgattttgccgtttgtccactccgcttttctgcttctccttttcaatgtctcttctccctttcgttggcatttatctttccattctcccaacaacaataata

SEQ ID NO: 65831 - DNA, 203 bp, Heterodera glycines
  Genomic contig location: Contig_ID=SeqID_36546; Location=45..247; Strand=-
  SCN-specific regions: Sequence locations=1-203
ttgttcttattgcatttttgttaaagaattttccaaaaaatgtcgaaatagtgaaaaaatagtgacaaaacgccaaaatagtgatttttaactattttagtgacaaaaccccaaaatagtgatttccagtgacgaaaagtgacgtccaaatgaaaaaattttaacgcagaaatgcgttttttgagctcctttcttcaaaacaa

SEQ ID NO: 65832 - DNA, 108 bp, Heterodera glycines
  Genomic contig location: Contig_ID=SeqID_36546; Location=1450..1557; Strand=+
  SCN-specific regions: Sequence locations=1-108
atgacaaaacctgacactttggcagaacgaatgaatttgttgctaagcactggccttggtgcggatgtgtactttttagtcggagaagcagacgcaaaagaggcaaat

SEQ ID NO: 65833 - DNA, 704 bp, Heterodera glycines
  Genomic contig location: Contig_ID=SeqID_36547; Location=143..846; Strand=-
  SCN-specific regions: Sequence locations=1-377,399-679,701-704
atgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttgtcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcggctaaccatccctcccttttgtgcactatttcgtttcaaaattgaatcattctttttgggtttttgaaataaa

SEQ ID NO: 65834 - DNA, 78 bp, Heterodera glycines
  Genomic contig location: Contig_ID=SeqID_36547; Location=681..758; Strand=+
  SCN-specific regions: Sequence locations=1-78
aaaagagcgcccccatctgatattcccatttttccgttccacaactggccaaaggcgactgtgctcattgacacgtag

SEQ ID NO: 65835 - DNA, 1044 bp, Heterodera glycines
  Genomic contig location: Contig_ID=SeqID_36548; Location=207..1250; Strand=-
  SCN-specific regions: Sequence locations=1-351,373-737,773-1044
atgtacaatccgcaaggcattattactctggcacagcataaagtagaagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagactatgtctatcctaacttccaacaactccttggcaatgacaaggagctgctcaatcgtttgattctcgctccacacattgacacgtga

SEQ ID NO: 65836 - DNA, 257 bp, Heterodera glycines
  misc_feature (5)..(5): n is a, c, g, or t
  misc_feature (15)..(15): n is a, c, g, or t
  Genomic contig location: Contig_ID=SeqID_36551; Location=625..881; Strand=-
  SCN-specific regions: Sequence locations=1-109,131-170,193-257
aatcncttcggagtntggcaaatatcgtcctttgccatccgacagaaaatgttcccgcaaaggctgcgccagcgacccgcccccgggccactcattgtcagcccggacattcttctgaaaatgggactgtccaaccgacgaaaacgagcagtttgatcagctcaaagaatggatgcgctgaggcggaggaggagcaatgcctttttgtggaacattttggcccaattccccaatacagcgaaacggacgaaaaagag

SEQ ID NO: 65837 - DNA, 946 bp, Heterodera glycines
  Genomic contig location: Contig_ID=SeqID_7752; Location=1..946; Strand=-
  SCN-specific regions: Sequence locations=1-85,107-110,132-354,376-946
cccgcggcgaattgcgccgctgcgcccaccaaccgccaaactttggccgccgcgttggcccacccgccggtgggccaaaattcgtcgcgccgccggcgccgcccggtggccaacatggacaacacattggacggactggtggccaagcgggcggagcaaatgccgacgccgatgaagcggcgctaccaaagcgaaacggaggccatcgaattgccggacgacgagcaggagactaaggcgaggaggaaaagcctgggattttttctggaaaatttttaaattttgcccgaaatttcagcgcatggaaactgatccggacgtgtgcacgcgcatgtgctcagtgtgcggctaccagggcaaatgggtgtcggagatgatccggcacaagcgggtgcacaccgcggaaagggttggttggtggtggcaccggcacgcaaaaaatttcggcatttttcatttttgcagcccttcaagtgcaagtactgtaaccgtaccagcaagtggaaggccgacctgatccggcacgttgcgagtaagtgccgagaatggaatgtttcgggaaatcaaatccagactcccgatatgcttaaagcgatactttagagtttgagactaatcggcgtggctctttaatcgattgaagctaaaattattgtacgaatttcaagacaaagcttaaaaatgacgcttcgaggcgtaaaaaacgaaaatttcctctgtagaaggaaaaagaataccaaaaataacagccaaattttaggcagaaatcttagaattttgctcaagaatctagaggagttttagaacagtttatttttgaaaaaaaatcgttaaattgctaaaaaaatttttggccccttatagaaacccatggaattcgtgtggtgtcaagtacagccgtaccaaggcgttcgagcttggaaaaacgcccaccgacgctgacgcc

SEQ ID NO: 65838 - DNA, 816 bp, Heterodera glycines
  Genomic contig location: Contig_ID=SeqID_7753; Location=1041..1856; Strand=+
  SCN-specific regions: Sequence locations=1-150,175-206,233-494,545 -596,623-816
atgcagaaattagtctttccattagtgaatctttacaaggacaattgccttcaactgatgcacgaaaagctgaaaaaccaacaattggacacttgggcacaactgaaaaatgccattttgaaagaaaaggaagcgaggtaaaaaatgaagaaaaattattattataaaaattaactttaaagagagcaaaaaatgaaagaattaatgagccaaaaaacaaacaaaattagcacaaagaggccgaaggaaagggtaaacaaaaatatatacaaagtattagatgtagaccaaaccctaattgttcagggaatcgactaccattacttctatcggtttgatgccaatgcgatcagttgccgccactgtccgtaccgccgaccggcgcaaaagaacttgaagccgaccagcacgttgaagagccatctgaagacgcaccatttgactgtgttggagcagtacagaaggagcaacgacattttgaaggaggacagcggaaaagagcaaaaagaagaaggaggaggaaccatcaaaacagaagcaaaacaatgggagagcagcatcaaaacggaatctttaggctgacagagccctaaacaaatcaaatttttaaaaaatcattggaacgcaaaaaacgggtcggtgtcgtttcggtgcccatgttttggtgccaggcccaagtttttgaactacaaattttttcattgtcaatcaaatccaacaatttcggtatcattcgaagcttaacatatttcgaagctgtttataagctatttgcttctcgattagacaattaccaaaaagttcataacatgaaaa

SEQ ID NO: 65839 - DNA, 390 bp, Heterodera glycines
  Genomic contig location: Contig_ID=SeqID_7754; Location=845..1234; Strand=-
  SCN-specific regions: Sequence locations=1-390
atgggcctttgtaatggtgcgagaatgaaagttgagcaaatgcaaccgaatttgattgtgtgtaagattttgactggagacaaggcaggtcagactgtgtacattcctcggatcacgctttgctgttctgaagattacccttttgacctgcataggcaccaattcccgttggtgttagcttttgcaatgacaattaacaaagcccaaggtcaaacccttgagcaagttggaattgatctgaggaaagatgtgtttagccatggacaattgtatgtggctctttcgagagcaagggcttggaataagttgagaattagattagatgatggaaatttagagagaaaggtgaagaatgtcgtgtacagagagttattagataacagtgattag

SEQ ID NO: 65840 - DNA, 102 bp, Heterodera glycines
  Genomic contig location: Contig_ID=SeqID_36555; Location=46..147; Strand=-
  SCN-specific regions: Sequence locations=1-102
ggaagctattcccgaaggattcggtctccccataaatctgggcgcatcggttcggggggactgccccgaaaacgaaaaaaatcgattttttcagagtgtcct

SEQ ID NO: 65841 - DNA, 1805 bp, Heterodera glycines
  Genomic contig location: Contig_ID=SeqID_7755; Location=200..2004; Strand=+
  SCN-specific regions: Sequence locations=1-238,260-383,405-616,668 -689,711-716,838-893,915-1031,1057-1145,1171-1251,1273-1391,1435 -1741,1764-1805
atggcactgtcactgcttgtaccaatgttggcccaatgctgtggtggcacgcgcatggccgcgttcacttccggcgacaacagccccaacgagccgcccatccgcgtgtacccgtgcggtgccggcccgaccgggtcgcgcttccgcgttgtgcccgccaagttcaccggatcgcacaaaatttcgccgacaaagtaagtccttttcttgggcgggaagggttactaagaaaattaggtttttttatttttattttaaagtttagagtttttttgtatgagatgatcattcttagagttcgacttgggcctctggatccaagcctggataggtccatgacatttcggtaacttggattttttcctggacctagatttttctgaatttttgtccaggaaatacagaacccacgtggaatccaggtacacaaatccaggcttttttttcaaaatgtcgagctctaatgatcacaatgaaaaattcgcttgttatgacacttaactcatggcaaagtactgattctcaagggcgttcttgaaatcactaaaatctttacaaatgtattaccatttatatttgaaattcctcttaaacactgtctttttgatttgccaagatttatttatctaaattttgaatttaaatttagaaaaaaattcttaattttcgcataagacaatatcaggaagcaaccaatttcaccaaaaattatcaactaaataaaatttgtttttatattatttttaatattttatttgttttcaacttttatttaaaaattgatacttttcctaaaattattttaaaaacatattaaacataaaataaattttttttgttttcagtgccggccccgtgccggtgatggaggaaattgccaaggtgcagccgggctccaagaactccaaagcggtgtccccatcaattgatgaacaactgttgctggaccaactggtggactcgacggacgcaaagccattaatccgataaaggcgccaaaaattgaatttgaattttttttttcacggcggtggtgatgaggacgacgacgacgattggcattgggcacacaatttcccccccccaaaaaaaacaactaaaaatggcacaattccatactatttgttctgtgggcgagcgtgaataacaaaaacacagaccaacaacacatttaatcataatcaatcatccccaatatgtttgatgaatgaaaaatatgttttggcgttttgattaggtgttatttttgaatttcgaaatttgaaaatttaattatatggtaggggcacattgaatattcaaatgatcataaataagcctaccaacttttatagagggataatatgggccaaaaataaggtaaaagtcccaaaggatacgcagagataatgattttatatttttaatttttttgttattaattattttttaattcttttaacaaactttgatttctcataattattcgaaaatttctcactcgttattattaattattcgtattttaaggtttttatttttagcaaagttcaaaccctaataactttctgaatagtttgaaaacaaagagcataaaactcaaaaaaaacccaaaaaatttatcttcaaaaaagttaattattttcgtagatcactaaactcaaatgaacaaaaagttaattacacaaatttgcattttatcaacaaaaaaaagattttcgtgtctttttgcaatcataacagcatcatcaaatcacttaatcattcattcacattcatcttttactttaactttggtgactattagctgaatttgggtcaacata

SEQ ID NO: 65842 - DNA, 1238 bp, Heterodera glycines
  Genomic contig location: Contig_ID=SeqID_7756; Location=1..1238; Strand=+
  SCN-specific regions: Sequence locations=1-55,87-96,119-195,243 -542,572-604,629-679,792-945,976-998,1021-1046,1070-1095,1124 -1150,1172-1238
tcaatatgaaacggatgagctaattgcacgcaatttggccagtgcaattattgcctaattataaaataaaaataattaattaatttcagctcctccaagcagtgaaaagcaaaaaatgcgatctgaaacatatgggcacaattctgtactgtgcttcacaaaatcaggcattaaaaattttgtcatattattagcatttatttaaatttaaaaaaatggaaaattttgaattttattaaaaaccaaagaggggaccctttttggtttgatttaatatgaaaatttattccagggggttttgggggtccctgatcaccaatcgacacatattttatccaataaacgacttcctaacctaaacctaaacaaagaaaaaaatcataaaacaagaaattaagtcataaaacaagaaatttgaattttcgactttagttcaagttcgggtaagggattagatttggtcaaaatagatgtctgatttgtgattagaacaaattttcatacattattatcacaaaaattttgcaacccaaaagggtctctttagttttttaataaaattcaaaaatatccgcttttaaactagcgccaaaatttttattccaatttccaaataaaaatttcattttgcttaatgaaacgaaaatgtaaatttatattttacggctatcaatttgagttataaaataaaaaaatatatttaaaaaacattttaaaaattttatttcaaataataaatgtaaaataacgcatttaaaatgaaattgaattaaaaaaataatattttttttgccaggataaccgcaagtgttgctcgcatttgaatttgtcggatgcaaaattgggtgttggcgagcgctgcttgcgcttctgcgacccgggcggtgaggccggcatttcatccattgcccggtcggatgtcacgtgtctgttcaattggaatggtaaaaattaaaaataattaaaaaataaattgattttggcattaattaagaggccaattaattaattaaaagcaattaaattagtagagaaataattagtagataaaatcaaaaatattttttgactaaaaaactgaagaatttttgattacaaaaaattggttgttttttgtgcttttaatgagttcaattattttctaatcatttaacaaatcttgcaaattaattgcccctaattagcgctttgttaatttagtgctgatgtattgtcaccactcaggcattaaaatggtg

SEQ ID NO: 65843 - DNA, 643 bp, Heterodera glycines
  Genomic contig location: Contig_ID=SeqID_7757; Location=1077..1719; Strand=-
  SCN-specific regions: Sequence locations=1-91,124-148,169-417,439-643
agtggacaaatccctccaccaatcactttcattccaaatccaatcccaactacgaaatccccgcaaaatgaggctattcagcatttgcctgcttcttcttcctctccttttgcttcttcttctccccccaccttttgccaatgccttcgaggaggaggaggaggaggacaacgaaatgcgggcccaagggcaactttcggatgaggtaattgttgccaatgccaatgatgatggtgggccaaattcggaacaggatgaagaacaaaaccaaatgcgggcccaaaggccaacaccactgccttggcagccaacacagtggccaaccaagccaccgcaatacccgccggggagaccgtggccgggatcaagcaacggcaagggatggggaaacaagccatggtatggcaacggaaactatggcaagggcggcggcggaggaggacgacccaaccatcgaagcggtgccattatgctgcagccggcaacgccgcgttggcgcacgcctcctccctttttcccaactcgtccaactcgttggacaaaattcccaacttaccgacctcgtccacgcccaacgcgtaggcccctcatgcccaattttgtgccgcagaatgtgatcccgggaatgccgtcatcgtactga

SEQ ID NO: 65844 - DNA, 925 bp, Heterodera glycines
  Genomic contig location: Contig_ID=SeqID_36564; Location=1..925; Strand=-
  SCN-specific regions: Sequence locations=1-364,422-470,523-925
tttttgggttttattttttaattcaaaaaacccaaatattaaatttttgctttttgtgaaaataaggattaattttttccaatttttaggtgcgctgtgcggacgaacgcctgctgggcaaggcgtcatgaaatgtgccagtgggtcccgccccgccgaacccactgttctccaccgtcaatcaattcatgctccaatggacacgtcgtttgcgcgacagaggcacgccgatctctgactacgagctggagatacgcgagcgtggcaccaagctgatgtgccggacacacgaatcaaggtgggggaaaacatgagccgttcgtccccctccccctcgtttcatccccccccccccccctcgccgtaaatttttttaaaatttacaattagaaatttaaagaaaatcttagaaaaattttatgcgacttttcagcaattttttgcaaaactgaaaaaatcgttagtttttcaaaaaaaaatgtttttttttgatatttttttataaaaaaatttctaaaatttcttgtaaatttcaaggcttgaatttttttcaaaaacttttcgggggtaaacgatacttgaaatttgtctaaaaaagcactaaaaattggcatcactaaaggtgatcggcgtaaaacggcagcacatctacgagttccgcgtggccgcagtgaacgcggcgggccaaggcgagtggagcaagaactctgtgccaattgctgccacaccatcctcctgtaagccgttgatcaccaagggactgtttgcatgcgacatgactgtgctggtgggtgaacaggccaagctgctggtgccctacgcagcgaaaccatggccgaaattcgtttggagcaagaatggcgaagcgatggatgtgtgtgccgacccacgcgctgaggagaaaatcagcggtaagtgaacgcgc

SEQ ID NO: 65845 - DNA, 607 bp, Heterodera glycines
  Genomic contig location: Contig_ID=SeqID_36571; Location=626..1232; Strand=-
  SCN-specific regions: Sequence locations=1-96,118-500,522-607
atgagcaaacaaatctcatcggctggcacatggccaaaacagctggcagcaaaactatgcgccatctacgattttcctgtaagtaaaactacaaagagttttatgataattggtttgggccgtcccaattttgagggcccgaattttggcacttttccaaaatttttcaggttgccgttccgtgctgcaacggcttcacctcgttggtgttagcattacgctcagctaacattggaccgggtgccgatgttttgatgccgtccataacatttgttgctgtctcaaatgccgtcctcaatgttggtgccaatcccgtgtttgttgactctgctgatgaatgggactataatccaagttggtctctgctgttacgagcggcaactcagaaaaccaggcacgaaaaaatcttggaaacgttttgactggggcgtaaaattataatgaaattccatatttttttttcatggactgtcttaaacggacaaaaatatattttatcttggcttgaagcttctatgtaaattatctatgtccatattaagggtgaaaatgttatgaaagtcttttttaaaaaaaggaagtttacgaatttattttatttaataaa

SEQ ID NO: 65846 - DNA, 1751 bp, Heterodera glycines
  misc_feature (1600)..(1600): n is a, c, g, or t
  Genomic contig location: Contig_ID=SeqID_7758; Location=561..2311; Strand=-
  SCN-specific regions: Sequence locations=1-273,313-339,377-410,432 -580,624-627,649-775,810-922,969-1109,1131-1368,1390-1751
atgtcggaattatgtcatttgccgaatcggtaccgtaaaatataccgaaattgtgccgtctcgtgcacatcagttggcacccgctcctccgttcgccagcatgccacaaaaccatttgatgccagctgcagttgcgcaccattgtcagcagttggcttcagcctccgtcttggcacagttgaagcggtggttgtacccaatgggagcagcacagtttgttggaaaggccttgacacaacggcaatgtcgcgccaaagtgcgacaagttggagctaaaattaaaattatatatatatatatttaaataattatggcacaacttggtgacagttgaagagcaatttatcataaaaaattattttatttattttttaatccaatgtcatcatttgccagtaatctttgcacacataaattttaaattaatatttcaccaaattttgaatctttttttttcaagtcccattcatcattgaggaagatttgaattattctgcattaattttagccgtgctggggcgtttcttaaaaattgccaagtgggcgagaattaaactacaaatataaaacaactatagagaaatatttttatcaaaattttattgatataagtttttatatatccgtatttcttttttaatttcttattctttaaagtgttcaccaaaaacatgaactgacaagcataacaaattctaaaaaataaactagagtgccacgggaccgggaattttgggcaaaccaagtcccggtcccgtgggcactctacaataaactatttaaaatacaaataaaacagacttttgttaatgaacattcagcactttcatacaaacatttgcaaaagcttttgtcgcaatcgtagcgttttttagattttgtttatatagcataaatcatggtaataacagcaatcatcgactatattatttaaaaatgtataataaatttaaaatactttatttaaacctttttaaagttgcaaaaccatattactggtgctacaaagcatgtgtcaaaaaatgaagtgccacaataagtgcttcaatatttctttgcaactttcaaagggaaatattaattataataagcttatcagaaaaaaatgaaaataattaatttatcttttgtggttttcttattagttcataatgaccgtagcgccaacttggcagtttttaagaaacgacctagcaccccttaaacacattagtttttgcggactttgggcagttcaacgctggaaattggtcacatctccaataaattgtatctcctaggtgttctctaacctagtaaaattgaccctcatagaccaatttttttttcagctccgtgttgcgactcatatgagaggctatttgtaaaaatcagaatgattaaataaaagaatttatatagactcaatgcctagagagttgcacgtggatgagttgcccgtggatgagttgcacgtggatgagttgcacgtggatgagttgcccgtggatgagttgcacgtggatgagttgcacgtggatgagttgcacgtggatgagttgcacgtggatgagttgcctgtggatgagttgcctatggaatgacctgccactgcgccagnttctgagttggttccatgtgacactaaaaaatgactttttcggaaaattttccggtctttaagggtcaaaatccaaatttagctgatgggggaccgttctaatagaggttttttgaaatatttggaaaaaaatgggaagaaaaagaataaa

SEQ ID NO: 65847 - DNA, 500 bp, Heterodera glycines
  Genomic contig location: Contig_ID=SeqID_7758; Location=2574..3073; Strand=-
  SCN-specific regions: Sequence locations=1-386,452-500
atggcgccgtcggataggccaaccaacaattctgtctcggacaaacaggccagtgcggtgatcgactgggagctgttcagcgcaaatgcgattttggacggctcggaaagcatcacaaagtcgtccaacttgtccaacatgtacaagccggtgccatcggagaacagcaaagtgaccattgcatcggcatttggtctgccgggtgctccatctgtttcaaaatgccatgctgactttctctatttttttcccaatgaaattgttcaacaccatgaacttgctgcaacgtgatgttcagcaccagttcatcctcgtcaaatgtaattttgttgttgctgttcagcaccattacatccgttgttgctcccgttgtactgctctgcaccgttggtgtcgttgttgctattggtgttgttgtaatcggcgttggaatttgtgccgttactgttgtctcacttgtgccaacatcagcaatgcccaactggaactgttggtgctga

SEQ ID NO: 65848 - DNA, 643 bp, Heterodera glycines
  Genomic contig location: Contig_ID=SeqID_7758; Location=3660..4302; Strand=-
  SCN-specific regions: Sequence locations=1-105,137-141,163-346,375-643
atgaagtttggcgaatttgtcaacgttaaaaccgtggcattttcgcaggtgtaaaaatggcatcgcataatgcccaatttgtcgcggacagcataaattcgttccttaaataataaaataaataaataaatttttacagtattcttttttcaaaattttattaagtaccgtaatctctgagacaacaatttgtgttattggcactccgtccgctgctttgatccgttcaacatgaacaatgtgttccacattttgtggtgagatagtattattgatgaactgctgctggtgatgatcattggacgggttcacattgttggagcctagataaaaacatgcacataatgccaaaagttttgttttaaaaggatttgaaaaaaaaatttagcattgcataaaattatagcaaatcactagggatgggatttttaggcaaaagcctatttttttcctgagctccccgtggtccgaaacgcacgaaaaacatgtttttttgggctgttgttaagctatttttcgagttattagtgcctattttctaggcttttatttttagcgcctaaaaagcctaaaaaaatttgaaagagcctatttttggctattttggcgttttgcccaaaattattaacaaaaatgcaataaa

SEQ ID NO: 65849 - DNA, 891 bp, Heterodera glycines
  Genomic contig location: Contig_ID=SeqID_7758; Location=3816..4706; Strand=+
  SCN-specific regions: Sequence locations=1-113,142-325,347-351,383 -523,552-570,592-596,659-680,702-746,793-891
atgtttttcgtgcgtttcggaccacggggagctcaggaaaaaaataggcttttgcctaaaaatcccatccctagtgatttgctataattttatgcaatgctaaatttttttttcaaatccttttaaaacaaaacttttggcattatgtgcatgtttttatctaggctccaacaatgtgaacccgtccaatgatcatcaccagcagcagttcatcaataatactatctcaccacaaaatgtggaacacattgttcatgttgaacggatcaaagcagcggacggagtgccaataacacaaattgttgtctcagagattacggtacttaataaaattttgaaaaaagaatactgtaaaaatttatttatttattttattatttaaggaacgaatttatgctgtccgcgacaaattgggcattatgcgatgccatttttacacctgcgaaaatgccacggttttaacgttgacaaattcgccaaacttcatttatcggctagccgaagatgcttggaatgggtagagaaataaatacaaaattaattaattatttgatctcggattcaattagaacaaataaaaaggcaattagcaacccaaaaaaaatgaatatttaattatctattttaatttaattggttttttagatttttatattatgccacaacggctggcgatgtgttcaccacaccgatgctgccgttggatgcgagccaaaattattcactgtccatcacgcgtcgggtcgaaaataattattaaatattttaaaattaattaattataaatttttacgtattttaagttagctgaattaccagctgtgaacagtttggaagtggatttggctgaacaaaagctgatcactgtcagccgcacaggacaactgatca

SEQ ID NO: 65850 - DNA, 118 bp, Heterodera glycines
  Genomic contig location: Contig_ID=SeqID_36573; Location=46..163; Strand=+
  SCN-specific regions: Sequence locations=1-70,92-118
atacacaaacacaaggaggaattgaacttgagaccccctttttggtgactaactcacagaccactaagacgaaaaaaccaacttaattgtacttggagcccaaaattgaatcgccgtg

SEQ ID NO: 65851 - DNA, 869 bp, Heterodera glycines
  Genomic contig location: Contig_ID=SeqID_36575; Location=139..1007; Strand=+
  SCN-specific regions: Sequence locations=1-869
  Gene Ontology: Mol. function=calmodulin-dependent protein kinase I activity; Cellular component=synaptic junction; Biological process =induction of apoptosis by extracellular signals
tcacccttctcgtggagagtggcgccaacgtcaatctcggggacagcgaaggagtaacgccgataatgatcacttctcgtttcggaagggtgaaaaaagcaaaacttggaaaaacttggcattttttgtttgttcaggtcgaacctgtgcacttcttactttctcacggtgcaaacgttgaacagatggattacagcggtggctttttgcccgtttttaaataattattgcactaattaatatgtctttttcaatttcagggatgcgatttgctcttttggacgccgccgctgatggccatttggaggtgtgccgtttactggtggacgattgggcagctgacgtcaaccagcaagcgatcgacggtaccacgcctttgatgggcgcgtgcagcttcgggcactttgaaattagtaagaagcaactggtgcataattcgactcaactttctgccccaattttcagcggtttttctcatcgaacatggcgccgacattgaccacgctgacatggacgggtacaacgcgttgatgtgggcagtgaagtacgagaaggctggtgtggcgcgacatttgctagcgatcggcgcgaacgcagaccaagtgggaattgacggtgggtgggcccaaaaagggcttaattgtaatgctccaactgattgactgctctccccctcccccatttaaggcaaaagggcgatagatttggcccaagaaggcagacgtgccgaaatgatcgacctttttcgaaccacagctaacaatgagcagcgggaggatggcaatgcgtaagaaaaaaaagaatttccgatcaaaaaggatatttttgatttcaggcaacaggacgagcaaccaccgcagcaacagtaa

SEQ ID NO: 65852 - DNA, 872 bp, Heterodera glycines
  Genomic contig location: Contig_ID=SeqID_36576; Location=109..980; Strand=-
  SCN-specific regions: Sequence locations=1-542,564-759,781-872
gacttggacggtcaaattttgcacggacgcaatctcgactatgggtggactcagctgctcagagagccaccacattgtggtggattatgtcagggacggacgagtgcaattcaccggcatccaattcatcctttatagtggacttttgaccggacaacgccctcacgcgttcactttgtctctcaatgctcgatgtaaactgttcccgaatagcgttgattttgcgtaataatttgtcgcgatcagattccggtggcccatgggataatcttttgatggcactgatcacccgctttcgtcatccaatcgcatttgaactgcgcaaagtgttggaaactgtggacaattaccaggaggctgttgacaaattgagtcgcatcactacggttgcgccatcctatttaatcgttggcggagggaaaggagacggcgcgatcatttcgaggtgctaattaagcaatttaagaatgaacgtgattttttcggcttattagggaccgatttggagtggccgatgtgtttttcttggactatttgcaccaccggtggtttctcgtggagacgaacagcgacccatgggagcgaatgacggacaagcgaaggtgtgcagaagattagccatgccactcactttcaattgcccacagaacaaaagcggcccaatgcctaagacgggtcggccagcgtttcatctccccaattgcgctgtcctcccgcgtcctcgccattccgcccgtccgcaatgagtcggccgggccaaagagccgaaaattgggaaaaataatttcagacagaccatcttcacaacggtaatgtcggcggaacagcccaatttgatttacaacttcacaaaagtgtggccaaacgcagaa

SEQ ID NO: 65853 - DNA, 739 bp, Heterodera glycines
  Genomic contig location: Contig_ID=SeqID_36577; Location=302..1040; Strand=+
  SCN-specific regions: Sequence locations=1-147,171-576,598-673,700-739
caaacctcaagcaaaatgaactgtgtacattccaagcattcacttgcgacaataacaacagcagatgtcgtcgcgttacgaaacggcgaaaagcaaagggacgaaacggacgcggaatcaatgggagagggaaacggacggaacgacaacggcaccagcagcaacagcagagaagaagcactgatcagactgatcaaaagccacatccgactcggtgccatgtgcggcagcattggctcgttcatttggcacattcaacggcaggtaaaagaggccatggcacggagagaatcattttaatatccatttgaactgttcagattttctacgcccattgtgccaaattggtggcactgttcgctgtcgccgtcgcccaccttctcttcctccacccttttctcgatttgttttcgcgcctcgaaaaatacgccagccaattggactttagcagcgtggacgccgaactgatcagacaaagtgtgcacgacttggccgatgtgagtgttggcacggatttgtcggcttaagtgtcggttgccgcccagcggggacacttttggcatttgtccaaattttgtgggcctttcccccgggccctctcagcacaagcatttccagtacaaaaagaacgtgtggatgaccgtggccgtgctgtgtgtcggactgtccaccagctccttcttcctgtttctgctgccctcgtcgtcgcccgtgcgcaaatgccacgtttatttggtgg

SEQ ID NO: 65854 - DNA, 600 bp, Heterodera glycines
  Genomic contig location: Contig_ID=SeqID_36578; Location=143..742; Strand=+
  SCN-specific regions: Sequence locations=1-102,126-268,290-600
agtcagcaatcgttgcttaacttgccagatcggacagcactgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaac

SEQ ID NO: 65855 - DNA, 921 bp, Heterodera glycines
  Genomic contig location: Contig_ID=SeqID_36579; Location=35..955; Strand=+
  SCN-specific regions: Sequence locations=1-71,103-425,448-485,507-921
atgatggcagactttcggagacgcactgaggcggaggaggaagcgattttgaggtttgtttcgcattgggttttctttctcttgctctgactaagtgaattttgcaaccctgtcaaaaaaaagttgaatgaatacagagttgactgatgtttgcttatttcgctaaaattttcacaatttttttaggtgtgtggtgaaggagcaaaaggatggacaaagtggtgatcagcagcaattagacgaacaacagctaagacaaaaggtctgtcgccggtggtcattaggcaatcatttgtgacgaattaaaaatagtcattttttggcgaaaaatggattggatacaaacccatgtaaaacatgcctcccaattcatgtttttttgaaaaaatacagccccgaaagtcagtgtgcccttaaacaatttgtttttacgtaattatatgtttatttcagggggcaaatgtggactacatggaaatgggcggggaggaggaggacggactgtccaacggcggaggacgcaaaatgctcaaaatggagtcatcgtcgcccgtcaacaacagcaaggcatgtggttaactgggggaaaatgagccgaaccgtggaatggacggagattatactcttgcatttttagatgattttcattggtccggtcaagcccattgtccaacaatcgccgaccgcacctcaaaagctgcccaaggtggagctgcgcaaccagtccatcatgttggacctttctgatgttggttgggttgggtaaattgggcgttgggcggtgggcaaattaatggacggacacacaaaatcgaaatacggacaaactcaggaaattaggtgaacaggtcgagacataatgagcgagggagtgtcttaggtgttagggtccacattggtgaccattgacatgtaagagaa

SEQ ID NO: 65856 - DNA, 49 bp, Heterodera glycines; identical to SEQ ID NO: 51181
  Genomic contig location: Contig_ID=SeqID_36580; Location=736..784; Strand=-
  SCN-specific regions: Sequence locations=1-49

SEQ ID NO: 65857 - DNA, 551 bp, Heterodera glycines
  Genomic contig location: Contig_ID=SeqID_7761; Location=1161..1711; Strand=+
  SCN-specific regions: Sequence locations=1-5,28-182,221-488,517-551
atgatttatttatttccattttcttttaagggaaatctgtcacggattattttgccacacttaaattttgatctgcttggcattgagttctatgtgaagtttccgaccaaccttcttttcacgattgcttttagcagtaatgcgccatttctttatatgttcaggtattaaaaaaaattaaaattttaatttaatttatttattttattttattttatttgcagcactgaccatcaaaaggcattccgttcacaattcaaacggatctttggcaaaaacgaatcaaagcatttaattgttgcattcgctaattaatttcatcgaaatttttaaaggcgcttcaaaacaaaaacaaaaaattgactttcgattactaatttttttgataaaatttagcattaaaagctcttacctcaaaatcgaagctttgcgctgtctatagcataataattctgttggttttatcttcaatatttattctaagtaccagcttatttttattttaaaatagaaacagagggtgctatgacgttagtcaaaaaaccatcaaa

SEQ ID NO: 65858 - DNA, 407 bp, Heterodera glycines
  Genomic contig location: Contig_ID=SeqID_36582; Location=255..661; Strand=+
  SCN-specific regions: Sequence locations=1-407
atgcgttcttttttcttcgccagcctcgctttggtgctcatttgtgcctccaccactgtttcaaagccccacccgacggtattgtggtcatttttgaaaatgcatttaactgtaattttttttcttttaagcctgccccatctgccaagaccaatgaaaaaggttgctatcaagtgtgctttgtcgttgtgtgcatcaacatttgccctaaggccaaggttggcatttttttgtttataaaactttgggttcagaatttatgtgctaaaataattcaatttaattgccaagaacgatgaaaatggtgctgctgtgaaatggcttaacatttccgtgccaatccccgacgccatttccctgccttcctttaacatgacaaacattacccaaggcgaggagcaggaaga

SEQ ID NO: 65859 - DNA, 495 bp, Heterodera glycines
  Genomic contig location: Contig_ID=SeqID_36583; Location=22..516; Strand=-
  SCN-specific regions: Sequence locations=1-221,243-334,357-368,390-495
  Gene Ontology: Cellular component=Golgi membrane; Biological process =nonselective vesicle docking
atgctcgatttgctgtgtaaagttttgctgtcacaattgggtgtgtctgtggaggttttggccgagtcggtgatcactgtagcggagaccatccgggccaattacgccaaccaggaattctttgcacaatccacagtggctgaccaggacggcgttaggtgtgtgtgtatagctggaagaaaaaaacaaaaatactgataagttaaaattgtaagaatttcatgaataaaacaatgaaaatctcctgaatttcacgccttttctaaggcccgctttactgattttgcttctgtcgatgacttctgaacgacaacccttccgtcttcgacttgccgttttctattgttttctctgttatttgtatgataatgagaagggcaaagtcaaggtttctcaattcattggtttatttgcgacttttattattttctatcagatcattgacatgcttttgccacaaaatgacaatcgttcttctgaagaggaaggcaacac

SEQ ID NO: 65860 - DNA, 196 bp, Heterodera glycines
  Genomic contig location: Contig_ID=SeqID_36584; Location=89..284; Strand=+
  SCN-specific regions: Sequence locations=1-55,81-196
tgtcaacaatgtcaccgccgttttggatgcaatgttacgcatcaaattgtccgttgtgcccggcccgttgctcagcgtgttcgtgcaaaacattgccaagctgtacaccttccaactgtgcaaattggaggcggacgacgattgggacggaattgaaacgttggacaatttgctcacctccaaattgcccgagtag

SEQ ID NO: 65861 - DNA, 584 bp, Heterodera glycines
  Genomic contig location: Contig_ID=SeqID_36586; Location=1..584; Strand=-
  SCN-specific regions: Sequence locations=1-111,133-173,197-306,328-584
tcgttgttgttgcacgtatgcgcatgatgattgcgtggaagcggctggggttgtactcagtgtttacgccacgctgcgcaattgccaaaaattgctcccgagataaaggttgaacatttattttaaaaacaacagtataattggaaattgaacacatctacaaaacaatggacaaaatttcaagagggaaaaaagttttgtgatctccgcctccaaattcaacgacgcacggcaagttggggtggcgcaagcggatgccatgctttatgtaatagtgcatccggacctttaaattttttgttaccgacaaacaaaacaaataaaaataccgttatgccgaggtagcctcggtacgcgggggccgagtgggtgtccaggatggacaggtcattacagcggaccggaaaattgcgcacggacgggcgcaggtgggcggtgcgcagttggacggagcgcaaatgctccacaatgtcccggcgtttctctaggcttttgaaaagcacatgcagctcgtgggcgttgcatttgaaccgcttgcagaggtaaacacgagcggaacggggcgacggcgttcggcacatgca

SEQ ID NO: 65862 - DNA, 794 bp, Heterodera glycines
  Genomic contig location: Contig_ID=SeqID_36587; Location=80..873; Strand=-
  SCN-specific regions: Sequence locations=1-163,200-217,244-256,280 -381,424-588,681-689,711-794
actgagcaaggaacagcagaatcagaaaatgaatccaacacttcgtccggtagcgttaaactgcttgaaaatgacgctgaattggacagcaacaacaccagtaacacaaatgaaattgcatcaaatgtgaatttgagggcagcaaatgtgtctgatgttccggtaattttctaaatattattttaataattcattaattgggttttgttatataagctaattgattaactaattaattaattaggtttttgattacaaaattgaaaattgaaaattttcaatacatttaaataggccacttcactcacaatcagctgcacataaattttatgataaaatcttcaaaagttctgataacattttttatgctgaatgaaattcttatatttatttatttcatatttatttataaattaaaattttccaatttcaatgggaaatttttttaaatagcaaattattttgaaaatttgttttcagacaacatctgagcaaattgtctctgtgcctgacgcttcacaaaatgtttctactgagaacgatgaaatttcgttaaacaacctcacaaccgtattgcctaccgaagaaactgttactgtaacaactaccgtaagcactacaaccgctgcccctactacaactaccataactactacaaccgctacctctactacaactaccgtggcaaagcaacaaacttcacggaagccggtcaaatttgcaatgagtgaagatgatcatccccatgtgtttttgctgggtgacgaatgcaaggtggacaattaattaataaa

SEQ ID NO: 65863 - DNA, 618 bp, Heterodera glycines
  Genomic contig location: Contig_ID=SeqID_36588; Location=33..650; Strand=+
  SCN-specific regions: Sequence locations=1-155,177-333,360-618
agagagcgcaaggaggcagccacaacaaccggacaacgacgcaccgacgccacgcacagcgccgcagggcgccccacgagcgcgcaacccacaaagaagcagcgaaccagccaggcgaggcggacacgccaccgacacaaggccacgcagcagccagacacaggcggacacacgggcagcacagagcgggagaccacagcaccaacgcaaggaagcaccccaaaagcatgggacgcgaggcagctgccccgaaaagcggggcagcggccacaagccagcacgaacgaccggggcccaacagcggacgggggcaaacgggggggccaacgcgagcccaacaggacagcaggcaggaggcgaagaggaaccaccaggggaaagagccagcagcaggaacacccacagcgaccccgacacgacgagagcccggcccaagccacagcgaggaaaccggaaccagacagcacaccgaccgaagccggaacaccaaccgcccccgaagaacacgaaaaggctcagacccgggcagcgacgggcggcgagaacaaagggcagggacgaatgcagagcgagcggatgactcgcccctacaaggaattcctcgttcacggacaataa

SEQ ID NO: 65864 - DNA, 480 bp, Heterodera glycines
  Genomic contig location: Contig_ID=SeqID_36590; Location=479..958; Strand=-
  SCN-specific regions: Sequence locations=1-144,166-223,256-394,417-480
atggcattccgagaccccaaaaatttacgaaatcggaattctgaccccaaaaatgtcggaactcggaatttcgtgccatccctactctgtaagctggggtcacatatgaaataacggggatcacgaaagtctagtagacagtacgggagggtgagggaggagtaggcggttactgtactgttttttatttttttcacacgctgagcacgaagacggcacttcgaattttaatcatttaattttatttttaaaattccagcgccttctcaagcctcaccagcaattaccggacggaggcgaatattcgtggcgatctcttcggcggttggcgccggagcagcgccgattagtggagagggagggcgttgaaaatgttccggtgatttggccaccttatttaatatttttgtaaattactgtaacaattgtatgactttttactgtattgttttaccatttgtgaattttcgtataaataaa

SEQ ID NO: 65865 - DNA, 1601 bp, Heterodera glycines
  Genomic contig location: Contig_ID=SeqID_7762; Location=543..2143; Strand=+
  SCN-specific regions: Sequence locations=1-298,320-1601
atgaaaggacggcccgtgcctttgcaaagtgtgatggactgctcaaaacagctgtgtgcctttagtgaactcgccgttgctgaacattttcccacttttcttcgcccttctgacgctgtcgcttatttggagtcgtacgtgcgaacattcgaattggcacggcacatgaaacttggcacggaagtgaggagaaaaaaatgggaaaagctcttccgttttgtgcgctttaggttaaaacgattcgccgatcggagtgttggcaaaagacagataattagcgggggattggcaattaaaccaatggattaattaattaatcccttttcaagccgatggattgtccaatgggcggacagtgaacagccgaacaacggcccatcggaaggacagcgactggtcgaggaactgttcgatgccgttctcatctgttcgggcgcccgcctaaggcggtggcgccccccggagtaccgtatggagagggcgttcaaagtcgaattcgaatttcctccgccaaactccgtcccctccctttgcttagggcacagttatccattcggaacagttcacacattcgtccgactttcgtggtcagactgtgtgcgttgtcggccttggtaactccgccgtggctatttccattgcattggcacacacagccaaacaggcactttatgagcttggctttttgtttccttatgcttcacattgcgtgagctgacctttcattttttgcttacattttcaggtgtttctgtgtactcgtcgtggtgaatggatattaccattgcttcaatccgacggacagaagccatgggattggcctttcagcagccgatggcatttttggggtcgccgatgggtgccgaaatgcctccgaaatttttgttgggaaatgagtgcccaatcagtatcaccagactgttcacaaaacaacggaattgggcgaccaatgcatcgattgctgaggtgacaccgctaaaagacttctgcggaatggcctggacaaaatgccaaagtttagtgccaatttgacatttggagctgaacagctctgcccactgcttgcttccggccgaattcgaattcgcccaaacattttgtcattgtccgactcgaatttggtcgaattcgccgacagaactgttgaacaacacgtggacgcgctggtcatctgcacgggtttcgaattcgactttaatttggtcgaacatggcaaacctttgcgagtgatgcacaacgatttccatttggtactgcggacaatcaaatccgattttcggatttgccattgccttcactttttcacagtataagcatatgtacgcgccggagttggcgccccaccacactttggccgttgtcggacatgtccaggcacctcttttcacacccttttaaacaattggattgcttaagccccgcgggggaagcatttggccaattgccgaactgcaggcgcggctgtttttccacgtgctcagcggacacacgcaactgccaactccctttttgatgaaggccgaattggagaaacgccgttgtgccgtgtccacggaaatgctaaagacacgaaggcacacacagacggtactcggcactga

SEQ ID NO: 65866 - DNA, 746 bp, Heterodera glycines
  Genomic contig location: Contig_ID=SeqID_7763; Location=2367..3112; Strand=+
  SCN-specific regions: Sequence locations=1-118,140-391,482-715,739-746
atgccaataagccaatttatggatgaaagccaaagagaagtgagtgacgacgacggaagttctaattgattgattgagcggactaattgattaattgttagtggccgagcgattaagcggaaatggcagtcggtggaaaacaagtgaagcaaaagctaagctattgattcttaagcatttcagcgattgcccatccctacgacaaattaagtaataaacggagggagaccaatcaaacgattaaacaattgacgaatatatttgttttattcaaaaaaattgccaaatttgacaaatccatccatctgcttagattttttcgagagtacgacttttcttcggattgactcaaaccgaaatccaaatttccaatcccagcggttgctaggacgagggacggggccgaaagagagggggaaggaacgggagaggagtggggggggaggcatcgaatacgtggaggcgggggggggcgaggggaattcgcgatggatttatggtggcggcgtacttaaaagccgtgggttggcacaaaaggtaactaattgacgagccaaaaacatcggtggtatttgcaggcaaacttagcaacagagcatcaattgcatatgaaaatatgcaattaagctcaggtcaacacatgacaattaatattttcatgtcaaaatttaaggaattaattaatgagttttagagcaggcagaactctcatttttatgtgtataattaattttgtatgtaatata

SEQ ID NO: 65867 - DNA, 696 bp, Heterodera glycines
  Genomic contig location: Contig_ID=SeqID_36593; Location=6..701; Strand=+
  SCN-specific regions: Sequence locations=1-384,406-443,486-498,521 -558,580-696
atgccaccgctcattctccgcgaatggaaaccttatatgagggagttcgatggatgttatgaaacaaacggacaaaggagtggagattgcccattgaccgatcattccgatgcatcatttggaggagacttcttccatgtaattttgcacactcacgaaatggatcttcaacgtgtgtgcgacggaactggaacttgaaaattaatcaaaattatcattgcttataacaaatgattgggtttcgagtgtgggcgattggcctgtttttctaacattgtgtacatccgtcgttcaccgatctgtttgttctgcgtctgtccaacgtttagtggcccataattatggattcccgatcactatttcgaaatttgggaattcatcttattttcttttggcaaaaattgtgtccataaaaatatgggacgacatatttgacattagcctttaaaattttttccggaaaattttaaaaaactaatgttgaatggtccattggcaacaaataaaaattatttgtcccttacttttatatattttcaggccgaagacgagttcactctttcccacatcccttttctgggcgatgccgaggacgacacgtcattctgtgccgaactgatgaaaacattccaggacggcatccacggcacggtcaaaggctgcggagagttcgttggcccaccaatttgtctgtaa

SEQ ID NO: 65868 - DNA, 368 bp, Heterodera glycines
  Genomic contig location: Contig_ID=SeqID_36594; Location=192..559; Strand=-
  SCN-specific regions: Sequence locations=1-75,101-240,262-262,285-368
  Gene Ontology: Mol. function=phosphatidylethanolamine binding
atgacttttaggctcgtcgtgaacattcctggcaccgaggtggacaagggcgatgtgctaagtgaatatggttagttattttatttatttttttaattttccgttttaagttggttcggggcctccccaggacacgggtctgcaccgttacgtctacctgatttaccaacaaaagaacacaattaaagacaccgaacacggccacctgaccaatcgttctggtaatatttggtttttttctaatttatctaaatccctggagaaaattatatattaaaatttaaggtgacaaccgtggagggtggaaaactgaaaaattcgcgaaaaagcacgaacttggcgacccggtggctggcaatttttatcag

SEQ ID NO: 65869 - DNA, 185 bp, Heterodera glycines
  Genomic contig location: Contig_ID=SeqID_36596; Location=390..574; Strand=-
  SCN-specific regions: Sequence locations=1-37,60-70,93-185
atgtggcaaaatcaaaaggggtcagaacggcgaaacggcgatgggaaaaggaagggcattcgggcaacggctggtccaaaagggccacacaatggcaaaggaaagggagggcactcgagcaggcgcggacagggagggcactcgcacagacagagagcagcgaaggccgggtgcagtgaaaggcg

SEQ ID NO: 65870 - DNA, 217 bp, Heterodera glycines
  Genomic contig location: Contig_ID=SeqID_36596; Location=696..912; Strand=-
  SCN-specific regions: Sequence locations=1-217
tgtcgtggcgacaaaaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgg

SEQ ID NO: 65871 - DNA, 661 bp, Heterodera glycines
  Genomic contig location: Contig_ID=SeqID_36598; Location=73..733; Strand=+
  SCN-specific regions: Sequence locations=1-661
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactccagaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgcccccgaaacc

SEQ ID NO: 65872 - DNA, 969 bp, Heterodera glycines
  Genomic contig location: Contig_ID=SeqID_36601; Location=120..1088; Strand=+
  SCN-specific regions: Sequence locations=1-10,55-273,295-339,368 -410,473-542,564-597,636-948
atgaaaacagtaagaattttttgaaaatttttaaaaatcaaaatttagtctgtttgaactttgcttatttggcccaaagtgtgtccattcaattggccgttattgttgatggtcgaactgtgtttcagattacagtatcgggtgatttcttactgtatttgtgtttggtaaaaacagggagaatacaggaaccgacagatttttgaggggaggcggaattttgccaaatttattttaatttattcattcacaaggaattatttttcttggattattttgaataaaaaatatttggcaatctatcacttagagttttcccatttttcaataatttttcactattttaaaatttaaaattcttaatttagccataaatcctccgccaatttgcttgcctttatttgtcggcgaattgtgctttgaattttacaatgtaaaaagaaaaataatttagtttaatttaatttaatttttaattttttaaattttttagctcaatgtctcgcataatttgttcagcggatgtgccctttttgatatggttttgctccatcaaaaagtcattcacgaagaattgggctgcttcaaaattccgtgaattttattttaatttatttttttaaaatttaatttatcaactttaaattttgaatttagagttccaattgcttcggaaaatgaacattgaaagatgccatcgagaattagctaatttttgcgatgaaattacgattataattgttattggagaaatgattccgttttatttggccctgaaaaaaaagattgaaattaaatattagaaaaaccgcaagttaggcttaatgaataatattcctaagccttcttttgagaataatgaatttgctcaaggataaattaaaatattgcggataaaatttagaaaatttataaaattggttttttcttaaggttgaaactcggcacaaaattttaaaaaaattatta

SEQ ID NO: 65873 - DNA, 301 bp, Heterodera glycines
  Genomic contig location: Contig_ID=SeqID_7764; Location=228..528; Strand=-
  SCN-specific regions: Sequence locations=1-4,26-275
atggtaataactattaatatcccattttcgtgggatggagggggacgggggctaaagtattgaggtgacgagagatcggttggccaaaaaaattaaaatggttaattaggattaattcaatttcaattttgataggtgttcacaaagccggacatggtggagcgtttctttccggatcccaaagaagcccatactgttgaagcaattcgtaaggtccaagcaatgagttgggcactcggagacgacgaaaatgaagcgaaggaaattaaaaaggcaaattaaaatatttaaaaaaattaaa

SEQ ID NO: 65874 - DNA, 453 bp, Heterodera glycines
  Genomic contig location: Contig_ID=SeqID_7765; Location=873..1325; Strand=-
  SCN-specific regions: Sequence locations=1-13,35-130,181-289,316 -380,429-453
atgaattatacggaagataatttggatgaggatacaaagaagaaaattgaatctttactcgatgatcgtttctgcgcggtaaaactggcaatgagcaaaaaggaagtgatcgaagcaataaaaatggttcaaatttaataatgaataattttaaaaattaaaagaaattttcttttatttcctccggaattaaaaaacttatataagtatttatccaattttactatattaaggccgccaaaaaactacttgagaggggttttctattgcctcacgacattgaaaagtaatatatatatatatatatatatatatcagataaaaatttttcagaatttaacaattattccaaaaaattgtgacttttatatcttatttggttaaattttaaaaaaattattaaaattttattctttattcttttattagcgatgttaaattccttaaaataaa

SEQ ID NO: 65875 - DNA, 1236 bp, Heterodera glycines
  Genomic contig location: Contig_ID=SeqID_7765; Location=2960..4195; Strand=-
  SCN-specific regions: Sequence locations=1-72,94-125,175-397,420 -576,607-730,778-937,984-1075,1119-1160,1196-1236
atgggtggaatattccggtgaggcttatatttagttaagaaagcttattcagaaaaaggaaggtattggaacttttttaaaaatttgaaattagagtgcgagaatttcatacgtattcaggacggattttaaaacaaaaatcattattttattaaatatctatgaaaaaatttagattcatttggattctttgcctataccatcaattgaatgcaattgggctgttggaagttgccgagcacgagtgtgcacacttggctattaacgaaattggagagatttactttcagttcttaaacgtaagtttaaagagaatattaaactttatatgataaaaagaaagcggataaggataaaagtccaaaagatgggattatactatggacgaaagatgttttattttaaaattgaaaaataaggataaaaattcttaattaattttgcttttttgcccaattttaaaattttgcctttgcaattctacccaatttctttagcattttaacagatgattctgtgacaaattttgatgcaaatccaaaaaaaatccttcagattgtaaaataaattgaattattaatttcctttctttcttttatggtgtttcatatcaaattcattatttttctgcaaaggcttattatatgtcacaaaaacttgtttgttttcgtcgattggtaatgcgcaaaatcataaaaaactagcgcattaatttttatatgcaaaactgaatttaatatgttagttaatttaaaatttttcttttattttataaaagtaataagcaaagatgttgtaaaatacaatatctcttaaatttattctaaaaatgctcagcttgaaattttttcaagcttctaaaaagcaaaaattttattatgaaaaatcataaaaaatagcacagcaatttttgtattcaaaactgaatttaatatggtatttaatttaaaatttttcttttattttataaataatgattttatctaggtaaaaaaagtttaaaaatagcgaaatgaaaaattctgcttggtaggcctttttacttaaaaatcaataaagtttatattataagttattattttggaaaatatagaaagattcatatacataatttgcaattttatttatatttcagtattcttggtctctttcttagggctatattttgttacccattttttaattcaataagtttcagctcaacctggaaaattaaatgaccacttaattaataaa

SEQ ID NO: 65876 - DNA, 932 bp, Heterodera glycines
  Genomic contig location: Contig_ID=SeqID_36605; Location=7..938; Strand=+
  SCN-specific regions: Sequence locations=1-165,187-444,469-932
  Gene Ontology: Mol. function=protein binding; Cellular component =cytoplasm; Biological process=protein amino acid phosphorylation
atgcaagtcaccgactgtggaaagcatttccttattaagttcaagcaaaagtttctgccacgcgagattagagtttgaagagagttggaccacccgaacctcgtctacttgtacaacgatttccagtggagcgactatcagttcctagtgatgcaattggctgttggtggagacttggtaattccctcttttgttttatgagtgttgcattacttcaccatttactcttcagctttcgttcctccaaaaatgtggccccgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgactacggattctctaagcaggtggtgaaaattgtttttgcttatttgaagttgattttcagagttctgatttgtcttcaacattttgcgggtcgcgttcctattcgtcaccggagattttgcttggcatcgcttatgacatgttcaaatcggacatttggtcaaactctgttgtgccatcctttttatgctgatcataatttcaggtcattaggcgtcgccgcgttcatcatgatcacaaacacaatgcctttccatgaagacttgcccaaccagcaaatcgttgactcgcagcggaagcgccgttacaaatacccgtcatggcttaacattacgaagcaatgccgcactgccatcgatgccttgctgacttaccaaccggcttttcgtccggtagggttttgcttttaattcgcttctcattttctttcccattcagaacatctttgaatgtgccaagttggaatggtttgcccaagattccgcctctttgtggtgcggtggtcgtcgtgccggtgttggagtgatgggtcaa

SEQ ID NO: 65877 - DNA, 862 bp, Heterodera glycines
  Genomic contig location: Contig_ID=SeqID_36606; Location=1..862; Strand=-
  SCN-specific regions: Sequence locations=1-27,49-182,205-426,448 -516,578-647,669-705,728-764,787-823,845-862
cgagattcgagagtggagggttcagcgaaattaaaaaaaaattttaaaggcaattaaaatgtcgatagtttagaaaattgtccaacagcgaccaaagtgactttgatcgacagactcagcgattgtgggctcaaaaccatcgaagcgacaagttttgtgtcgcccaaatgggtcccacaggtaaaagaaagaaaagccactgcaattaattatttctaatcatttatcctggaataattggcaaatccattaaaaacaattagtgccattccgttcagcacagatggccgaccatgccgaagtgatcagtcgctgcaaaaaatttgccggcgtcagctatcccgtgctggtgccgaacctcgccgggcttcacaatgcggtctcctcgcaatgcatcaataaatgtttaaatcatcaacagaaagcttttttgttaatttaaaatataaattggaaaatcaaaaaaatttacaattaaaagtgaattcacaaaaatttaaaacagagtaagcgctcaaaaaaaataaattaattaaattacctatatcaaaaataaaatatttttaaaataatttttctgtcagatcaaaaatgggaatgtgcgtgaaattgccgttttttgtgccgcgtcggacgcattcacaaggcaaagaccaaacaaaaggggggtgggcggatcagaggttcactttttttactttttggcacttttctaaattcgggtccaatgccattggattttttccagaatttgacaaataaatccttaaattttcatttaaaaaatctgttaacaattcgaataaattgcatctattagggtagtaaaaatattcaaataaatacgaaaaaaagaacaaaa

SEQ ID NO: 65878 - DNA, 811 bp, Heterodera glycines
  Genomic contig location: Contig_ID=SeqID_7768; Location=25..835; Strand=-
  SCN-specific regions: Sequence locations=1-196,282-368,390-638,731 -740,762-811
atgaaaccgaaatttttatttgctataatttttgcatttttcatcggtttttccatttttgaagggacttcgtcttacgaatgggactcggataacttggctaacaatgtccaaacatttgccgaatttatggacgatctttatgaggattacaaggagaagggaaaaatgggtgagtttatagcaaattcaaaactaattaaattatatttttaatatttaatctttttaaaacatattttaataaagtgtaaacttttttttaattattttaattaattgtcattatataggaattaaatcttctataaccaggcatgaatttatatttgctaaaaaaaattccttctatgagccaaagttgccaaaattaaagtataaacaaaaatttaatttggtatttttatcgtttctaatttgaagggctatgatttttaggcaaagtgtaaaatttggcgcacatgatacgcacagataagcacgaaaaatgcattttccgcttggtttggtgtgtttacgatgacttttataatgcctttttttgcctatttcggggtttttgtgcctattttcagttattttcacttctgcctttttaggtgctatttcgtgatttttgtgccgaaaaaacgaatccctattaataacataagaatttaaaaaaaattaattatttttgatgttttgcttttgatttaaaaattttgtataaaatttttaaacttttttagacataccttggctaaacaaatcaaaactatacacggaaaacggatattcggagaagcaaaaaaggaaaggttcaatttga

SEQ ID NO: 65879 - DNA, 704 bp, Heterodera glycines
  Genomic contig location: Contig_ID=SeqID_7768; Location=1067..1770; Strand=+
  SCN-specific regions: Sequence locations=1-49,160-351,373-704
atgaaaaaatttttcggcggctccaaggcaaagccggcgccaaagcaggtttattttatatttaatttaaaaaaaataattataaatttggttttatgtttaataataagaataaattttaaaaactaattaaaaaagaaatttctttcaaaatattaagtgagaggattgaaacttgtaaatttgaaaagtcaataaaattttaggaaataaaaaaacgttatttcatggcctaagtccagttgacccttgataaaaaggcaattagattttctctttggccttcttatcactttcttgagcattaaaatgaaatttttccagcaattagctggttttgagtttaatccctttttaattgatcaaggcatattgatgtcccaagctcccgctccaagtttgagaacgcgtaacgcccgcggagatactcgggaaggactggtcgtgaaccggagatcaggccgaaaagagtggggacggggaatcgggattggcttaattttaaaatggtggcttctgctcccgtcatgcccttgttttacgcagtccttctgtcattgtttgccattatgtccacgtggattataatgacaatgattgataaaaattgaagcccaaccaggcaaacgtgtgaatgaatgaatacaatttttgaatgcttataataataatgcattttttctttttcttatgctatttcttaa

SEQ ID NO: 65880 - DNA, 1405 bp, Heterodera glycines
  Genomic contig location: Contig_ID=SeqID_7768; Location=3618..5022; Strand=-
  SCN-specific regions: Sequence locations=1-258,281-541,583-591,613 -641,663-859,960-1014,1037-1320,1347-1405
atgtacatagttaggcattttggggtagctcgggaatggaaaaaaataggaatcgagatcggattgatcggaatttcgcggtaggacccgacaaagagatgggatcgatcgacacctcatgatgtgactagggaccggacaaaacagggtcaggaaacttttagaggttcctggtctgtacattctgggaaaaatgccacggaactcgggtttgtttcggttatcctggcccaaacattgccaaactcctccaaacttattgttttttaatttattaattctcagcccccccccctcacaaaaaaaaatttggggattttttgaaacgaattcggacaccaaacctaatacaaaattcaaaattttgttggcacaccttggcgaatatggcccaaaattcccatgccaccgccgttgttggtttttgcctttgcccttcgcaatgtgttgttgttccggtggtcaatgatgaaaatttgctcagtgtgactgaaggcacagcccattccattcagacattcattaggcacaaatttaatggattaaacatttaaaaataaaaatttatgcttaaatattttggtaaaatgccccaaaaatttcccaaattttctaatatttttttttattttcaaagaaaattgtgttaagggtttccgggtcgtagaatcagattctggcatcaacttagacataaattaaatcctctagagcacaaatacgaaaatgtttattttcgtttttttgttcgagttcgggttaaggggttcgggattgagcgaaaacgaacggtagccggattgatggatgattagtgatcccgaaaggtccagggaatgtgttttttcatgacctaccgattttattttaaaaatattttcagttcgagattttttttaattttagtaaattttttcataaaaaaaataccatgaaaaaaatttttaaacaattttttagggatttttgaaaatttatgataaattactaataatttttcccataaattcgctgaaaatttaaaaaatatatttttcttgaaattttcttatgcaaaaacctaagctttgtctcccttcctagaaataaatcggttcattagaaaggtgaaaagtgtgccgtcgtcgtccatcgttcgtcacgaatgccaaagacagaaaaaaaatacaaaaaattttatcgcctcgccggcgaaaatcccttccccccccccatttaattaataatagtgtcttttttggatttaatctgcggccgacgtgccttggcaaaagcacacgtacactgaaaattgcttgcgaagaatggaacatttgtggattatttatatttgttgtttttgtgtcctcgtgccctaataatgccaccgcaattccattgcatcgattggattagtctcaataaa

SEQ ID NO: 65881 - DNA, 109 bp, Heterodera glycines
  Genomic contig location: Contig_ID=SeqID_7768; Location=5222..5330; Strand=+
  SCN-specific regions: Sequence locations=1-109
atgggctgcacaggcgacagcgaagaagcagcagcagcgatgtccgcttcattgagcatcgggcaaaagcgcgtgtgccgtcggtggatgagccaaaggacaattaggg

SEQ ID NO: 65882 - DNA, 280 bp, Heterodera glycines
  Genomic contig location: Contig_ID=SeqID_36612; Location=525..804; Strand=-
  SCN-specific regions: Sequence locations=1-280
atgccgccatattcaaatgccattttatgtattcataaattgccttcaattaatctattatttatttgcggccaatgcaggtatgaatacagtattcatctcattgttaccgtcttcactacctacagtacaccattcttgtccctgtcctttgtacttgccaaatttctgccttttttcacaaaaatggtgcagaatttgggcaagtgcatggctgcggagcaaatgaatacggtggcgagcgacccgaataaataaattggcacgaaaaattaataaa

SEQ ID NO: 65883 - DNA, 255 bp, Heterodera glycines
  Genomic contig location: Contig_ID=SeqID_36617; Location=528..782; Strand=+
  SCN-specific regions: Sequence locations=1-255
atggttgagatgggaaccgaaattcaaacatcccgaaatgaacttaaggcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgataggcttaatgaggcgctcg

SEQ ID NO: 65884 - DNA, 75 bp, Heterodera glycines; identical to SEQ ID NO: 54636
  Genomic contig location: Contig_ID=SeqID_36621; Location=172..246; Strand=+
  SCN-specific regions: Sequence locations=1-75

SEQ ID NO: 65885 - DNA, 75 bp, Heterodera glycines; identical to SEQ ID NO: 54636
  Genomic contig location: Contig_ID=SeqID_36621; Location=572..646; Strand=-
  SCN-specific regions: Sequence locations=1-75

SEQ ID NO: 65886 - DNA, 2094 bp, Heterodera glycines
  Genomic contig location: Contig_ID=SeqID_1004; Location=1103..3196; Strand=-
  SCN-specific regions: Sequence locations=1-46,68-305,327-385,407 -588,610-882,904-913,935-948,970-1063,1107-1115,1155-1217,1244 -1442,1464-2094
aacattatctttttttctctaaatttttcgtcttcttttgtcgtactatataatatttttattattaggaaaaacaacatttacttcgctatgtttagcttattttgtatatgttagatccataggaaattttgcatatcgttagagaaaaaaattctgcatctattaatgctgaatttatttttgttaatgctctatttcaaaagttataagaaaaacaaaattttagagcctcataacttttctctggtacaccaaatcgcttagcatttgcttagaaaaagcttctcattatcaagagctttcgaaagataccaagattatccaatttggttggcaaaaaccttcaaaaataattcccaaatatcgtgattttttaatattttgacaaaaataaatgaaaatattcatgttgcacaacggacttgagccaccaccctttgtccctttactatcttacaaaaaccactgagccacacatgcaaatcttttctggtacaggagctcatttcccggacgctgtgtaaatacacggaaacgaagtgaaagtcatccttggttcaataaaatattaaaactttttttaaaccaaaaatgtgaaattcgaaaatctgatttttcgacattttggttcgaattcgggtctggggttcgaaattagtcgaaatggatgccggattcgtgatcagcgaccctgaaaaccattggaaccatgttttcatgacttttgaaaacaaaaaaaaatttcttcaaaaaaggggggctaccatcggcagtattaccgttaattttctggaatgagaaaattttcattagaaaatgagattttgagctcatattccgatttttaggtttggaggaatccgaagattaggtagacgtagataagtagctgctacctaattactttcttcctcatttaaaaatgcaaaatacgctatttggcgtaataaacatttaaaaattttcaattaaaaaaaactgaatcggtatcgctttgtatctttgtaatatgccgcacagtaccatacaaattcccgcggaattttttttggactaactctatttaagttttaatttaaataaagatttttatagaattaattctcttgatattttattgtgttttactgttttttatattttgaaaatggcttctgcacaagttgtgtcccaagtggaagtgccagttgagaaaaccatcgaccgtgaaaaggtaaatatttaataattattttatatactagttcatgtgaatttattaggtttgtcctctgttactacggattttttgtgcccatggacgtcataattcgaccagtgattattcgcgtggtaccgtccctccaaacgaacttcaaatttacacctggtcagtattggaatcaaaaagaaaaaccttttttgaattccttatttaggccacatgaattttaattttgggatataaatgtggattttggtgaaatatgtttcaggtacacttgccaccaattgggcagcggcgctttggtcgtccaacttccccagccgtctcttgtggaaacgatgaggcacttaattcccatccattaaaacacaaaaaaggttcattttgtgtccaggcttttgctttgggattgcgatgatcgatcggtgttattcatttttcatcgaagtgtccacggaccaatgcaaatggatgaaagtggcggacgtgaatgagcgcaggtacaacgaacacactttactaattgataacaaatgaaaaatacacttaattaatgaaaacatttgcaggagttggcaaactgtccattttatacgacaaccggtcgttttcatccgcatagttggtgatagaagaacccgatttaatctcaaaaagcaaaatttgcgatcgcttcaggcacatccaattcggccaacgaagtgttccactgtgtacattttgaatgtccggcaatggaaacggacagtgtctcagaggaggaacggctcgcccgactgcgacgtatcgtcacaaagaccattgaagacaacatttcgcctccgtccattggtgtgccgagttcgtcgtccattttggcctcgtctcaaaatgctttggattca

SEQ ID NO: 65887 - DNA, 2044 bp, Heterodera glycines
  Genomic contig location: Contig_ID=SeqID_1005; Location=1876..3919; Strand=+
  SCN-specific regions: Sequence locations=1-651,673-907,929-972,994 -1320,1342-1366,1388-1567,1589-1762,1786-2044
atggctggacccgactctcgttttattctcgaattcttcaaccgtgaggctaaagagattggagtaacgcaggaattgcttaacaattcacaggtttttgactttatgatcgtttgaattttatttttttttattcagcagtccgatcagttgatccaggcctactactttctgtgtgatttgatttttgaaaatgtcggcaccaccaaagagaacgagtgtgaagtggccactgatctgacgagggctcgtcccaagatgatcatccgaacgcaacagcataggtacgttggtttttgttattttgatcttacaattagtattttcgtatagttttatatacattgcatccacaatttgttcagcaatttggtgttcaacaagttgttcgatggttctaacgaatttctctactccgatctattgcaaccggacccccgcagaacgaagatgcacattgctcaactgattcgcttgtacaccacaaagtgtgacattgccaaagagctttccgcggtggacaatcacattgtgagtgtataatttggcggagtttactagttttagtttatcaattgggctaatttattcggaatttacaaatttaaggatgaacaaatgaaagcgcatgactttgagaagaactgtgaacgttccacacatgctgtatgagatgatgtgtaattatacgcggaagagtttttcccttttagcaactgaaagatcgcgaagaagcgcttaaccgcatggagacgcgaaatgacgaaatgggcagcaaagtgcgacgactcaaggacaaattgaacgatcgacaagcgctagcggaggatgagaaaagaaatgtcgaacgcattgacaaaattttgttgggggcacagtgcgaaaatgcaagtgaaaaatgaaatgctgaaaaaggggcggaaaattgtcaaaaactttggatttattaacatgttattagtgatttttcgcttatttttaataaaaattataggacgaatgcaagaaattgtttgcccaggaagaggaaaaccgcaagcgattggacaacaacattgtgaactcaccggaacgcatcatcgaagagctgtccaacatggaggtcgaagtggaggacatccgtcgcaaaaatgatcaagcagtgtcagttgtccattcgttcggtttttgtaattggtcatttattttgttaggcaaaacgaccgaaagttggagagggaatacggcgaacaacgcgtgaccagccaatgcgtggagagtctgatcaacggcatgcaacaattggagatgatgcaggaacaaatggtggagatgcgggcgaaggaagaagagcgacgaaaggtcgtcccatttggtgatttaataccaatttaatttatattattaagcaaatggacgacttggaaatgacccgcaaaaatttggtggccgaaattgaagtgttggagagacagtcgacgaccgacttggaatcgttggggggcgaagtcaaccacagggctaagtcgctggcgatgctcaaccagcagaaggcacagctcgaaaggtgccgctgccaatcagtgggatttggagagagttttcctgaaattgcatcaatttttattcccatttaaacctccctattttattgggaaagtaatttaacactgaccatgagagaatcggttcatgaattctaaatttaaaagttaaataggtaactaattaattattcagtgatgaaaaggagttggccaagcaactgaaggagaagaaggacgacattcgccagcatcagcaggagatcaagcgaaaagaccgttctttcatcattctcaccgacacttacgacgattccgtggccaaacttttcaaaaatttgagccttgtggagcaaaaggtgtgggaaagggcgtccttttgtcttataaatccggcaaatatgaaaacatatggcggaaaatgtgattttttcgtggtcatttttcaggttcaagtgagtcgctcgaaccttctcagcctgttcaacgagagcgaaatttttggtccgttcaatcagtga

SEQ ID NO: 65888 - DNA, 1455 bp, Heterodera glycines
  Genomic contig location: Contig_ID=SeqID_1006; Location=120..1574; Strand=-
  SCN-specific regions: Sequence locations=1-1129,1175-1368,1396-1455
atgtgtgccccaattgagacacaaacagcggtaaaaatttaccgaaagagggcagaaattctcgcccaaatgtctgatcaagatctctataagagatttcgatttgacagggaagggataaaagtaccatttttataaattcatttagaaaagtaaattaagtacattactaatttggtgcgtgaagaagttgagtctaacggccgttcgagagggggagcaattccggtagagttgcaagttgttgcaactcttgcttatttggcatcaaattcttttcaaatgatctgtggtgatttgctgggatttgatcaatctacagtgtcccgatcagtgctaagagttactacagcattacgaaatttggctggaaaattcatttattttgctccttatgaacaagtaccggaattatgaatgaattttggtcaaaaaattagtaccctttgcaggccagagaaataattataccaagcttttataatgttgctaattttcctggtgtaattggcgccattgattgtacacacgtgcgaattattcctccagcatccgctcacgaaaaggactattttaatcgaaaaggatacccctcgattaacgtccaaggtacaatacatataaaatggaccgaataattcattagcaatgtgattaggtgttgtcgatcacaatggccgattttcaaacatttcttgccaatggcctggttgcagccacgatgcctttgttctccgccagtcaaacgtatgggaagctgctcaacaacaatataattatgcacatgcaaaaacaagggttattgtcgagaatgcatttgggagatggaagcggcgattccatattttacattccgaagtacgaattaaattgcagaatgtgccaacattgatcacggcagcagctgtgctgcacaacattgcaatcgatcgcaatttgccagattttcttaatgaaacttttgttgacaatcagccctctctcctccaaattaattcacttcctacatttcgatcgcttgacagttttaatttgcgcaataatattgccgaaaacttttttggtggctcttcgtaatttattttattttttcttttctattcatgccaaaaaatgataaatctttctgatttattaatttttcatctttaaaaaatttatttttttaaattttctcactcgatccgcgggtgctacgtcatttcgcgacaagtgcaaaaagggcacttcgcgacagtgcaaaaattgggcacttcgcgaaaaatgcaaaaattgggcacttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaa

SEQ ID NO: 65889 - DNA, 882 bp, Heterodera glycines
  Genomic contig location: Contig_ID=SeqID_1007; Location=221..1102; Strand=+
  SCN-specific regions: Sequence locations=1-195,217-220,243-335,384 -618,650-694,717-882
atggcacgcgagaggtgcttgattcaaattttggagttttcaccgcctctccgcgtggcacagtgccaagaacggcataggactttccttcttcaacaacaacttgctgtgaggaaaattcggcactttcctcttgttctcaagttcgatcaagcgagccaccatggcttcattgaatcgcgccgccattaataattttaattttttggggaaattgatttgggaaaaataagaaagaatggcaaaagaaattgttttgatgtaaattcaccgccatcaaaaacatagtttgggtaaacaatctttcagttattgatcatctaggttaatccataaattatgcaacaacaaaaatacaaaaaacccaaatatttaatattcatggtaaataaagtgatccacggatcaggtcgatttagaggaaaggaaaatagcgttggatttgatgagaactactgaggaaaagaaaaggaatacaatccacggatcgagatccatggatcacccaatccgatctttatgcatacggattttgatccacggatttttcgatcctcgaatcagtgattcgtggatcacgatccggggatccgatcctgatctttatgcatacgggtacggatgaccgggaattcccggcccggtcccggtcccgtggcactctagtaaaaatagaagagccgatctcgagttagaaaagaaactcaaaaaacaaaagagaattcaatagagtgggtcgaaatatgggcctatgcaaaatttcaagaaaattggtcaataggaaaattttttttcaaggacaaagttttttttttctctcattttgacgtactatttccatgtctctaacatataaaataacacataataatttatttgtca

SEQ ID NO: 65890 - DNA, 3590 bp, Heterodera glycines
  Genomic contig location: Contig_ID=SeqID_7769; Location=1673..5262; Strand=-
  SCN-specific regions: Sequence locations=1-5,106-210,255-281,315 -370,392-573,597-813,846-938,969-1205,1231-1590,1612-1878,1900 -2796,2852-2878,2902-3093,3141-3313,3458-3590
  Gene Ontology: Mol. function=ATP binding; Biological process=protein amino acid phosphorylation
atgtcggatgaagaggaggagaaggagcagcaacggggtgaaaaggagcaaaaacgaacagcagcagttggtggaagaagaggagaaggaggagcagcaacaggacaatcgccccaacaacaacaccaagcagcactgaccaggatgagcagtgacccacaggagctgatcatggaagaatgtgtgtgtgcgctgttccattttaattggaaaattaatttttaaatcataaaaaagtaatgtaaaatttttttcgacgaaattcgaatacaaaataacggatataaaaataaaaaaaattttgaaaaataatacacacgaaatgaatagtcttacaattagcacctaaattccttatttagacttcattcaatcttttttaaatgcaattatgacatttttctattgttttgtcactttcaaatatccaatacattaactttttatattgactatattttggcatttttaccattaaaattttttgattttttccgaaatgttgcgttaaattaattttttttttcccattcaaatagcccaatatttgcggcccagacactgatttgccacaatttttcagattttggcatggatgagcgccattttcggtcacgggctggcacggtggacaccgaaatgaacggggcgaacacaaacggagaggaggatgatgtcatggacattggagatgatgagctgatcgagaacaaagagtttgaacagttgaccgaggaggagaaggcattggtgagaaagggcaaatggttgttggaagagtttgatgggttgaagtttgtgatagaccttgtcatatattaaaaaaaatttttttttaatatatactaatttctgcccaaattttttatgcttttaaaactcgaaaataagctaaaaatctggttacccttgatgtgcacacttcccaatctaaaaacttatttttttttatatatatatatataaatcgccgtgaaaaatggcggtgatgtgaaaccaaaatatgagaaattccggtacttttctttttgggttcgcacaacaaagatttttaaaaatcaacaaaaaaaagcgcgcaaattcacacaattcagtttgactttgtgtacccaaaataatgctgcccgtgctttgtgaatttgctggcatttttttgattttttttaaaattttgccctgcgactccaaaacagtaaagtaccgaaatttcattttcaaaataaaaaattactttttgcagctatcccctgaaatgctcagccaaaaggaggacaaatatcagcgccgtttggtgtccatgctgcccgtctattacccgggcatttccgggtgccgaagtgtggccgagtatgagtgcttgaacaaaatttcggaaggcacttttggcgttgtgtaccgggcgcagaacaaacggacgggtgggtatgaccaccatatttttttggtgtcccaattttaaattttatatgaaaattcataactaaaaatagggcattattttttagtccgttttttgcccaatttttcgagagaaaaaaatcaggggcgtgagcaattgctttgctaacttttgtcagggaattttacaccaaaacctgggatcaattttttgtttatataacttttcaataggttgagttttaaaattattaaatgactcattaaaattttttggtatttcacctcgcttaggcgtgtagcaaaaccaaaaaaaaaaaaaaatttagatgaaattgtggcgttgaatcgacttaaaatggagaaggagcaccagggctttccgatcacatcgctgcgcgaaattcacatgttacttaagtgtggagcgcatccaaacattgtcaatgttcgggtgagcaccctttctacattttttgcaaaaaaaaaaaataataattacgcctaaaatcggcaggaagttgtggttggctcgagcatggacaaaatttacttggtaatggattttgtggagcacgatgtgaaggcattgattgagctgatgaaatcgcggaacaaaaaatggacaattcgtgcgttttttaagattttttttttccaaaaaaaaattggtaagattttaccaaaaattttatacaaatttttttgtttaaagcgcaagtcaaaacgcttcttcgccagctgattgccggcgttttgtacatgcatgaccagtacgtgatccatcgcgacttgaagacgtccaacctgttgttgtcccatcaaggaatattaaaggttggttggctctatcgctcttttttcagaatagactatgaaaatttctgaaaacaaaaatataatttacatattccggatttttttttctaaaaaataagaagagggcaaatatttcagaaattttcttattgaaactttgaaaacaatctaattattttttttagattggcgactttgggctggcccgtgagtttggcgatccgatcaagccgtacacgccggtggttgtcacgctgtggtaccgtgcgcctgaactgctgctgggcacaaaggtatggcttttttgggccaagagattattattttttcttgacgagtgtccaagcgttgtaacggaaaaaattactttatattactagtaattagtttttaattgttcaatttattcagctttatacaacgcctgtcgacatgtggtcggtggggtgcatttttgccgagtttctgaagcttgagccgctgtttccgggccgcaccgaaattgatcaaatgcagaaaatttttaaggtatctgtttaaatattgtcaaattttgatggaaaatgaaattctacactgaaaaaattatcaaatttattttaaatccataaaaaaaatttttttttttaaatttgtctgtcattttagaatttttttagtcaaaaataatatattttaccaaaataaattacacttattttttgttgttcaaaggaagtcggcacacccaatgagcaaatttggcccggctgtatggaattgcctgggatgaaaaccggcgtttttgcggacacaccgtacaatcagttgaggaagaaatttgccgccgagctgcctgatgatgacggctttgagctgctgaacaagtgcatattcttatataaaaatttttaaaaaatcatttttattaatgaaaaaaaattgctttttcccccattttcgactgctcacgctgaacccgtcaaaacgattggacgccgagacggcggtggtcagcaaatggtttaacaacgacccaaaaccggcacatccctccacatttccaactgtgaattttgcactaaaaatacaattaaaattctctattctgttaaagttaaattaatatttttttgtgttttaattaaaattttgttttaatattattttaaatttaataattatatgaaaattattattttatttcgcacttttttaggttatgcaaaaattaatatattttaattaaatattttatttagtggccagctaaaagtgagcagaaccgtcgtccaataagagatgttggtgctggtgggggccgtgctcaacaacagccgccgccgaggccgaccggaggatttacgcttcgatttgatgcgccaaaattttga

SEQ ID NO: 65891 - DNA, 460 bp, Heterodera glycines
  Genomic contig location: Contig_ID=SeqID_36623; Location=493..952; Strand=+
  SCN-specific regions: Sequence locations=1-156,179-247,279-328,360 -373,396-460
atgactttaaaaacaaatcctaaggttttctataacaacgcaaagaacaaaaccgaggaatttgtcatctgcgcggatgaagccgaatcggaggaatgtgcgggaaaatattggtaagcaaagaaaggcacaattggaaaacaatttcaaaaaatgtgccaaaactgttgttcaggttctacaatgttcgggaccatttgaattattttgggaaatcggtgtccgaatggggagagaagggatgtgccaactgacagaaaaggacaaaaaagaatgaatgaattgtgcaattaataattcactaattgtagtagcaaaataataatccaaaatattttttaattttttattattattatccgaagaatgaaacttaaaaatatattaaattttaagggctctttttgatttgagtgggccattctcaactgaacatctgccaaatgatcccaaaaaatga

SEQ ID NO: 65892 - DNA, 753 bp, Heterodera glycines
  Genomic contig location: Contig_ID=SeqID_36625; Location=232..984; Strand=-
  SCN-specific regions: Sequence locations=1-247,289-310,368-452,474 -509,548-753
acaagcttccgctgagcactaccaaaagcgaattcgtctctcacttctgatcaatgcgcgagtgttggtgtccttgaaaactgcaattgatttggatgatgcactgtttgcccttgaccgtgctcagctggacccagccgaacttggcggcactgtgccattggcagacaaattgcaaatgtccattgacgatctccgccaattccataggtcgtaaaatagtatttaaattcataaattctcttacaaaaaaatttatttttatttatttaatgattttataaatatcaattcggcatttaaaatttgcattaaattaatttttttcttttatgataagtaaaaatattgttttttgaataaaattcgaggtacaatttttcaatttttttcaaaagaaattttccaatttaaaaaccttaaataaactaaaaaaaaaagcgagaataaatatttagaaaaatatgttcaatagagcctgttaaattctggaaaaaatacgtatttacataaaataataattattattgtaatttttttttaaattcaagagaaggtgctcgggttgtcattttggtgctcagcaatgatgagcagcagcgactgaacgcggacgagcaccaatcccgacggatcatcaaggggcttgaccgcttgtccgcctcgctgttcatccttcattttgcgccccgcggtgcgcctccctctgctggaccactgagcgcacaattcaacggaagtgcactcggataa

SEQ ID NO: 65893 - DNA, 2432 bp, Heterodera glycines
  Genomic contig location: Contig_ID=SeqID_7770; Location=529..2960; Strand=+
  SCN-specific regions: Sequence locations=1-201,227-337,404-613,635 -862,884-892,919-934,962-1030,1055-1090,1137-1159,1212-1234,1257 -1316,1338-1359,1389-1428,1450-1566,1593-1665,1687-1791,1830 -1856,1979-2261,2283-2318,2392-2432
atggtcagcattggcggaaatgtccagcaaattaatgcggtcaaaacggtgtttgaccagtgtttgttaatgaacacacacgcatccatgttgtacggcgtatatccgcttcatacttctgctcgtaagcctttttcttctttttttctgacaaaaacccgaaaaattgtaaattttttgtcggtttgtccttctaaaaatacttttttattttaaaaaggaaaatctgcttgtaagcccttatcgattttttaccgtaaatcctgtaaatttatggtcgctctcctttttatgctttttaatgaagatttttttttgaaaaacagaaatttctagcaaaataaatattatattttaactcttttaatgatatttttttaattttaaaaataaaattaaatttcgctttttattgaaaaaaaagaaaattccaatctaaattccgttaaccttggattcacaatttcctatttcgggattttttatgggattttttttatggggatagcccaatgttcctttcctggatttctgagattttgtgcgattaaagcgaaaagttaagattaaggaaatcaagaaagtgctaactgaagtatttcaatttttagatatattaaatcagaaaattttttctatacttgtgacgggaatgttttcaacggaattgtccaaaagatcgcactcatctgaatcgttagaatatactttctttgtcatcaaaattttggcatttgtccatcaattgaaagataaaaaaagtgccaaaaataaaattgaaatatgttggaaagttttatccgactcgggagaaactatgacatcaaatgaatccattgatgtgcttaaaccaattttggcagaatttgaggatcaatttggtggcaccaacaaaatgccaaaaaattatcaaaatttgattcaatcatatggcaaatttttaatggaatttttacatttggatgaaaaatttcgaagtgaattttatgaaaggacagcagaacgtgaaaaattgatgaacatttttttgattgttgacaaggaaaaaacatttttggacaaccaattttggaaacattttgatggttggtaaattattaattattatttttatttaatttttattaaatttttaagttcattcaacagaaaataatgttgaagaaggcagcagcaatagcgaaataaaattcatgaaaaaatacaaagaatgtccaaatgtaaagcagcctaattttttggaaaattcagaaatagctaatgagggtaattttgaacataattgcttattaattaaaaaggcagattctgataatttttattctttgataaatgaataatttattggtttcaattttcattaataaaatttaattaaaaatttttaagacaaagaagcacatgccctgatgaaatcgtacattgatttaatgaaaaatgcacaaaatgtgcaaacaaatggacaaatgaacaaattgacagaaaatttggaaacgaatgccgccgtttgggttagcaaagagcaaataaacgaattgctaaaatttgacgaatcaataaatgacaaaagtgaagaatttattgaaaaaattagccaatacaaaatggagtggtacaaaatggcgacaaaaaatggacaaaatgtcgacaattacaaattgttattttcattttacaaatttttaaacacacttattgaggatgatgagttgaagttgaacaaaaattggaatttacatgtgaaaaatttgttgaaatggtcaacaaatttgtttgaaacggtcatattagaaaaatttatatatttaaaataattaaacattaaattagacattgttttgttccacgcatttgagaaattaaaaaaaatcaaaaacaattaaattaattataatgaaaattttaaaattaaaaagggttaatttttcatgaacattcaatgttttattaaaaaaatatatttattaagaaattaattcttcgggttcttccaatttgcgcaaaaaacacctgcgcattgtcagatgaaaaaatggcagccgagtttaagcaaaaaatgaaaaattcgcaaaattggaatgatcaaattcatttccatgcactgacccaattgatcaacaaatttgacgaatttacacatgttttgtgctatggaagtggagaaatttcaaacaatttgatgagggaacgacttagtttgattgtgccagaaaaagcattcggtgccattgaagcatttcatcctgaaataatgggttatcgtaagtaaaagaaagagaaaagtgttaaaaattcattttaatttgcattcttaatggttttaaaatttattatccaaatattcaaatatcatgattaaattataatttacttttttatcatttatattttgctaaaaatggctgagtatttaatttactaaaacattgata

SEQ ID NO: 65894 - DNA, 1875 bp, Heterodera glycines
  Genomic contig location: Contig_ID=SeqID_7771; Location=2031..3905; Strand=+
  SCN-specific regions: Sequence locations=1-35,57-113,153-219,241 -254,300-376,448-571,601-643,798-879,901-962,1001-1105,1135-1414,1437- 1521,1579-1702,1753-1793,1817-1853
atgtccgatgatcgaaaatttgatttaaatgttgcggaaggatgggataacatttttccaaatttattgaacattgacgcgatgaatattaatcatgaaaagaagaatgagtacaaaaaatggattggccaattgcacaaaaatgcaatcatcaaactgagccgggaggacaatgtttttgcgcaacaattaagaaaaggtgacaaatttaattgatatttgaaatgagtttaatcttttcaaatttatggaagaaaaaaaattaaaattttaaattttatgcatatttaaaaaaaattgttttctttaaaacagagaatttatttttcaaattctttactgttttttctaacaatgagaaagtggaaatattctgaaattttatttatttatgttttatgaaaataatattttttatttattaaattttaaaaaattttaaatttagaatattcttcttctgaaaatgttttatttcgacggtttcttgttgatttggttggagaatcaaaaaatgatgaagaaatttggaaaacaattcaagttgataagtctgatgaaattgtcacagaaaataaattcaataatttaaatttaattgaaaacctttcgccaaaaaagggaaccaaagaaaaaattgtggaaaagtcaaaatgcaaaaataaaaaaccaaaaaagaaaaataaaaacacggagaatattaagaaaaatgaaaacacatccaaaattgaagacgcaattgaatgtgaaaatgaaattgaaccagaacaaattagcgaaattagaaataaagctaattcaaatgaagaaattgatcatattttctggggaaaatcacccaacaattctcaaacaaaatttgatggaataaaactggctaattttgaagatgaaaattttgtggccaaaattttcacacaaatttttgaaaattttcaaaagaatccaggtttatacagttcttttttattttattaatttatatttttaagataattttgtgggtttattttcgtctgctcaactgttacattttggcatttatgccaacgaaatttgtaaccgaataaaactgatcaatcagctgaaagaagcgctgcccgaaattggaattgatcacattgaaaacattgaaaatgaatgggatcaattgaaaagtgtcgatttgtcatcattaaaaaattgtaacaaattaattacgacactttttctgttattaaagcaaattgttgcaaaaatggacaaatttgaagtgccaaatgagcaaattgtaaattcaaatgaagaaaattttgttaaacatttgttaattaggcaaaaatttgccaaatttattgtcgaacagtatgagaagcacaattggtcaaatttaagccaagaaaataaaattggcataatgaaagcaatttttgtggatgaaaacattgatgatgaacttattgagaaatatttgctagaaagtatcaaaatgtttataatgaactatgaaaagtttaattcgcaaatcaaaatgggtaggacataattaaattaattaattatttttatatattttatatttaagataaaaatatttttgaaatatcaaaaccaaatcagtttatggagcaaaacgcaaaattatatttcgaaatttcaaagggatggcaagaaattgattatgatgagaaaacttctaaaactgtgaaaaaattcaataaggtataaaacaaaatttatttgtaaatttatattattttttagtttaaaaatgttatagagcaaaatggatacagtgatgatgatttaactgcaaaatttaagaaaacaattgaattaaagagcatgtttgaacaatgggtaattaacagaggatattttatatttaaaatttag

SEQ ID NO: 65895 - DNA, 866 bp, Heterodera glycines
  Genomic contig location: Contig_ID=SeqID_36635; Location=232..1097; Strand=-
  SCN-specific regions: Sequence locations=1-280,326-661,691-821,844-866
atgaccgccacatttttccatcatttgcgacaaatggcgccatcaattcttaacgaatgtccatcacttcgttttgtcaatttttatgccggtgatctctttgccgaattcccatgcgatgacagtgccgcggcatcggatggacaagcattcgccaaatggcttttcactccgcttcaaaacaacgtgccaaaagtgttcaaatgcgactcacacaacgacgacagtttggcgacgaaacttgacgtcttcaaactggtgcttattaatcattaatggcattatttattaattaattaaattgttttttttttactaatttttacacattttagacattttcctccgcttcatctcccgtcaatttcattgtttccatttggtttgatgcgtcgcctttgccaattcccgtggtgccattttcgatcaccaacaaatcgactggggaacaattgatgctgaaggaaattgacgacaagagccgtcgttttctgctgatccgttgtccaattgtgcgtgacgcggacaaatgggcgaaatgggaaaaggaggcgcttggctggcatattcgtgatcagtgcaatcaaatgcgcattaacataactggttctgacaaaatcggggacgggtcagtgaatgaatgattgaatgcttattcaaaaattcaaatttatttttctgtttatttttaggcttctcaacggattgctcggcttaagtgaatggaagttaagaaatggacgatcggtttgaattaaggaatttaaaaatgatttttgccgtgctcataaaatgttttctttttttgttggaatgatcactttgcttatacgtattttttaaaagcactaccaaaaaaaaataaa

SEQ ID NO: 65896 - DNA, 231 bp, Heterodera glycines
  Genomic contig location: Contig_ID=SeqID_36640; Location=422..652; Strand=+
  SCN-specific regions: Sequence locations=1-201,223-231
atggcaaatgaaaaaggaaatttcgaatgtgagaacaaagaaataaagcgaagcttcgaaagtgccgtctataatgcatttgccgaagacattttaatggggcatttgaacgcactttcgaatttattgaagccaaaaaaaggcgaggaaaagccaattcaaatgggaaaagcagaggaacagcagaaagacggcacaaataattggtgtaaataaaaagattaaatggaa

SEQ ID NO: 65897 - DNA, 1051 bp, Heterodera glycines
  Genomic contig location: Contig_ID=SeqID_36641; Location=1..1051; Strand=-
  SCN-specific regions: Sequence locations=1-360,382-464,486-563,586 -1051
gccaaataaatattccttgaaatttttttattgcaattatggagttggagccgatcatcaaacagaaacacaaattgccacgagaaaaggtattgtatttgtttagaatttttaaatttggtgtttttaatgttcaaaagagaaatccttacctcaatgtcaccagggactaagattttagcctcagactattctttagggtatcttgaaaatcctttttttacaaataaaagattgtttgattggtcagtttcccaacgacgtgtggcacagagagcgttatgcccgtgacagtctgataatgctcacctttggcagtgccactgttatcggtgtcatttacaccaccagaccgacctggtccaagtggcttttgaagctttctcgcaacagagttgggaccaaaggagcaggttctccaatttttacttctttcttacacattttagcaactgacttcccaactttgtattttttaattatttgttcgaattcgacctgaaaagaaagaaagacccgggtttgggttttggtctgcgaaatacagactggccaatgtgaagccctgacttttaaaaatctttttattgtcttccattttgttttttcctttaggttcgtttcgccccaaaagtgccgcccttcttgtgccattcgtcccgatgttgtccaaccgtgccaatcactccactttcccgcacaatttggtctccccaacagtgcatcgccgttttgtggttatttttttatttttacctaaattagatgccccccaccccttaaaataaagacgacacatttttcactcggtcatattaaaaaaagagcccgacgggcttttgctgggccagtttcaaaaatacaccgggcccgtgccgcccggttagacgtactttttttgctgggcctgacaattataacagtccggtactttcctacattccggactctattaaaaagcaaaacaaatagttgataaattattttatatttcagattgtcggccgagtcattgctctctccacctttttattcgccatgtatattattc

SEQ ID NO: 65898 - DNA, 3634 bp, Heterodera glycines
  Genomic contig location: Contig_ID=SeqID_7772; Location=2217..5850; Strand=-
  SCN-specific regions: Sequence locations=1-355,377-455,477-850,873 -1065,1094-1149,1171-1377,1494-1775,1798-1867,1960-2128,2150 -2312,2337-3021,3044-3085,3115-3119,3141-3173,3205-3337,3360 -3375,3398-3582,3607-3612
gtcccggtaattataattagctaattaattaggtgtgattcctcccaggtgcctcccacatcctccgattctgccacttcccctccgctgtcctccgcatcacattttcagcaacaacaacagatgcttcgccgttttgggcccgacgcgcagcggggcgaaacggtcgatttgggcgatgtttaccggcaagttacagtattattggcacactgtagccaattaccgcactgcgggtccctctttaccgtactgtgcttcagtgtggtccgtttctactcattttggcgcacatgcacttcattccaccgcattgtaacgatgattgaggtgatttagtcaattttattggcggatactgtaatatttatttcggtaattaggaaaagatgaaaagctaaaaaaatcgccgtttcctctgattacagaggatcggtcagggctcaggtgcggtggtggcggcgccgacggatcagcgccggtcaccgtcccgcgctcgcaacagcggcgccggcatagccgagcagtggtgcccgcccagtcagcagcagctgcacccacgagcttcgaccagttcagcggccactggcggttcggagccgacgtcgtccgtggcgcatggcgatgcctttggcgggcggtcgccgcgcggattgcctgactttcagaagcgcctgtttgtccagtatttgtggcgaaatgccaagcccagcgacaaggcgcgcgttcaacgcgaattcgacccacgcaggcaacggctgctcaaatacgtgacggacaccgcggcgcggaaacgggtcggaaagcacacaaatttatgcatttcgcaaggcgaaaaattgacgtaatatttggcaaaaattggggggccctagacgtctgatcatttggcaaaaatcacctattatcactcgcttaatcagctgatccaatgcttttccctgctgctttaagatgaccagtgccaaagtgcagtggcgcagcggaagtgccggcacttcgactgacaaagcgacaaaatgggtgaaaatgggggggggggtctaaaaattgaaaaacagggggaaaaataattgttttaaataatatatttcaatttacactttcagcagtcccttcaaactccgcccggctccgccacggcgcccattttttcgccttccgcgccctccgtccgctggcgtttgccgcccggcgcctccgcgtccgcgggcgcgccgagccccaaccgttcgccaacgcattcggcttccccctttgctgccgcgcgacggctgccccattccgcggtcagcgcatcgctgagacggacgcggacaagcgcggatatgcggacaaagaagtgaccagaacgagcgaaattgatcagaaatgatcagagagagacagacagaaagaccgagagagagagagagagagcgagagaaaataagaaaaagtgagagacagaaataaaagaagagagaggaagacgacaggagagagagaagagatcagaatggacaaaagaggggagggggaatcagagaaaagcaccgtaaaattatgctcatcaatcgaagattggaattggaatagacaaaatgccgactaaataagtcgagatcaatttgaaatcaacctctcgagaatggaatggacagaacaactgactgatcagcgagaaagaaagtcgatcagtgttactctttttgagaaagccgatcagtctttaagaatcatgagtcactttttgagtcaaaatccgtcgttccattcgacttttgactgacttaagcaaagcccaaaagcattccaatgtccattttcgattgtcctccttttccagtttttcgtttgcattttatttgcacacactttgcatatcataaaaaattgttaaaataattttttcattttcaatttttcttatataaaaaataaaataaaaattatattaaataaatttttaataaaaatcaattttgctatttcttttcccaaaaagctacaataatcagccccttcaatttgcagaaaaatgtaatcaagcagcatatatgccagccctgctttaagattatataaaaaaacataaaaatatcaatgccaacaccattggcatagccttagcaatgccaatgccaacgccagcagcctcagtttttcatgccaatgcctgcagcctaatcatgccaatggcttcggcttaataatggcaatgccttcagcttaatcatgcgccacccttacaatcactcgattggtcatgccaatgccatcccacgcatttcacgtcaccattttcggcattggcgcaattatatgaattaagagaaggaggaggaggggaaggcttttattataggcagattcaccagcgatgccatcattttacaattttatctccccaattaaagtaatttaataggataaccgatgaaagcatttacattttatatatgtacaccacctacctaatctggagtaagacattttgaaaaagactaaaaaatactggggacctaggaacgggtcgaactccacacatcaccaaactatttcactttatccgttgaaaatggcaaaaattccaaagtttcagttatcttaaagttcaaaatggcacaattttcgcttcgctcgttggcacttttcggctctttcacaattttgaccacatttttcacacggtcaacctttggagaatggccgggtaaaaattttttttgtgtgtttaatacatagttttggcacttttaagggaacacaatatcggagaagatcgacctgctgattgcggtataccctcagaatacgataagcaaagtgatgggttactgtaaggaacagaaggaaaagtgcgaaaaagaatggaaaagctcgaaaagctcgaaagcagaggaaaagctaatagaaaagctgaagaaactgtggcacgcggacgaagagaacatgaaaaagaacaaaagggccaaagatttcaaaaacaaaatgaaaaatgaactcttcgccaaaacgtcattttttggaccggcaattaattaattgggaaaattttaatagtttaaaattttaagtggtcaaaaaagtttcgctcgaggggatttaaaaaattaatataaactttataaagagtgccaataattcaaatcatttttattggattaaatttagcaaagaaatttttttttaattccaattatttaagttaattaagtttagtggtcccgaggtcatttcaaagtacatcggaccatttgcaaaatgtgtgtttgacagctaccgcttaaaagtgggcaaaaagccaacttggatttgaattctcattttcaatttaagtcgttttggcagtcgacgctgcttaatttgctaatgcttgagcgaaacggaggcaaaagcgcgggaggggggagaacggagacgggaacacaaatggacaacaaaatggagacgaacacgaacagaacggacaaacagacggacttgggaacgaattcggacatgccaaacttggacatgccaaactcagataaatgggccaagacgaacaccaataaacagacggacttcggaacaaattcggatatgccaaattcggacaataagcaaaaatcaaagttgggcagtcccgacaaaacggcacaaacaaagg

SEQ ID NO: 65899 - DNA, 88 bp, Heterodera glycines
  Genomic contig location: Contig_ID=SeqID_7773; Location=905..992; Strand=+
  SCN-specific regions: Sequence locations=1-11,34-88
tagtgagcttatttttcctgtgctcttcctcctctcccattgcttcttctgctgcttatgcgcccgctttgcttttaggtcgtcactt

SEQ ID NO: 65900 - DNA, 539 bp, Heterodera glycines
  Genomic contig location: Contig_ID=SeqID_36642; Location=35..573; Strand=+
  SCN-specific regions: Sequence locations=1-539
atggcactcaattcttctgcatttcaatcactgggactcaacccaccaacattccaatcaatgggactcaattcttctgcatttcaatcactgggactcaatccaccaacattccaatcaacaggactcaacccaccaacattccaatcaacaggactcaacccaccaacattccaatcagtgggactcaacccaccagcatttcaatcactgggactcaattcttctgcatttcaatcactgggactcaacccaccaacattccaatcaatgggactcaattcttctgcatttcaatcactgggactcaacccaccagcatttcaatcactgggactcaattcttctgcatttcaatcactgggactcaacccaccaacattccaatcaatgggactcaaccgaccagcattcaatcactgggactcaattcttctgcatttcaatcactgggactcaaccctccaacatttcaatcgccgggactcaattatcagactttccaatcgctgggactcaacccaccaacattccaatca

SEQ ID NO: 65901 - DNA, 565 bp, Heterodera glycines
  Genomic contig location: Contig_ID=SeqID_36643; Location=135..699; Strand=+
  SCN-specific regions: Sequence locations=1-19,46-104,214-253,275 -284,306-565
atgaaattatttccgctacttttattaattatattatttttaattgtcaaaattggagcagaaaagaaaaagttacaacaaaagtcatttggcgaaatatttggagaaaaatggcaagaaaaagaagaagaaaaacgaaatgagcagaaaaaaagagaaataattgaaaaatattataaaataaaagagaaaataaagcaaaaaggaagaaaatacccaacaaaagaatgggataaaattaactcaaaaatagcgaaaaaattggggacaaatcgaaattacattcaaaaatggatcaaagaattggggcttaatcaaaagaaattttataaatcaaaaagtgatgaagaaaaacgtcaaattattcaaaaattcattaaaatgaaaaatgaatttaagcaaaaaagaaaatattctgcaaaagaatggcaccaaaattatgccgaaatttgtaagaaaattggagttggccatgacacaattaaaaaatggaagaatcaatgtggcattagctgtaaaataacggagaaagaaaaaactggaaaaaattaaaatttattggaaa

SEQ ID NO: 65902 - DNA, 54 bp, Heterodera glycines
  Genomic contig location: Contig_ID=SeqID_36645; Location=4..57; Strand=-
  SCN-specific regions: Sequence locations=1-54
atgcgaataatgcgaaaggcgaaatgcgaaaagcgaaacctcggcccatccctg

SEQ ID NO: 65903 - DNA, 80 bp, Heterodera glycines
  Genomic contig location: Contig_ID=SeqID_36647; Location=236..315; Strand=-
  SCN-specific regions: Sequence locations=1-80
atggcatttttcgtcgaattctattcgagttggtgcgggcattgcattgagtacaaaccgcactttgttcgttttgcaac

SEQ ID NO: 65904 - DNA, 735 bp, Heterodera glycines
  misc_feature (707)..(707): n is a, c, g, or t
  Genomic contig location: Contig_ID=SeqID_36650; Location=389..1123; Strand=+
  SCN-specific regions: Sequence locations=1-68,99-137,160-578,604-735
atggcaaactccaatcataatcaacttcagcaaggacagtcagcacttggaaatgtatattttggcacatttaatattaatatatcattaaaaaaaatgggttgttttactcaattgatctgactagccaacatagatttgtcatttatattaatttccataattgttcaagaatgtattctgcaccgatggaacgcacaatattcagttcttgaatggatgcgttacccaaattggccaacctttaccgtatgtttttttgatggtgaagactttaaatttgtgttccaagaccgctctgcctgatcgttgtttcaattgatcaccggcccgaacaacagactcccgcaggattgctttctgtgactaatgttgtgttgcgcaatgccgatggtcatcggattgaagcttcgggatggcaaactcaagcgggtgttttggcgtcattgtccataggaactgcttactggttcatgaactgtatggcacgttcacggtatcagcgactggattgttggtaccgaattggcgttgatggtagaaatgctaccataattcctcacccaatacaccaggtaatttttattattattattattattaaaaaaaatcactgattagcaaacaaccaatgctcgtcctaatgaatcagttggacttcgtcactcaatcgcatctattttgggggaacaaattcaagtttttanaaatcaactaaagttgtgtataatttaa

SEQ ID NO: 65905 - DNA, 85 bp, Heterodera glycines
  Genomic contig location: Contig_ID=SeqID_36651; Location=800..884; Strand=+
  SCN-specific regions: Sequence locations=1-85
aattttttttgtttgcgtttcaaatatcgtaagattgtttgatagggccagacaagagaaggcaactgttggtaccaagtttgcg

SEQ ID NO: 65906 - DNA, 330 bp, Heterodera glycines
  Genomic contig location: Contig_ID=SeqID_36651; Location=50..379; Strand=+
  SCN-specific regions: Sequence locations=1-330
gtttgcgtttcaaatatcgtaagattgtttgatagggccagacaagagaaggcaactgttggtaccaagtttgcggtaaaaaaatgagaaaaaagagatagacattttttggtcaagaattttttttgtttgcgtttcaaatatcgtaagattgtttgatagggccagacaaaagaaggcaactgttggtaccaattttgcggtaaaaaaatgagaaaaaagagataaccattttttggtcaagaattttttttgttgcgtttcaaatatcgtaagattgtttgatagggccagacaagagaaggcaactgttggtaccaattttgcggt

SEQ ID NO: 65907 - DNA, 624 bp, Heterodera glycines
  Genomic contig location: Contig_ID=SeqID_7774; Location=114..737; Strand=+
  SCN-specific regions: Sequence locations=1-624
atgtcagctgcagaattcagtgcaaagttgcgagaacttactgcttctaaggtataggttgtaccaaatcagtatgtgcttcctccatgcttgtgctttggtttccagtttagcgtgaattatttatgtttaggacagaggcacattgttgccttatctgtcttcggctctaccgttgttgcgtcagtctgtgtgcaatgatgaacaatcggagcttctacaattactttctttgaagtcagacgattgcgttagtccagttaagaaggccgcaaatgtaacaaagaaaacgtcgaaaagcttacaaatatattaaaattatagtcaactgatgttgagcggatgtcaaaagattttgaggaaatttgttcaattcgtgaaaaatgcaatgatggcaagaagcgtcgattgaaaatacgactaggacccgatgtgctagtcaaccgttctttgtacgagttagcagtggatccgcattctaggtgcacggaaatttcatggaccagtaaaacaaagcgttttagtagctacacaattccatccgacggagctagcagcaacttaattccatccgacggagttaagcttgccctttcagcacaggtgattacgaaatatgcttga

SEQ ID NO: 65908 - DNA, 1759 bp, Heterodera glycines
  Genomic contig location: Contig_ID=SeqID_7774; Location=983..2741; Strand=+
  SCN-specific regions: Sequence locations=1-43,66-161,190-433,459 -1633,1655-1759
ctataaaagggcagccattttgtctcagtgatcattctcaacaattcatttttgttgtcatgtgggggttatgtgggggttggcttgtcatcccacggggtgggtcgcctgcaggaggaacttgctccggcccaccccacggggtgggtcgcctttcaagtgctccagtttctttaaattttttagattattaggtgatatgcgtatgcttaaagctattttaacagccaatataccaaattaattattgactttattcatctgtcttcattacaactgggttttcattgtagagaatttaccatccgaaggattttcctccgactgtatcatttccatccgacggacagacaactggtacaactattccatccgagggcagacaaacatgcaccgcccgcataacttgaaggaagcggagggagaagtgcagaaagcaatgtaacaacaaaagcaactgtattcttaacactcgtttcacgcttccagtttcatcgctgctgactgttggttggaggtgttccgattgcttccacgctctcaggttggccttggtattgcgaccatcagtcctcgctttgaccgccgagtggacgaacactttaaaacgcgcaaatggacctttggagatcttagaattggcgtcaaagctgggaaaaatggcacaaaggaagtggcagttgtctatggcattagaaacgatttgccattgcctcagcgtccgttaccaagcaaattggttgccttcggccggatttcaatcaggtcatcgacaatagaattgctttacatgcgcttgcctacataacttttgtctgacttttttaccaagcaaattggttgccttcggccggatttcaatcaggtcatcgacaatagaattgctttacatgcgcttgcctacataacttttgtctgacttttagttactttgatcccagtgtgttcacttttatcggactattcaacaaccgtcttcctcaatcatgcacagcaatgctcgacatatccaatgaaaatgtgcacattttgcggcacatcatgcacagtatttggccaacgttcaaagatgccgtcagtgcattgcgcttgacaccgtgttcgtttcgtcttttgcgccgatttgccccgaccatgctttgctgttgtccggggctgcagagcattggtttcaattcggacattttgcccgaattcccggccgatgacagtgccatggtgtcggatggacaagcgttggccaaatggcttttcactccccgtcgggacaatgtgccaaataaccttctgattgaatttgccaaccctgtggtggtgaagtcccaatggtcggctgtcgaagcgatcaaaacggtgcgtaaatccatgaagtgtgatttttatagttttactgttttagcagtttctcgccgctacttcacgtgtttcgttcaaacttacgcttttgaacagacagtctgctgactcttcggaaactgttgtgcccattgttccgttcgagcctttacataacgcggccacgggggagcaattgacactggaacaacaagatgcaaatatctactgcattgagcgccttccgattgggggcgacaaacatgattgggtgacccacatgcttggagagcttaacaagaaaaaccattttaatttgttctttgatgaaagcggcgtttcgctgtgattggctagcatttattgttttatttattcgctgcttttatgtctgtcccatgcacccatcattttttttgataca

SEQ ID NO: 65909 - DNA, 752 bp, Heterodera glycines
  Genomic contig location: Contig_ID=SeqID_36652; Location=77..828; Strand=+
  SCN-specific regions: Sequence locations=1-128,165-414,436-752
atgcacaaacaacttttcaatatcaaacttttttacaaggaaatagatgcggttcgaactgcgatggtgtatggcttggaaaagcgattctttgatctgcgattcaaacggtgattttaagtggtgtcttttataattttttattcaatttcttttaatttttagttgcattgccatttcgaccttcttggacccccgattcaaggaccgtctggtgatggaagacgcggaggttttccgtgaaagagtccgcccgtggcttttcgaagaggcatcaattgctttcaaccaaattgaaaacgaagaaaatgatttgattgctacaacttctattgaatcgccgccagcaaaaaggaacgaatcattttttgctcaaatggaggaaattgccaattttgcacaagaaaaaagtcgtttttgttatcattttatttttcactttaaatattttagctcaaattgcctctcaaagcgacattaactcagaatttaacgaattacttagtttcgacagagcaccaatcaattctgacccgtttgaatggtggaagaagcatggaccaaaacttccaatgttatcaaaattggcgatgaagtatttgtcagcccctgcaacaagcgtgccgagcgaacagactttcaaagtggcgagggatgtttatgattatcgacgttcgagattaaagccgaaaaccgcagaaatgttgatatttttgaacaaggccatcccaatgttggactacaaatactga

SEQ ID NO: 65910 - DNA, 273 bp, Heterodera glycines
  Genomic contig location: Contig_ID=SeqID_36652; Location=603..875; Strand=-
  SCN-specific regions: Sequence locations=1-273
attttatggaaaattttatgaactttttatcatccaacaaaattaaatcagtatttgtagtccaacattgggatggccttgttcaaaaatatcaacatttctgcggttttcggctttaatctcgaacgtcgataatcataaacatccctcgccactttgaaagtctgttcgctcggcacgcttgttgcaggggctgacaaatacttcatcgccaattttgataacattggaagttttggtccatgcttcttccaccattcaaacgggtcagaa

SEQ ID NO: 65911 - DNA, 650 bp, Heterodera glycines
  Genomic contig location: Contig_ID=SeqID_36653; Location=1..650; Strand=+
  SCN-specific regions: Sequence locations=1-124,147-229,272-283,325 -464,491-523,549-613,648-650
  Gene Ontology: Mol. function=zinc ion binding; Cellular component =nucleus; Biological process=development
atggccctattttttccagcaacgaccgatggcacaaccaaaaatggcaatcaaaaaacgcttttcatgcactctttgcacaaaaagttttgactggttctcagacttaaagagagatatgcgcgtccacacgggcgagaagccatttgtggtgagttacagatcttacattttaataagtaagataaaaaaaatgcaatttttattatctgttaacggagtaaagaccgtttaagtttaaaaaagaaaattattttctaagtttattttttaacaaatggagtaattaaataaataataataattgaattttacttattttttcaatatagtgagaattttgtgacaaggcatttgctcgaaagcatcatcttgactgtcatcaacgtattcatacgggcgaccggccctataaggtgagttgaaaattgtttttgaatttaaaatttagtcccccacccctcaaaaaatttttttattttttaataatgcgattttggggtataatgatttgaaaaaaaaatttcaaataattttaaaagatgaatttacaatttatttgttagtgtgaccattgtggcaaacgcttttcggatggcagcgccatgaaacggcaccagcgcatacacacgggggaaaagccttatggg

SEQ ID NO: 65912 - DNA, 687 bp, Heterodera glycines
  Genomic contig location: Contig_ID=SeqID_36654; Location=246..932; Strand=-
  SCN-specific regions: Sequence locations=1-374,396-527,554-636,679-687
tcggttcgggggggcatgccccggaaaacaaaaaaaatcggtttttttcaagtgtccgtttgggggtcctcaaccaattatggggagcaaatatcccacgcagaattaaagttcaggctatagggaagctactcccgaaggattcggtctccccataaatctgggcgcatcggttcggggggactgccccgaaaacaaaaataaatcgattttttcaagtgtccgtttggggtactcaaacaattatgggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 65913 - DNA, 242 bp, Heterodera glycines
  Genomic contig location: Contig_ID=SeqID_36655; Location=750..991; Strand=-
  SCN-specific regions: Sequence locations=1-19,200-242
  Gene Ontology: Mol. function=protein binding; Cellular component =axoneme; Biological process=eye photoreceptor cell development
gggtgcacatgatgaaatagaagaaggaaaagaggaagagaaaaaggaagaaggagcagatgaagagaaaaaggaagaaggagaagaggaagagaaaaagggagaaggagaagaggaagagaaaaaggaagaaggagaagaggaagagaaaaaggaagaaggagaagaggaagagaaaaaggaagaaggagaagaggaagagaaaaagggagaaggagaagaggaagagaaaaagaaaagtg

SEQ ID NO: 65914 - DNA, 665 bp, Heterodera glycines
  Genomic contig location: Contig_ID=SeqID_36656; Location=76..740; Strand=+
  SCN-specific regions: Sequence locations=1-173,195-520,551-665
atggagaggaagacggtaggcaggacagttactagggatacggcgactacatcagcaaaggatatgaatatggtaggctatggaggtggagcatacggtgactatggaaagggatacggtaggattaaacttattaatgaattcctcattaattaaactgtcataagattactcaaatggaaagggaaattacggtgccggaggaacgggttacggtggttacaagccggcgaatgcggattcatccgattacagccagacgaaagggacgactgcatacggcagccaaaagtaccaactgcaacagcagggcaaatacagtagacctttcaacatcaacagctacagaaagcattactacgacagtgagacagtcaaatgcgatcaaatttggtgaatactgtaaatatcccaccaaggccattactgctcagtgcacggttcattttcattggcaatggccactgaatatagtaaagactagctgaaagaggcgacgacatatggtaccccaagcgagttattattcaaaattttaaatttttttattcagcaagtgaaaatgcaaatgcttatcagcagcagaaaaaggtttactctccgtacaaagcgcggtactacacgcgccaattctgtcgctacacagccgcgtcaagcccacgcgc

SEQ ID NO: 65915 - DNA, 706 bp, Heterodera glycines
  Genomic contig location: Contig_ID=SeqID_36657; Location=68..773; Strand=-
  SCN-specific regions: Sequence locations=1-87,116-183,206-286,344 -388,411-464,513-706
atgtcggacgaagaatttgaggaaattgagcggattgtacttggcctggacgaggttggtttgttaggccggccaaccgccgatttcaaaaaaataaaataaataaataaaatttgatgggatccaattttttcaaaattaaacataggctttaaaatgggcgtaaaaggaggatcaaaatcctatttttatcaatttatttatctacaatcattttgatgttttaaaaaaaggattgtataagatggttgccggacgaaacgacgtcggtacttaacgtcgccgcaaaaaaaataattaaatacttgaagaaaaatttttaaaaatggttttaaaattttttgataacctaaattctacagaaaaaaaaaatttgctgaatatccacaaaaataaacaaaaagttgaaattgttttatttcctggaattatttcgaaattttgcgagaattaggccaagttactaaaatttttaataatatttttttctaaaataaaaaattttaaaaattgacaaaaaaaatgagttaagcctgacactgatctgtacgaccgtgtagcctatttggacatggtaaagcaacaccaacaggaacagcgcagaaagctggccatgttgcgcgaagttgagaggtacttttaaggggcgtttttagcgaaatttttagcttgtagtcgatttaatatttttatgggtaataataaa

SEQ ID NO: 65916 - DNA, 662 bp, Heterodera glycines
  Genomic contig location: Contig_ID=SeqID_36659; Location=362..1023; Strand=-
  SCN-specific regions: Sequence locations=1-662
aaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 65917 - DNA, 80 bp, Heterodera glycines
  Genomic contig location: Contig_ID=SeqID_36661; Location=49..128; Strand=+
  SCN-specific regions: Sequence locations=1-9,69-80
gtcctgccaataatatctgtggcatggaataaattttggaactgcgctgcctaacggcggtgcttaaagtgcgctaaaaa

SEQ ID NO: 65918 - DNA, 80 bp, Heterodera glycines; identical to SEQ ID NO: 51817
  Genomic contig location: Contig_ID=SeqID_36661; Location=663..742; Strand=+
  SCN-specific regions: Sequence locations=69-80

SEQ ID NO: 65919 - DNA, 101 bp, Heterodera glycines
  Genomic contig location: Contig_ID=SeqID_7775; Location=2352..2452; Strand=-
  SCN-specific regions: Sequence locations=1-25,47-101
ttgtctcctccgccgtcctcctacatatttatttgtattttaatttgtcttcaataaatttgtttatttgttcgtctcttcgacatttcggggaccgaaca

SEQ ID NO: 65920 - DNA, 1561 bp, Heterodera glycines
  misc_feature (1508)..(1508): n is a, c, g, or t
  Genomic contig location: Contig_ID=SeqID_7775; Location=1..1561; Strand=-
  SCN-specific regions: Sequence locations=1-426,448-775,798-850,872 -1440,1462-1561
ttgaataaagaacaattcaactgtctaatgttgttgacggcattgaagtcgcacaacgattcggcacttcgtcaaaggattttgtcgaagctttcagcggacggggcgaacatcacttacgacggagtcgtggaagacctgattaattttcaggcaacaattgtggaggcaaaagcgattgaagcaccgacaaattggaggaacgtgaacgccgtgaatcggccggtaaagcaaaacaattcgccgaaaatgcaagttgccaaagtgccagagaaacggcaggcgaacaagaattgctggcgttgtggagctgccgatcattggggcagcgaatgccgattcattggagcaaaatgccgaaagtgcaaattcacagggcatattgagaagcaatgtgaaagtgtgcaacaatggcggttgaagaccaaaggaaaatggttaggcaacaagcgaattggtcatttacaaatcggtatggtaaacccgaaaaatgacgccgattcactgaggaccaaaattcggttcaaccaaaagccgatcgcatttgcactcgacactggatcggatgtgaatgtcgttgatgaagactcacatctggaggctgggagcccaccgatctagaagtgcactgaaattggaagagctttcgatggaacgccgattcgattcatcggaaaaggctttggcacatttgaatttggaggaattttgatcgcgaatgaaccattttacgtggccaagcgtggttcgcttaatttgttgagccgccaaacaatggacaaatttggatttttggatggcattaagcagcggatcagcgagcatgtgataaattcctgcagagccaccgatcaaattggaaagcacattttggaattaaggaaagaatttccgggtgtttgcgaagatgcactaggccattgcatcaaagaaaaggcacaactcaaactgaaggaaggagtcgcgccaatttaccgaaaggccagaccggtgccgcatcattcaaaagaagtcatcgaacgtgaattggaccggttggaaggcctcggaatcattcgaaaagtcgaacatttggattgggccgcacccattttggtggtgaaaaaggcggatgggaatgcccgcctttgcatcgattattcaacgggattgaatgatgcattgatcgactaccaacacccgctcccaattcctgaagatatttttgcgacgttaaatggaggacaattcttttcgcagattgacctcaaggacgcgtactttcaggtggaattggatgacgagtcaaagaaattgtgcggactttcaacccacaaaggcaatttcgccatggaacgtttaccgttcggagtaaaagcggcgcccagcatttttcagtctattatggacaaaatgctcgcaggcttgaattttgccacggcttatttggacgatattatcgtcgcaagccgatcattcactgatcacattcagcatttaaaagatgtgttcagccgactgcagtcatnatggatttcgtgtcaaaatgacgaagtgcacatttttccagagaaaattaagt

SEQ ID NO: 65921 - DNA, 1025 bp, Heterodera glycines
  Genomic contig location: Contig_ID=SeqID_7776; Location=1191..2215; Strand=+
  SCN-specific regions: Sequence locations=1-101,131-224,247-254,314 -357,393-548,570-1025
atgcccctcattgtgctgctaattgctttcctaataagtgatgtcacttttgcaatggaaaatgaaaagaacggttcgtttaaaaagcattatttgtaagcataaatattattctttaaatatttaaattcacaggaaagccttctgctcctgctgatggtaaagctccttcaccgtcgtcggaacctccgcaaaatggtattttctgatttgtttcacctcgctttttaaaaaatattatttttactggcctccaaaaaataggtttaaaaaatggattaattaaataaacaaacattttttaaaaatttatcggtttaagataagttgctttttatgagccaataaaagtaatggtaaaaataaattataaaaaatatatttattaaattctgcgttgtattcttggcgaaagggccaaaaacccaaatcggcccaaacaaaataatttacttttgtaaaacttttgtatttgtttggatttataatttctggggggggggggcggggttcgtattcactaatcaggaaacggaacttatttgaccaatcccgaagccataacgagaattgacaatgaagaagattaattttttatttgaatttatgactcaaaaattgttaattgaaaacattagaacatttccaatgtgctttttgaattaatttttttggcttgataaaacgcaattgattttataaagtgaattttttatttttaaattcgacaattggggcttttgagatgggcagaatacggtcagggtcgttttcgtactagctggacttttgaaatgggtagaataggcatgcagtccaaaaaataaaactaataggacaaacagtgaaattccgcgccaagcaaactaacgttttaatggctaaatattttcttgccttggtaaaaccttttatttaagaaaatttctcagaaagttcttttgaaactccgaaagcaccgcttaaaggggacgacgaagactcatcacccaagtgccccggggctcccctaaaagcaacacaaa

SEQ ID NO: 65922 - DNA, 672 bp, Heterodera glycines
  Genomic contig location: Contig_ID=SeqID_36663; Location=1..672; Strand=+
  SCN-specific regions: Sequence locations=1-62,224-288
  Gene Ontology: Biological process=N-linked glycosylation
aaagaggaagtgaaaaagcctgaagaaaagagacaaaaagaagcggaagaggaaaaacggatagaggagcaagaaaagagaagaaaagcggaagaggaaaagacggaagagaagaaaccaaaagaagcggaagaggaaaaaagaatggaggaggaagagaagagacggatggatggggaagagaagagacgaaaagcggaagaggaaaagccggaagagaagaaacgaaaaaaagctgaagagaaaaaacggactatgaatgaggaacacaaaaaacggatggatggggaagagaagagacgaaaagtggaagaggaaaagccggaagagaaaaacccaaaagaagcgggagaggaaaaacggatggatgaagaagagaggagacgaaaagcggaagaggaaaagccggaagagaagaaaccaaaagaagcggaagaggaaaaaagaatggaggaggaagagaagagacggatggatggggaagagaagagacgaaaagaaacggaagagcaaagacggaatgaagagaagaaacgaaaaaaagcggaagagaaaaaacgactggatgaggaagagaagagacggatggatggggaagagaagagacgaaaagaagtggaagaggagaaacagaaggatgaggaagagatgagacaaaaagcgaaagaggaa

SEQ ID NO: 65923 - DNA, 79 bp, Heterodera glycines
  Genomic contig location: Contig_ID=SeqID_36665; Location=272..350; Strand=-
  SCN-specific regions: Sequence locations=1-79
agaattgtcgaaaaccatgcatggacaattttttttcactgagatggctcccgactgatccgactgtcccctttggctg

SEQ ID NO: 65924 - DNA, 161 bp, Heterodera glycines
  Genomic contig location: Contig_ID=SeqID_36667; Location=496..656; Strand=-
  SCN-specific regions: Sequence locations=1-161
atgaaagtgacgcggaagaaagcaaacgatgccaatggatggggccacggaaagacagaaggccattcattgtccgttttaaccttctttatgtcctttccatgttaccttttgtttttcccatccgctgctttgacttcactcatccgtttgattgtccg

SEQ ID NO: 65925 - DNA, 784 bp, Heterodera glycines
  Genomic contig location: Contig_ID=SeqID_36669; Location=1..784; Strand=+
  SCN-specific regions: Sequence locations=1-391,413-784
  Gene Ontology: Biological process=mesoderm development
tttcctccgcttttcagctgttgccgggaggatgcgttctgtgctcggaatgcgctctctccgcagtgtttgcgttgcgatttccgtccgtttgtcttcttggtgattttattgtcgtcaattgtactcagtccgctgcctttgtcaattgcgctggcgacggcgtcgtcccccgtgccaatgtccccgccgttgtacgccttcaagcaaagtgccgtttctgttggcaacttgaacagagcgaaattatgtgtgaggagcggaagaactgctcgaccaacgagttgacactgtacatgatcaaatgctgggagaaaccgaacgcaatctatgcggggcggaggcatttcttcaaaaatgtccgaacggtgcgttatcgatcagcagcatgactttgttgatgatgatgatcctttttttcgtttttccattgtcagttggcattggacgagtgggcacagctggcggaaggcgctttttctgtccttcactctcggcgggttcggcgttgacaggtggtgaaaaggggcaaaagagtggaatggttctgccaattttttcgcttaggttttatttgggctatcggaaaagtgccatcggaaaactgtgagtattttttatgcactaaataattatttttaaaatctttggaaaaaaatgaaaaatttctcaatgttctatgattcgaaggttctctttcggtggtcttggcgtgtggacacttctcgacattgtgctcattgacttcggttacattcagcccgctgatgaatcgctttacatt

SEQ ID NO: 65926 - DNA, 621 bp, Heterodera glycines
  Genomic contig location: Contig_ID=SeqID_36671; Location=11..631; Strand=+
  SCN-specific regions: Sequence locations=1-621
atgccggggaaaacgagcttttacactttcggaagccgactcccggcccagcaaatgatatgcagagtgatcgcagctgcagaggaaggcaaagacgagtgccaaacaactttgttgcttgacccgggaagccatgtcgacggcgcagatacggagctaattcaacaactcgaaccgcaacccatcgacaagcggccgcttacagttcaagtgttcggaggaaagaagcagcggattcggtcagcaacttatcgcctacgactcaaacggaccgacggcaaattggagagcattgaggtgtccgaagtacctcagatctgtacgccaatcagaacagaactcatcgagtcgggagcaacacccgatagcgacccgcgaaccatcacacagacaacgcaacctcaaataatgatcggcattcgaaagttctgggattacgtggtcggatttcggaaaatcgagagtggcgcgcatgtgattgacaccgtgtttggacaagttttgtgtggcgaaggcacccaagcgagcagcggggcaactcccgcagcatcaatcctaacaaccatgccatgcggaaatatccaccaaactcgaacaaataaacgacaacaaatcggagaa

SEQ ID NO: 65927 - DNA, 459 bp, Heterodera glycines
  Genomic contig location: Contig_ID=SeqID_7777; Location=96..554; Strand=-
  SCN-specific regions: Sequence locations=1-58,80-185,207-394,416 -423,445-459
atgtcagcttcacattcgcaaaaaaatcccgaattaaatatgaaatgtatgtgctatggtcaaccaggtgagagatggtcaaaattctgatccaaaattaacaaatatttatcctacagtaactcaattttatacagggaaaaattctgaaaaaaattctgctgagctaatttttgatgctgataaaaaagtcttttgcgtcaacttgatcagattacttcttcatggtgatttgaaaccccgaaaatggctacggaaaaatattcaaaaaattcctagggggttggtatatttttttagaaattttgagttggcccattggaaagatcactcaatttgcaaccgatttgccttttgaatggtaggcttacgtcttatacccacagagcaagagaggatgaaaaattggacaactcaaaaatgactgttttcaatagtacatatttcaagggaaaatga

SEQ ID NO: 65928 - DNA, 981 bp, Heterodera glycines
  Genomic contig location: Contig_ID=SeqID_7778; Location=57..1037; Strand=+
  SCN-specific regions: Sequence locations=1-104,126-401,457-816,839-981
atgaaactgttgttctacagcctgctgttcactgttttgctgctgtttgctgactatgcgtttggatacggtaggtgaactacggtagggcagcggagggcccaacatttattactgtagatttaaaagggctaacaatgtactgtatttcaggaaaacagcccaaaactgggcttgagagacgccctcaatggggcctggagttgaatagcaaagccgacggtaaacttgggcagaacaaattctgggaccgctacgggcgtcccgcgtcgcacggcatttggcacggttcggtggcccttctgacgcgaaatgggcacgagtgggcacgtgccaaacagcaatttggacgcattggccatggcggcggtttcaatggacagccgggcaaagggacacgcgaaaacgagatggagaagtacaagcaggagcaggcggaaaagcagaagaaaaagggtggcggcagcactgatcggaaaagtgattgatgtcatggaaactcataaaaagacttaagctaggcctaagctttaggcttacgcttaaaaatcaggctttattttgtaaaatttttattgtacgattggccattgactcaactgattagggttggttgataccgtacccgctaccatcaaaagcacccatttttttctctactctgaactcgataaaaacgttctcgagatgaccaaacacaatcacttattttaactttttagtttggtcagagaatttatttatcaacacattaaattccagtaaataattatagctttacatttatttatttttttgctaacattgcccttttccgtcgtcctcgtcttcgtcctcctcattttgcattccgattggcacaaatgccaaattcgttggcactttcaaatgcgcaatcactttgccctccgtttccaacagaaattcaaaattgaactcacccttacctttaatatgagattaaatttattaaataagaaa

SEQ ID NO: 65929 - DNA, 272 bp, Heterodera glycines
  Genomic contig location: Contig_ID=SeqID_7778; Location=892..1163; Strand=-
  SCN-specific regions: Sequence locations=1-51,149-272
gaatattcggcatcccttttgtggaccttttcgctgtaagaatgtcaatacatatttaataaaaaaacaatttaaaatttatattttaaaataatttaaaatttcagagtgaatttttaaatttattttcttatttaataaatttaatctcatattaaaggtaagggtgagttcaattttgaatttctgttggaaacggagggcaaagtgattgcgcatttgaaagtgccaacgaatttggcatttgtgccaatcggaatgcaaaatgagga

SEQ ID NO: 65930 - DNA, 344 bp, Heterodera glycines
  Genomic contig location: Contig_ID=SeqID_7778; Location=2923..3266; Strand=+
  SCN-specific regions: Sequence locations=1-18,40-86,108-145,184-344
atgggaatgaacatcatgttactaaatgcaatcaacgttgatttgcctaaccgcagtgcatttgttactggtggtcgatcaaagccatttgtaactgaagtaattttttatttgatttttgctgtaaatttattacctgcgccagttttaataatttttagttttaatttaaaagaaaattttcaggaaagatacacaaaccgatgggctactgttttaaaaattgaaacacttcaggaataccatggtatatagaaaattctcatttcattattacattcctcaaaatgagttccataaaatttatctaccattttacacctaattgaataagttttataaaa

SEQ ID NO: 65931 - DNA, 638 bp, Heterodera glycines
  misc_feature (605)..(605): n is a, c, g, or t
  misc_feature (619)..(619): n is a, c, g, or t
  Genomic contig location: Contig_ID=SeqID_36672; Location=1..638; Strand=-
  SCN-specific regions: Sequence locations=1-97,134-157,180-381,427-638
  Gene Ontology: Mol. function=alpha-N-acetylgalactosaminidase activity; Cellular component=lysosome; Biological process =carbohydrate metabolism
atgaatgtgttcattttattattttccatcatttcaatggcttattcattggacaacggactcgcaaggcaattaatttaattatctttgctaattgttattttataataaaataaaaatattttttaaatatcatttaagcattatattttatggtgattatatttaatggaaaatattttaaatgagtaacatttataaaagaatgctttaagaacccctccgatgggttggatgtcgtggaccaaattctattgccaaaccgattgtgccaaacacccattcagttgcatcaatgaacaactttatatggtaataaaataaacaattaacagtaattacgcttcattaaggaatggatagattgaaaatgctcataagaattaattcaaaatatatataatattttttaattattcattttatgcgctaaacggatagccaatgaccagttattctaatttttctggtcaatccgcttttttttaaactgccaatttcgtaatcatccattggcattgtttgatcaggacatggccgatcggctggcagaggacggattccgcgaggtcggctaccaatttgtgcacatcgacgactgttgngcggaaaaggcgcnggactcacagggccgaatt

SEQ ID NO: 65932 - DNA, 352 bp, Heterodera glycines
  Genomic contig location: Contig_ID=SeqID_36673; Location=52..403; Strand=-
  SCN-specific regions: Sequence locations=1-352
atgaaccgacggtagggaaatttttaaaaaattacaaattttttcgtttacccaattctttttttcatctttcagatggatttgtagcgacgtgtggatggacattctgccatcttttgaccatgcccaactcggactcaaaatggcattgctttccgaccgtttcgatgcgcttgtggacatgcattttgatggaaaaagcgaattgacaatttggaaagaaatatcaattaacaaggacgaaggaccaacaccgaaactgtctgaacggatcgatggcaaaagggtggcatttccgttgccggaccgtccgctgcccaccaaaattcgttttagggatctttggatttag

SEQ ID NO: 65933 - DNA, 463 bp, Heterodera glycines
  misc_feature (442)..(443): n is a, c, g, or t
  Genomic contig location: Contig_ID=SeqID_36674; Location=568..1030; Strand=+
  SCN-specific regions: Sequence locations=1-77,105-141,165-208,232 -294,317-385,407-463
atgaatttaaaaaccatgacccaagtttcaagtaaagtataatattaattatttacatcagaaagacgaattgaaccaataattaaaattaaataaaaataattgattcgcttactaaaatactgatattaatttccaatcataatttttattataatttttttgtactgttgagtaaattatgaataaattcacaaattactagttcaaatttttaaaatttatttataagagatcaaattttcaattttaaaaagatgcatcaacgcaagagtgcataaaatatatagaaaaagatagaagaattgagaatatgtgtaaaagatgcgaaacgtaagcgttcaattggatgtcaaattttattaacattaatggataaaacgttaaaagtttaatgaacgcctaagcatatataacaaatctatgaaagatatcaaattannagcattattactcaaaaaca

SEQ ID NO: 65934 - DNA, 63 bp, Heterodera glycines
  Genomic contig location: Contig_ID=SeqID_36675; Location=316..378; Strand=+
  SCN-specific regions: Sequence locations=1-63
tattatatatatgttatataggttttgagtttcgtttcaaaaaacaaaatctcccggccgaag

SEQ ID NO: 65935 - DNA, 69 bp, Heterodera glycines
  Genomic contig location: Contig_ID=SeqID_36679; Location=19..87; Strand=-
  SCN-specific regions: Sequence locations=1-69
atgtattcaatgatttatatttcggatacaatagtgagtaagaacgaatacggtaagaaagaatataca

SEQ ID NO: 65936 - DNA, 101 bp, Heterodera glycines
  Genomic contig location: Contig_ID=SeqID_36679; Location=558..658; Strand=+
  SCN-specific regions: Sequence locations=22-59
tttttcgatttttgaaaaagaaagttgcattgaacggttttcccgggatgtacacacaaatgatgatgatgatgatgataataatgatgacgatgatgatg

SEQ ID NO: 65937 - DNA, 1552 bp, Heterodera glycines
  Genomic contig location: Contig_ID=SeqID_7780; Location=90..1641; Strand=+
  SCN-specific regions: Sequence locations=1-332,395-509,532-532,570 -584,606-676,699-704,743-969,991-1039,1061-1173,1195-1207,1229 -1467,1548-1552
atgacagcaaaacaactgatcaaagcaatgaaacgaaattatttggcattacaaaagtcagttttaacgcataaaataaagaagcatttccaaatttgaaacgaatttattacttaatgaatttttacgctttttctccaattatcaaaacccaaaacaggtggcagtgattattcgaccaaaaaagggatgtgtaaacgaccgaaaggtttatttggcggaagcctccgctgatcagcaaaatgatgctcttcccgccacatttgcggatggatcttcagaaactggcgctattctttcagggaaaaggtcgtttttcaaacaaaaaatgcattaaaatattaaatttttattaattaaatttttaagtgtatttattatttttcatatttttgttccattttagagctgttgaaatcgtccgaagtacaaaagaaactgcaaagatcagtttgaatcatatcgacgcgcaaatttcaatcatttccattggaaatcttttcttcaatgtttttgtccgtcttcgttctccaaaaatagaaaatgtaaaagtaaatgcacaattatatacagtaattaatagtaattaattccttttattgcaggcatttcagtcatcgctttgtgtccaaaattgtccggacggcgcaaaaatggacaaatattcggcatttttaaacagcaataaagaaaataaaggtgtctatataattttttaattttttgaattattaaaaaattagaattatgctcaaaaatcgtcggtgaactgacagcaaaagatggcgaagataaaagtgccaaccgacgacacaattggatcagttccatctgtgaaaaggatttggcaaaagcatcggcggcaaaagcaacaaaaaatgcttttccaacgacgcattggcttaattcattgatttacgctgctacggaaattgaagttgcttctgtaaatggccaattttacaagtaaaataaaaatctagttaataattaatggacaatgcaaatttttcgacagaaattagaaattatcaataggaaaattttacaattaattacagaagagcattgatcagtctgatcacttttacatcgtattttgaaactgatcattgtcaatttttaggaaacaaagaccattttattacaaaaggccccaattatttttcactttgattctttaaattctataaataaactatttgtgaaaaatttataattttttagcgatagtagacaaacgatcgacaaaatctttgatggtgatcctttgtccaagaatgacaaagtgtcgcctttcattgattctgggcgtttatctgacaaaaaagcgatcaatggccatcaaaacaaagccaaagaatttgaatggcttccccattcgaagcacaaatatttttcttcaaaggcatacgacaagtcattatcattggcattgccatctcttctcatattcttgcaaatttgttttattatttattatgtctattaatttattttaacaaatttattttatgaatcttttgcaaatatttattattatttttcaaaa

SEQ ID NO: 65938 - DNA, 580 bp, Heterodera glycines
  Genomic contig location: Contig_ID=SeqID_7780; Location=1876..2455; Strand=-
  SCN-specific regions: Sequence locations=1-235,257-453,475-522,545-580
atggacaaacatcgcttgttcaagtcgctgtccgccattatgcttttcgttgtcggctcttactttttcatttgtgtctttgttttgctcgcttcttccatgccatcacagcccttcttcaccttccatgtttttccatcaatcctcgcccttttgacttgcgttgccgccagtagcaatgcgccgttacttttcattttcaggtgccggggcaaagggaaaagcgacgggaaaataaaatggcaattaaaattcagcaattgaaaattcaattcaaattcagcaaggattatcgcctcgcgtttcgcaaacagttcgcggaatggcctctgatcggaaaatggctgaacagaatcggaaatgttcaagtgaacgtggtcagaaacgtgaacatgaatgtttcgagtacaattcccctttgaaaatgaaaatcgatctttgtacttttaaatctttttgtaattattctttatttgtggtactttgctaatcgaaaaggacattagagtagaaaaaatgttttgtccataaattaattaatgtattttcgggttgtgtttcggcagatgggcttaataaa

SEQ ID NO: 65939 - DNA, 454 bp, Heterodera glycines
  Genomic contig location: Contig_ID=SeqID_7780; Location=3365..3818; Strand=+
  SCN-specific regions: Sequence locations=1-60,91-93,116-378,410-454
atgacatcaaagtcccaattccgaaaatggaaaaatatggccaaagagtctcaaattcggtattaattaaaaaaaaatttctatattaatgtatttccaaaaatgaaatttctggatacaacaaaaaaaggtttcttgattcattttagccgggatgttttaaatgacatttgacaaaggcatcttttgctaattatgcaattaatatttaaaattgacaaaattaacagacttctgacaaatgattgtgtgcaaaagggcgccgttgaagaacaaaccgggcaaagaaagaagccaccggaaaagcgaggaaaagaacaactccacggagaacactccatggccaaaccgagcaaatgcccaaagttaacgataaccaataattgaattaattaattaaattattttaccgggttttccatggaataattttgaaatgacatttaaatggaaa

SEQ ID NO: 65940 - DNA, 271 bp, Heterodera glycines
  Genomic contig location: Contig_ID=SeqID_7780; Location=3929..4199; Strand=-
  SCN-specific regions: Sequence locations=1-20,63-93,119-214,236-271
atgattatttcgtaagcatgtaaaaatgttttcttaaaacattcaaaaatttaaaacttttagtaaaaatatgaaagatcgtattgaattaacacaaaaataagaaaatttaaaaaatcagaacatatactttttaaatttcattacaccttaattaatttacgtctttttaacatattgtatggaaaaagtaaaagctgaaaaaatttgtaccaaattatttaatttcttttttgaaattttgttcgaatcacgcaattattacaataaa

SEQ ID NO: 65941 - DNA, 1350 bp, Heterodera glycines
  Genomic contig location: Contig_ID=SeqID_7781; Location=1195..2544; Strand=+
  SCN-specific regions: Sequence locations=1-4,26-132,154-246,268 -944,968-1047,1070-1179,1201-1316,1340-1350
atgcacccaaaaagaatggccaaattttggtgggagaaaacattgacatttttatatgcagaaaagcaatgggaaaatattaacacaattttaatgtgtcactttattaaataggtataaaaagtaattttaattgattaattggactgaaaagagagcaaaatcattcatttccataaattatgaagatccgtaaataaacaaagtgagaaatcgaagaaaggacaacaacaaatgaatgaacggagagagaagagagtgagtgatcaatcttttgtcaatcacccactgatcagtccgatttaattggccaaaaagtgtcggcgtttgttcacttcgccgcctgctgttgccgactttgcaaaatttctttccgcgatgcttcctatgggcaacagaaaaaactttaattaaaagtgaaatgaaaaagcgaaaatagcgccgccctttccttttgaattggcgcggtaaaatagagtggaattaatagggaattactcacaattagtcatttcatacaaaaggcacccccccccactcatttgcaaatgtccctaaatgatggggggggggggtctaaaagaggagagagagggtgtcgcgacaaagaattggttaatccaaattttatttttcgccatcgcctggacctcttttctcctcccttaaagtatgaatcattttaatgggaattgaattaaaccatgggaaaggtgccaagtttggcgcttattggcccacctgaagcagtgccgtgtcaatgccatccgtcggaaggtgaacatagcgaatgacggagccacggacgaagcaatttttcaccgaaatcatgtggggatgcctgcgggggaagttgtttaattcccataggtaattcctttaagtgcttatggcttttcatttaaatttgtaaatttgaacggattttgcacaaaaaaaggaattttatgaaatgtaatttgttaaacgtaaaaattgaaaatcatctgcacatattctggggtaatggcgttttcccagccccaactcgttttcggagtttgaggcaaaaattgactttttataatattcaatttgctggtccctttttacctgtcaacgtccgtcaccgaaatgtcgttgattttcatgttcaaatattggtctacagaatgtaaagtgccacaaatactgaaaagaatttggaatgaaatcactgttttttaattccacctgaggtcgtttttcagctcgacgatcacttctctgccgaccatcgacttgaaaaaggagaagaaaagcatttgccaagttacgatttaaatgcctttgttgtgaaaaatggttattatgatcatttaaaatggaaaa

SEQ ID NO: 65942 - DNA, 322 bp, Heterodera glycines
  Genomic contig location: Contig_ID=SeqID_36682; Location=112..433; Strand=+
  SCN-specific regions: Sequence locations=1-20,46-136,158-322
gccattgtcgccacaaaacggaagaagaaaaagaagaagaagaagcggataaaagcaacggaaatgtcgtctgctgattaagtgtacggaaatgaatgattgaataattctatttgagaaatgatctatctcaatttgttgtgcttttttctctcagaaatgcttttgttaattgtttcgttccaattatataaaacatttattttattggcttttttgttgaacatttattaattatcaatgaaacgattatttatagaatgtggaaatacagtagtttttgtttccttcctcctcgcttagaaaaaaattcactagggta

SEQ ID NO: 65943 - DNA, 573 bp, Heterodera glycines
  misc_feature (14)..(14): n is a, c, g, or t
  misc_feature (20)..(20): n is a, c, g, or t
  Genomic contig location: Contig_ID=SeqID_36683; Location=12..584; Strand=+
  SCN-specific regions: Sequence locations=1-331,353-421,443-573
atgggcagtttaanttattnggacggagatgacgacgaagcaccggttcaaggcactcattccgccagtttacgttcggcacccctttttaactttgtcaacgcggcaccgtttggagttcatggatggctggcgcattttggcaaaccttacattggcaccactcaattcgagattgatcgtggagcggaggcatttgaacccaatgctgatgtcggggcaatggtaaagattattggactaagtttttagaaatcattttcaggggtattccgaggcgcttattacgaatttcaataaaatgattaattttccaaaaaaaaatccaattcaaaccattctattttactaccgtatttggtgaaaaaattgttgagaggagcttagatatttcggcgtttttgagcactaaaagcctaaaaatagctgcaaaaaacatgaaaagtgactaaacaatagcacacaaaaattgggggtgtctaattaattggactcaaaaatgcaccggaaccgataattcctcctgctcttgagcagtcttaattggtgcatttatgtaaaaaaaggaaagaa

SEQ ID NO: 65944 - DNA, 243 bp, Heterodera glycines
  Genomic contig location: Contig_ID=SeqID_36683; Location=861..1103; Strand=-
  SCN-specific regions: Sequence locations=1-157,179-243
gcatttctccgtgccaccaattcttctgtcaatttcattattcattttgaactgttcgaaccaaagccaattgagccgtttgaattggtcaacgaacaaacaaaggaaaagctgacactgagcaaagaatcagaaaataattgggtgatgaagcgatgccaaattgggcaaattgttcaatggaaggacgaaaagttgaacaatgtcagcattattttgagtggtgtcaattgcattggttga

SEQ ID NO: 65945 - DNA, 301 bp, Heterodera glycines
  Genomic contig location: Contig_ID=SeqID_36686; Location=126..426; Strand=-
  SCN-specific regions: Sequence locations=1-78,100-131,154-301
atgttcatctctggcacattttcttgtgacgcattttataatgatgcattttttgctgacgcattttccactgacgcattttccactgaccgattttccggtcacgaagctgactttaccattattatgaatttatttctattttttgcaattttccacgccacttttttgccgttgacttactgtaggtaagtaattaaatgattgagaaggaaggatttactaattttaattgatgaaatatatttgaataactatttaaaatgcagtttattggggaattaactccagagcagtttga

SEQ ID NO: 65946 - DNA, 297 bp, Heterodera glycines
  Genomic contig location: Contig_ID=SeqID_36691; Location=869..1165; Strand=+
  SCN-specific regions: Sequence locations=1-71,166-232,285-297
atgattattaggattgcgcatagtatggaaaaggtaaggtctcaaatatttactaaaaaaacctactatgtagtaaaaataaaaaatttcaaatatgaacaaaaatataaagtaaaaatcagaaaacaaaaacgtgtgaaaatcaaaaataagccaaaaacaaaatttttagcaaattcatttaatttacagtctatggttttttgataaagaaatttaaaatttttacaggttaaaatttcaaaaaaaaatattattgaaaatttatcaaaaaaattttttttgcaatttcaaaaa

SEQ ID NO: 65947 - DNA, 612 bp, Heterodera glycines
  Genomic contig location: Contig_ID=SeqID_7783; Location=3167..3778; Strand=+
  SCN-specific regions: Sequence locations=1-94,116-241,263-612
atggccgacaaaactactattaatcttattcttcaacgacttgaagtgattgaacgtaaagtcaacaacaacaacaatgccgttccagttcagttgaatgaacaactgcaaagcattgttgaccgtttgtgtgacatcgagcggaaaattgacaccgcaaacaacaccaactgcaacgcgacggactcggaggacaaagagcggaagcgcagtcttgtactgatcggccttccagaatcaaccaaggaaaagccgacagaacgggccaaagaagacgccgacatggtgtccaacgttttggacgctttggatgtagaagtgtgcccacagatggtctaccggatggggcgccggaatgatggcaagcggaggggctctcgcctggtcaaagttgtgcttccggcgagcacctttcaacgcttcgctttggcacaatggggacgacgccgaaatgtactccgcgcaaaaaacgaggagtgggatcggctgcttgttcgaccgtcgttgacgaaagaggaacaaaaggcggaacatgaggcgcgtgtcaagaaaagggaggagtacgaacaaaaacgggatggagtgacaattcgcggacaaaaaaacaattga

SEQ ID NO: 65948 - DNA, 789 bp, Heterodera glycines
  misc_feature (686)..(686): n is a, c, g, or t
  Genomic contig location: Contig_ID=SeqID_36695; Location=53..841; Strand=-
  SCN-specific regions: Sequence locations=1-223,318-509,531-789
atggtacaattaggtaaagcacataggattttcagcaaaaatattttggtatcagaatatgatcgcacaaccttgcaagaagagaggcatatttgtaaaaaaaaaagtgacatttgggtgcaatttggaaccagttttgattttttttttcaaaagctatttcttagtggataatttttcatttttactgaatttttgtgaagaaatttaacaaaaaaatgcgaaaattttgttaaaaatttttaaaaatattcataatcttttttatttttgaaagcaaaaataattcaaaatattgtaaaaagtattttatttatgaaagccaaatatttttttatttcttcatatggacgttaaaaggagaaatttggataaaaatgatgtttttcgtgcatttcccatcaaaataaagctgccgcagaaaaaaatattcaaacatttgctgatggtctaaaatttaaaaaaaatcgcaaaaagaaaaaaggtttaaacccaatttcgtttaatctttaaaagaaatctttataaatatcttaaatgaagaaaataaatttctaaattctttttgcattcagacaaattaacagcaattttgggcgaaaaagtgccgtccttgtcggacgaagcagccaattggccaatgcttagacgggctgatgccataaattttagacttgaacaatggnctaatgccacgtgtagcaaactgtatttggccatctccgttggaggcaatgagaataaaattaagtaattcatcatgatatgcattagcctaaaatgaataaa

SEQ ID NO: 65949 - DNA, 955 bp, Heterodera glycines
  Genomic contig location: Contig_ID=SeqID_36699; Location=64..1018; Strand=-
  SCN-specific regions: Sequence locations=1-341,363-516,540-678,753-955
atgccgttcagacgggacgaatacggtgggcagtggaacagtgaggagaccgtctccatcaacccgtggttttacgaggatgaagaggcggaggacgcggacgcggccaagcaaatctcgccgctgaccatggccggcgttgtgttggcctatttggtgtcggatgtcattttgactttatctaaaaaagaaattcaaattgaaggccctcggtgccattctgttgcctctgttcaaaggccaatttgactttgtcaacggccttttctactcgtatttgtgcttcaccgccattgaatatggccatttgatcccagaaaagtgagaaagaaccagttacagtaatgcatatacatacagtagtttccaatcaccctaattaattaatccctcactgtattgccgtgtatcattaatagttaatttgctgaatttaattttcagcgatgcgttcattcccttcgttctcctttacatgtgcgttggcctggcaatttcgaccatcgctttgggttttgacatttaaaatatttctaattgaaaattcgcattattcttttcagacattggatcaaattacgtgaaaaaattgtattatttgggcaaacgagcaacttccattgcgcatgccagctttttctatggcggaaaacagttgaggggtggggggaggacgaacgaaccaaattcaatttgaatcaaatcaaaccgaaacgaatcaaacaaaatggaataaaaaaagtcaaacaaaagaaaaaagggaatttcgaagcaaaatttggcatatcaatgctaaagattgaagttccatgttaagcatctccgttcgcgaccttttggatgccgtcggtatgcaaaattaaaatggaattttttgctattccatcacaaatgttcaggccaagcgatcgggatcagtgaggatgcgttggaaaaggtcgaccttgaccgaatg

SEQ ID NO: 65950 - DNA, 606 bp, Heterodera glycines
  Genomic contig location: Contig_ID=SeqID_36701; Location=198..803; Strand=-
  SCN-specific regions: Sequence locations=1-101,123-131,153-606
atgggtcgtccacgagaacagctggttggtgaacaggaagagattttgggtcatgcgtcggcagttcaagagtttcacccgttgatgagaaagttaaatgagaggcaaaaagtgtcggccaaactgttgttagggaatgagtgttgtttgatctatcaaaatgcgccaccaggagttggtaagacttatgttgcatcaattgtggcggcgattctcttgtcgataaatgaaaatgttaaaattgccattgtcacatcagcgaatcttcctcttgcaaaattagcccaagaattagacgaagtgttaggtagtgatgaaatggaagagtcgggatcgattgcgttcttctcgggttacgcgaaagaaaaatatagagagatggttgagaagttgaagcgtcacattttggtgtcaaagctaacaagtgaggaaattcagagcaagttggaagagagaagtgaagagaatcatgataagagagatgtgagagagtatcgccaaaattatgaactcaggcctaggctgacacaagagagaaaaatggcatcgttgtatgcgccaagcggcgaacttgagaattgttttcgctacggcatctatggctga

SEQ ID NO: 65951 - DNA, 2914 bp, Heterodera glycines
  Genomic contig location: Contig_ID=SeqID_7784; Location=877..3790; Strand=+
  SCN-specific regions: Sequence locations=1-160,182-969,991-998,1020 -1096,1133-1175,1197-1215,1238-1426,1456-2203,2260-2378,2407 -2532,2555-2914
atgcccgtccaaataaccaatgagcaaagccaatacccccaacaacagccgcagcaattgcctcaatctccttcctccgattctgaccaaaaagaacaactacaaccagtgccggtttcaacacaggaagagacttcgcagcaagttcagccagcaagtccagtggcagagccatcggaggccgcagaagcagcgactgaagtgccggcgccgagtggaagcgcagcgacggggtacggaggcgcagaatcgccggcagccgcgggcgaccgattgcaggaagtgcaggaggagccaaacgcagcagacgaattaagtgcaacgacaaacgaagtccaaaaaccaaacaaaacaatgaatttggataattttgacttttctcaacaggaagaaaaaagcaaaacggaccgaacagaacaaaaagcgaagcatcagcagaccacggcggaacagtcgccaattggggcggaagcgacggcagcgaatgcatcggccaaaacgaacaacgaaaatgccgatttattcgtggaaccgatagacgtcagccaactgcaactgaccaatgacacggagtgcaacagcgaagaactgaggcggataataaccaatgttggtaaaccaatccaagggaaacaaatgcgatggggggggggtagatggccattttacgatgaagaattggccaattcattttgtaaaaatgcctaaggcccattgtttatgctacagaacatggacaatgagctgaatgttgccaaacggtccatccaattggctgccgaagctcggttcggcggtcgcttcgatgtcgtctgttcccaccacgacttttcttacataacaaacactgtaagacctttcattggcacgttcaaaagtgaaatgtcattgcaccaatcacaggaattgtggtgccaagaaacgcgggaaacgacgagttgttatgcgtacagacagttggggtactgaactgaccgacgactgactgacggacggtcaaattaaatcattttcattttgcatatttaaaagtccaaactgaatttgctcatctctttttttgccaaaataaatgttgtgataattttattcgattaaatggttttataatattcattttgcaaaaccatttcccgaacggagcaaaaactataaaaaaggcaatggcacactgaaaaatgaagaaaattaaataatatgaataaatgtgactgaaaatatatttgaaaataatttgtcattttatatgaatttgataatggagaattgagagaatgttttgtcccgttgccttccgctgaaagcccaccgcttcgctccgttcgtcgctacgcctccgttccgccgggcattgcctccgtcgcctcgtcacttttcgtcggttcgtccatcgcttccatctcttttatttccctggtgctctatcaaaaaataacttttaaataatattttatagccaagacaattttgagtgggatgggaagtgaagtggtcaaaccgccgggggccttttggtgattatcttatgctaattaaccgatgagccatcccaacactccttttagcgggtgcttcgttgttgagtcaattatttcatttcattttgcctattaggcactgcttcctcgtcccatataaccgatacatttgccaaaaaagagaagaatcacctccaaaaactgttggaatttcaccgacttgcacaacacttcgttgttaagcacaaactggagaaattcttcgatggaattccttcgctcggcaatcgtttgagggtcggtggcaccaaaatatttgggctccgcaaaggaagggaatttgcccttcagataaagctaaaaaagtgctaaaggtttcagaggtcaaaaaacgcggatttataaaccgatcgatgtatggaggcgagggttgagtaaagggcgctcaactctttgtagcgagtgatcaaaccgaataaccgcggctcactgtcaatggaattgtgcggtgtggccagaaaaaggaaaaggtacaataaaacgagtcgcagccaatctaaccgaaatctccaatttgtactcaacgtggccgaacagtcggctcgtgggcatagtcacatcgacgactttgggagaaaaaccaaaatgctttctttccatataaaccaaatttccgagcacagatttgcagccagtttcatccggcaaaagagaatacatttaacaataaatttgattattttatcaaaactatttaattaaagaattttaaaataaaatagtttaagttggccaaatgcttttaataattattattttagcatcttttgatgcacttccgaatgtttaaatgaaaattaataatttgtttctgttaccccggagcagaagatcagaacgtacaaaaaaccacagaaaaagtcctcaaaattgcagcacaaacagacgaagtaagtacggcatttgaggtaaccaatgctattttcttgtcattctaaagattttgctccgctaaaccaattgtgtcgctattctgtcggcccatcacgaattcgtacaaaggaagaaatttgggatggattcagacgattcagagcaggcaaaacgaaccataatttttggtttagttagaaaattaccaattttaatttaggagacatcgtcagaattatcgacgaagacgaggggaagggatattttgcgcaaacagttgcatttatcaccgatgactataccaaccaatttgcgatggtcatttggcttcttccgaaactcagccgcaattcatttccaaaaccatttgagtttaatgccgacagatttcagcatggctttggtttgtcctttttttgaccattttcattttgatgaattcttttcagccgaagaacgccccgtcccaatcaaagcttgtaaaaagattcctatttcgaaag

SEQ ID NO: 65952 - DNA, 468 bp, Heterodera glycines
  Genomic contig location: Contig_ID=SeqID_7785; Location=225..692; Strand=+
  SCN-specific regions: Sequence locations=1-30,53-180,205-468
atggcgaacagacagtccaatgttttggcgccggatgagtgttcgaatctcacccgaaacactcggtcaattgtccgccattttgaggcatttgtacggaaattcggttcgaaattcgaatccgtttttcattatcaatattctttgttttcacaggtgaagaaccattcgacgaattcgaacggaaaggcttttggaaaatgttgactgtcaaggacttctcgggcgacacaatgattatcgtgacggtccatccgcacccgaacagcgaagtcgggtgggcccggacaaaaggcgaaagacgcacaattcttttttagattaccgataatgccaaaacaaagctgagggaattctttttgccttcggatccgttcagagatgaagcggcacagtttaacgtcacttcgttttactggcaagaacaggcaaatgcgggggacgagcgcatttacgagcacgtggccg

SEQ ID NO: 65953 - DNA, 192 bp, Heterodera glycines
  Genomic contig location: Contig_ID=SeqID_7786; Location=1077..1268; Strand=-
  SCN-specific regions: Sequence locations=1-154,176-192
tgtcgttttgtttgttcgcacatggctgaaccgttagcgttggacccgtacaggaaatatcggaatgtccatatgttaatcccgtgttatttccttttctgtaccaacgaacttaaaatttttgttttattttcgcgaataaatcgttaacaacgaacattaaaaaattattaaagtaagagtacaataaaa

SEQ ID NO: 65954 - DNA, 1067 bp, Heterodera glycines
  misc_feature (42)..(42): n is a, c, g, or t
  misc_feature (49)..(49): n is a, c, g, or t
  Genomic contig location: Contig_ID=SeqID_7786; Location=1..1067; Strand=+
  SCN-specific regions: Sequence locations=1-14,46-286,311-1067
ggggggggggagggcccccccccccccccccccccccccccnccctaanaaatgtatgctatacattgtagagacattgacaatgaatggtagttttcctaaataatgttgttcagaaacggcctttcgttgtcttggatgtgtgctgtggggctggcacggtctgtctttttgctttctcatttgtttatttttttttgcattataagtcaccgattcccgccgaacttcttttgtctccctctcctctcccaattcctttttagtctcttataaaaaaatagaaaagattttcactcaacaattggtcttcagatcagtctttgtcttatgcaacgcattcgcaaagcaattctttcgcttccttccgcttctctctgtcccatttccttcggttgcgttggcatcgaattgaacagagaggcggtgagagatgcgcgaaagaacgcatctgagaatggtttcgacgcaaaaaggtgacgcaacttattttacagctcaaatgtctgtttttgcttcagttgcgtttacattgacggcgaagcggagaaaattttcaaggaattggaggcaattaattgttcattttaaaaccaatcatcgaatttgtttcagtaccacatgcctttcggttgtccattaaatagttcacaaattttcggagtgattgacccgccgagggcgggagtgtccgacaaagtgatcatcggttgcaggagggtaagggcattggtcatagtgcagaatactcattccattgaattttacgcgtcccgtgaaattttcagtttacaatttattaatgggacgcgtaaaagcgtgttctgcactaattaacccaaatgctaactaattttgtttaaaaattcgtttttatcaagctcaactctctgcgtacgctgtgctatgtttcctgcgacccaaaagcggcaaccaaaaatttaattgatttatgcagacccccgtcaagaaaattcgatggcgacccatttcgaattgttgacattcaacccgttgatttgttcccccagactgaacacgttgagtgggtgatcaaattgaagcga

SEQ ID NO: 65955 - DNA, 826 bp, Heterodera glycines
  misc_feature (774)..(774): n is a, c, g, or t
  Genomic contig location: Contig_ID=SeqID_36702; Location=54..879; Strand=-
  SCN-specific regions: Sequence locations=1-826
atgagcgctaaaattatcagagtgccgaaaatcgcatgtgatctaagcctagaaaaaaatggagtaagtaaaaatcgtaattacgctcaaaaagcttctcaaacaattttagcgcttccaattccttctacaatcgcctttatacatcccattatgagcgctaaaattatcagagtgccgaaaatcgcatgtgatctacgcctagcaaaaaatggtgtaagtaaaaatcgtaactacgctcaaaaagcttttcaaccaattttagcgcttccaattccttctacaatcgcctttatacatcccattatgaacgctaaaattatcagagtgccgaaaatcgcatgtgatctaagcctagaaaaaatggtgtaagtaaaaatcgtaattacgctcaaaaagcttttcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctnaaattatcagagtgccgaaaatcgcatgtgatctaagcctagaaaaaatggt

SEQ ID NO: 65956 - DNA, 651 bp, Heterodera glycines
  Genomic contig location: Contig_ID=SeqID_36703; Location=110..760; Strand=-
  SCN-specific regions: Sequence locations=1-128,159-310,332-334,356-651
atgcacgacgccaacgcacattgggtggagggcgactgcgtgttcattgccaatgcgaccaccacgcgaatgatcatccccaggggaaacaacgggggatttgaggtgcgtataaatagggactcggcaaaattattcaaatttttatattattttttcaacccaagcgaaagagaattaaaattgcaaaattccgcccgaattccaacaaaaaatcgaaaattaaaaaaagtgcaactcgaaaacttgaagatttgacttaacgttcgaattcgggtcccggcttcgaaattggttgaaatggaagtccgaaaattcctgagttttaattcacgtaacaggcacaatataaatacatttattagcatttgacattttaaaaagtatttgggtgtttttctaaaaaatttttgtaaatttttcctcgcatttatttttttgtttccaggaagttcccgtgcccacggttgctcagccatcatatgtgctcggctttcgtggcacaattcatttcaacggcacactcagcgacaacgcactcgccttcttccgtcacgcgttgcccccgcccacaacgctgtaccgcttctcggtgctggacgaattttatcgtgccaacggactgctgagcccgttcaaaacaacggaacg

SEQ ID NO: 65957 - DNA, 147 bp, Heterodera glycines
  Genomic contig location: Contig_ID=SeqID_36706; Location=465..611; Strand=-
  SCN-specific regions: Sequence locations=1-147
gtcatccgcacgttcaagcaaatgtatggcaaggaactgatcccggagttgaaaagcgaactaacaggcgacttcgaacacttaattattgcacttatggaactgccggcagtgtacgacgccgcacaattgcgccgttcgatggag

SEQ ID NO: 65958 - DNA, 370 bp, Heterodera glycines
  Genomic contig location: Contig_ID=SeqID_36707; Location=172..541; Strand=-
  SCN-specific regions: Sequence locations=1-370
atgtatggagcgacaccaagagcaattgaatatgccgaaaaagcaacttgttttggtaatttctttccattctaattcaaattcggccaattttaagtcagttccgacgagatggaattcgacctaccgaatgttggcagctttcaaagagcagaaaaaagttttgctggcaatgcaatttgaaagagaccaaagaaatgccggaattttgtctgcaccaaaaaaacctcggatggccgagatggaaataatttcatcattgccgtccatttcattcaaagacttcgaacttttgcgccaaatttgcccaattcttaaaatttttgacgtggaaacccaaaaagtaaaaaatttctttttgctcaataaa

SEQ ID NO: 65959 - DNA, 285 bp, Heterodera glycines
  Genomic contig location: Contig_ID=SeqID_36709; Location=517..801; Strand=+
  SCN-specific regions: Sequence locations=1-135,193-285
atggcaggtccaggacggctgccaaactttctggtaataagacaattgctcgaaacaattcagtttgtttaggtacgacccgaagaacctaaaaggatacattcattcatgcccagttaatccgttttctattcaaaaaggtaaaaatagttatttggatatttatttattcataatatatttaagggggtccgcaacgctgtcatggaaaatgggttaagaaatcgaaatcgaaggggtcgactgaaacgtgtgtctctgaaaaagaaggcacaaattccgagg

SEQ ID NO: 65960 - DNA, 154 bp, Heterodera glycines
  Genomic contig location: Contig_ID=SeqID_36710; Location=43..196; Strand=-
  SCN-specific regions: Sequence locations=1-74,96-154
tttgatgaagaggtacaaatgtgatttaaagaggtacaacagtgataaaagaagtataaaagtgattagaagaggtaaaaaagtgattagaagaggtacaaaagtgattaaaagaggtacaatggtgattagaagaggtacaaaagtgattata

SEQ ID NO: 65961 - DNA, 3404 bp, Heterodera glycines
  misc_feature (3374)..(3374): n is a, c, g, or t
  Genomic contig location: Contig_ID=SeqID_7787; Location=123..3526; Strand=+
  SCN-specific regions: Sequence locations=1-265,287-398,423-447,507 -565,697-747,825-826,848-1672,1694-1724,1757-1801,1827-1850,1876 -1908,1933-2135,2160-2200,2239-2306,2354-2354,2383-2383,2412 -2425,2465-2512,2584-2586,...
  SCN-specific regions: Sequence locations=...2608-2647,2676-2791,2813 -2826,2848-2929,2951-2995,3017-3075,3118-3156,3210-3308,3330-3404
atgacgccaaatttgttggcgttttgcctttgtcccatcccccaaataaagtgccaatttttcgtctgtctgatcactaatctgaattctgatcagccttctgacaaatcatcaggtgatcagttcttgggtcggctttttcttcgacgtccgttccgtctctgcgcgcattacgcttggcgtttcgtcactgcttgcgttgacgtttcagtttggcaatgtgctacggtatgtgccaaaaacggtatttaaattggggataaaatggcataaatttttagaaaataaatttccaatgattaggaaaattccaaaataaatacaaattttttacatttttagacatttgccacgggtcagctacataaaggtgagcaaaaagacctgaaaattttgaaatttttcattgtttttcagtgccttgacgtgtggatgattttctctgtgatttttatttttatgtaagaaaaaacaatttaaattaatttttattttataatattttaggacattggtggaattgtccatcatatgtcaagtgagtatttgcggaaattgagcatgcttttttttattaaaatgttaattaatttactttaattaatataaattattgaataaatttaatattattaaaaataatttatataacacttttacaagaaatttgaataaataaaaattttaaatttattactatggtttaataaaagtctgcacaaaaaaaagattaatatacaaaaaagcttattttacttaatataaaacattttcatttttaacaaataaattaatttcatgaaattttttttgaaaaatattttcgaaaaattaccaataataaattattttccatggccaatttgttgttacagttaaatcgctgggaacgcgagcgtcaaatcggctccaaagtgctgggccattggcttaaccaaatccgcaagacgcgcaagcagacagggcgcgccagcgattacagcggtggcagcggcgccgatgggtcgggcgccggcggcggcatccgcaaacgctttttgctttcaccgctgaagcgaagtgagtgcgtcgggaccacggtgatgccgtgttatgcggcacggattttttttgggggagggaagcgaaatagtttcgcgattttccgaaatttttatcggcattggcatttgccgcaatttttttttggcgcggcatttaaatttctgccattttcagtcactcattcgccgtctccgtccccaccgcctcgggcacaaattcaaaatgcgctttcgatcagtcgcagtgcgacggccacagatttgccgtccaaagaaaagtgaaattttgaaatggaaactggttcattaaagctttgaaatgcgatttttctattttgggtaattagtagagcccgaaatttcaaatttgcgaatcccgcgggatttcgcacaaaaaaaacaaaacaaaattgcggatccctctgcgggattggaactcaaaagttttacgggacgggatccccccaggactaatcccataaaatcccgcattttccaaaaatgcgggattgcggactgggatcccgccaaatcccgcaccgggctcttgtattgtaattgttagttacaaaattaccacttaccaattttacaacataataatattttttgtagagtagagcgggaccgggaattttttgttttgctatttatttaataaaatccaaagttaaagctaagttaaattaattaaaattttaaaatcaaattttcttcagtcatttcaaacaattaatcatttttggaccaaatcatcgaatattaatagaaattcagatttgattttcacatcacttttttcggagcgctttttcaaaaaacttttgggaaagaaggggtcccggcggaggcgataggcgccgccgggggaaattttaaaaatttgggtgcaatttgttaacagattttcaacaaaaaaagttggtttttgcgattattaagctcaattggtaggattttcatttgaaaaatgataaaatatgtatcaatttaaaaaaaactatgaggaatcatattttgtcgataggaaagccatgagtatacaaaaagaaaattcaaaataattaaatttctgtagagggattgaaccaggggaaagaagaagggaaagtcaaggagactagccattaggccatttgcacaattggcagttttacttttaaagaatatattaattattatttcttaattttttccctttaactccaattttcttcactaatttttgactcagacccccattcttaccagtgcttgtttttcccggttcccggttgccctaccgggaccgggacctgagcttttcaaaatccgggaccgggacctgagcttttcaaaatccgggaccgggacctgagcttttcaaaatccgggaccgggaaccgggaccgggacctcggatgaccgggaattcccggcccagtcccggtcccgctctactctaattttttgtattgatagtaaaacagtaaaattcaattattatttatttcttgaaaaaatatataattaaaatattcattatttaaatttaaaaattccatcttcttttcctccctgttttcaggtcacctccatctccaatattgggacgtcaaatgtgtaataataacaacaacaacaataacaacatcaccgccgccaccggaggcggcgaaagtgaaaaattttcaaaaaaaaattttaattcgaaaaatttttcttcagtgattcgcgtctcgtcggtcagccgttgggccacttttcgcgagggatttgcagggggtaaatctttggtcttttcaaaaataattttttaaaaattgcaaattttttgcctaaattttcagcaggcggtggtgacacgagaacagcgggcagcgaagaaggtgaggaaatttgggcactattttaatttttttttaaatgtgccgaattttacatgaaaagccatgccattgaggcgccaaaattagtaattaaaaattcaaaatatttgccttttttcctggatttaaaaagtttttttcgcaagaattggcaacttaatgagaaaatttaaatttaaaaattcaaaattattaaatatttttttgcagcagacgatgcacttttttcatcaaatgtttgttactttttttatttatattttatattaatataattattaaaattattatttttaaagcatttaaagaagaaacttattaaaatgggaatttttatttaataaatgattgtttcaaataaatattttccgatttttttagcgaaagccccgctttttgaggacaatttggcaccagctgaagaagctgaacccgtgcagctcgaagcgcgaatggtccatcncttcggtccaagtggcccgcaaatggatga

SEQ ID NO: 65962 - DNA, 215 bp, Heterodera glycines
  Genomic contig location: Contig_ID=SeqID_7788; Location=130..344; Strand=+
  SCN-specific regions: Sequence locations=1-64,86-192
ttctcttcccactttcctatttggtgttcaatttgacctattgcatttattatttgggaaagatcggcaggccgctgtgaacgcaatgaacaatttgtggtgcaacaacacccatttgattagcgaacattcgcttaaactatcattttattgaaataataatgtattttggaattcgttcattgttttttctaattatattttaaaatttttaa

SEQ ID NO: 65963 - DNA, 1069 bp, Heterodera glycines
  Genomic contig location: Contig_ID=SeqID_7789; Location=42..1110; Strand=-
  SCN-specific regions: Sequence locations=1-114,139-447,470-785,832 -1069
  Gene Ontology: Cellular component=membrane
atgagcattggcatttttgcggcccaattgcgtctgagggcaaaacaaattttttgcatttcgccctccacaattaacacatgcggtgccatcaatacggtatagattagtttctcataaaaaacataataaatatttcgtaggtttgctttgacaagaccggcacactgacggaggatgggttagttagttgaaaatttggggattttttttcgtaattttaaagcctcgactttaactgtttgcgtgccgtacataattgcgagtttgggcgcgaatttggcaacgagctgcacgacttttgcacagatgaactgccccaaaatggggagttgctgaaggcggttgccacctgtcacagtctgactcggtgcgtcatcatcttgaatttaaataaattttttggctttttttcccaccaatgtgccgattttttatatattgtttcacaaaataatcccccttttttgtacagcattgacaaggagctcaacggggacccgttggacctggtgctgttccgcaaaactggttggatcatggacgaaccgaccgaaagtgcggtggtggacgagacgtccatgtacgacatgcttcaggtggggatgtgacctgcttgtaaaagctaaaaaaaaaattttaacattgggctgccaaaaaccaaaaattttgatttgaaaaatgcaatatttcagcccaccgtggtccgatcgccgccactgcactcggcggttgagtccgacgtggaattggcgatcattcgacagtttacattcaggtgggtgtaattaaaagattaaaaaactcaaaatttttataatttttttatttccccgatatcccaattttgttgcagttcatcccttcaacgaatggctgtggttgtacacaaccccaacgaggactcacacattcaccatttggttggtcaccatttgatgataccgtattcctctgtatctccttttttgcagtactgtaaaggcgcaccggagaaaattgcgtcgttgtgtgtgccggaaactgtgccaaacgacttccaaacttacgtggacaactacgcacaaca

SEQ ID NO: 65964 - DNA, 844 bp, Heterodera glycines
  misc_feature (737)..(737): n is a, c, g, or t
  Genomic contig location: Contig_ID=SeqID_36712; Location=285..1128; Strand=-
  SCN-specific regions: Sequence locations=1-259,313-407,429-492,516 -567,595-687,740-794
atggtgtttataataataattaggaatgagagtcacgagaaaatccaaaaaagtcatggaaaaatagccaaaaagtaacaaaaaaatctggggatcagaatttcgaaactaccgaccatgggttcgggcttagacagttgaagtcttttataataaaaaaaacataaaaattccaaaaagtaaaaaaaaccaattaaaataataatgcatttaagaagctttcaaacaaagtgtaaaatattttaaagtcattttaaggccatttaattttatttgtacatattttggttgtgttatattttactgaaaaatgtaccaaaattgtaatttcttttcactttgaagctaattttgaatataaattctggctttttgctgcgatttttattaaaatgtccgaatgcaaaattggagaatttatttcatttcataataaaaaaaaatcgaaattttagaggagaattgttatgattgttttcaaatttgtcaaagattggacaacccagaatcaatcagtgatcaacaacagatcgaggtggacgaacgcaacagaaacaataaaaatggaaataaattttaattattaatattataggaaattcgtctaaactttgccaaaacggaaatggaattgtgcgaaacgaaacaattgtgcttaattaagggtcttcgactcgaaaaagcgagtttttatttaaacattttttaaatttgccataatttttaaaaaaaatttntagagggtacttcaagcagagttagcccaacaatacggtacagaaaattatttgctgtttttttaataattaagcataatttattttatttttaaatttgaaataaa

SEQ ID NO: 65965 - DNA, 455 bp, Heterodera glycines
  Genomic contig location: Contig_ID=SeqID_36713; Location=661..1115; Strand=-
  SCN-specific regions: Sequence locations=1-298,321-455
atgtggtggtttcacgaaattccaacaccaccgcccccgcaatttcttccaacccaacaaggccgactgaaaatgcgctaccaagggcacgattactacaaaaaatttgaaggagccaatgggcaggtgtactggaactgcgtccgttttccgcagaggttgggcgcgtgcaaaggcaaggcacaggtggtgaacggaattgtacggcaacgaatccgcacaaccatccgcctaacaatcatccgcctgccgaggaatgtaagtcggaagaatgagtaatagtaaactttggatataatttggccaatttttaggacccaaaatgtgacaacacacaagaaacggtggaccgtacgcaaccaaagaactgagcacggaatttccctaaaaatggcattgatcagtcatccccccaattgttatttgtgatcggataattgaaagcgcaaaataaa

SEQ ID NO: 65966 - DNA, 217 bp, Heterodera glycines
  Genomic contig location: Contig_ID=SeqID_36713; Location=214..430; Strand=-
  SCN-specific regions: Sequence locations=1-217
atggatggcactgccgcagttcctggcacgtctcagcagccgcctttcggcacggccactgacatggcgcacttctccaacgcattgcaactgcgacaactgcaactgttgcagcttcagaaacaacagcaggcggcacaggtcgcaaaaaatttgtcatttttggtgcaacaacagcagacggttcggtcgggagagatcggctacttcacgcaag

SEQ ID NO: 65967 - DNA, 520 bp, Heterodera glycines
  Genomic contig location: Contig_ID=SeqID_36714; Location=23..542; Strand=-
  SCN-specific regions: Sequence locations=1-254,285-427,449-458,480-520
atgaacccgaaaaattttgtgccttttggcctaaagtcaaagaaaatgcgtccaaattcactcaaattgacattgccatggacgcatttaacaagtggattaacacatcggatctgctcagcaatgaacaggaacagatcatcactttttgggctgaagttttttgcaaaaggctggaatcccattgctatgaatggcctgaattggacaaaaatatttttgcccaaattggtaatgaaattttacaggatgacaaataaatttttttaaattaataatttatagctcgtaatgaacggtggatgttatgactagagaccgcaaaaaaaagcatcaaaaatcgcgaaaaaggaactataataggcaccaaaaattgaaaaaaaggcatgaaaaggcacgaaaaccccgaaaaaggcataaaaaaggcatttaaaattttttttattaaggatttttagggagcaaaacacgtaaaacttattcaaaaaacttaatttttgtcatttaaatgattattaaa

SEQ ID NO: 65968 - DNA, 712 bp, Heterodera glycines
  Genomic contig location: Contig_ID=SeqID_36715; Location=49..760; Strand=+
  SCN-specific regions: Sequence locations=1-345,367-712
  Gene Ontology: Mol. function=long-chain-fatty-acid-CoA-ligase activity; Biological process=gametogenesis
atgccaaaccaaaaggacggagtgacaggaggcaaacgaattgagcaggaacttgccgtgtttgaccttcccttttacatcgtcgcattggcctttttcctaaaggcgttcttccgtctgtatgacttgctcgtcttcgtcccattcaaattatttgctgaccctgagctggaaaaggaacgctctcgtgagcgaaaggttttgcgctttcaaaagtaaaaaaagcaaataaaacggagggtttgctttaggccatgcccatcgatgggaagccgacttcgtcctggagacacgtcgataccattggcactgctctgtacaccgaactgtttgagggctgtccgacgcttggcaaaatttgggacaaagcggcacagttagtaattggctttatttatttatacatgcgtttatgtttgaattgaggttacaccgtggacacaattgcatgggcacgcgcgacattctcaatgtcgtcgaagaacagcagccggacgggaaagccttccaaaaattggcacttggcaaatgcaattggatgaactacgaacatgttgatgaagtgatcgtggaagtcgcttctggactcagcaatttgggcattgtccaaggacaaaaagtggtcattttctctgagaccaggaaggagtggatgatctcggccatcgcctgcttcaaattgggccttccaagtgcgctttactacaaatga

SEQ ID NO: 65969 - DNA, 355 bp, Heterodera glycines
  Genomic contig location: Contig_ID=SeqID_36717; Location=721..1075; Strand=+
  SCN-specific regions: Sequence locations=1-31,58-355
atgaattacatcacgaaaaatgaacgggcgaagtgaaaacaaataattaaaaagaagggcgggggactttagaagcgtgtaatctttgctttcaaatatattaaaacttttttttgcagaatatttggccaaaaagggaaacagcaaattaatgttgaaagtgccaatggcactctccgtttttcagagggtttatgccttttaaaatccggcacattaatccgttgtccatcacgtgcgatgtctagaccatcttaacatttcattttctaaagcacaaagttcgattccgttactgctgtttgtcagagtaaaaaaaatcagacaaattaaaaaatcaaatttaaaaaaagga

SEQ ID NO: 65970 - DNA, 66 bp, Heterodera glycines; identical to SEQ ID NO: 62826
  Genomic contig location: Contig_ID=SeqID_36720; Location=56..121; Strand=-
  SCN-specific regions: Sequence locations=1-66

SEQ ID NO: 65971 - DNA, 179 bp, Heterodera glycines; identical to SEQ ID NO: 57272
  Genomic contig location: Contig_ID=SeqID_36720; Location=193..371; Strand=-
  SCN-specific regions: Sequence locations=1-79,113-179

SEQ ID NO: 65972 - DNA, 146 bp, Heterodera glycines; identical to SEQ ID NO: 57274
  Genomic contig location: Contig_ID=SeqID_36720; Location=478..623; Strand=-
  SCN-specific regions: Sequence locations=1-79,113-146

SEQ ID NO: 65973 - DNA, 146 bp, Heterodera glycines
  misc_feature (26)..(26): n is a, c, g, or t
  Genomic contig location: Contig_ID=SeqID_36720; Location=730..875; Strand=-
  SCN-specific regions: Sequence locations=1-79,119-146
atggctatctatttttttgagaaatnttctatgcaacaaacgctctcgaacatgaaacgaagtgcggtgcgccgtggccattttatttttcaaataatttttaaatttaatatatattccagaaaaatggctatctctttttttga

SEQ ID NO: 65974 - DNA, 974 bp, Heterodera glycines
  Genomic contig location: Contig_ID=SeqID_1008; Location=11..984; Strand=+
  SCN-specific regions: Sequence locations=1-32,54-103,142-210,283 -452,474-974
atggatggaggtaggcaaaaatagaaactattcaattattataaataattaactatggatgcatgaaaaatgataaaaatcacaaaatttgatcattttttagtgaaaatctgtcaacaaattgtaatcaaattttcaaattttttcgcggcgccgcctgccccctcttcacaaaaagttttttttgaaaaagcgcgcctcaaaaaagcgttttattgatttttaaatttggaataaaatttaaaaaaatgatttttgctttatgattttaattattaaaaagttgtagaaaaaatttcgcattttcgcatattttagcttttcgcatttcgctttttttcatttcgcattttttagtttcgcaaatttcgctttttatttttcaatttggcccatccctgctaaaaagtaataccgtttttgcacccaaacttcccccctcccattcactattgatataaaataatgattttgaggtctgctcgcaaacaatccaagcctggaactgttggatgaaataagcaaggaaaatgcattggcaaaacaacacaatgtatgcagcagttgaccagttttatttagttttttttcaatttttacattttcaggaaccccagtatgagctggagtgttttgtttcgcttggcactggcaaggcaccgactgaaccggttggcacaacatcgttggagattgggactgaacttattggagcaattaagaatctggcggggattttgatggatcaggtacacacacacacacacactatatatatgtgtgtgtaaagcaaatcattttaaaactaatttcaagctggggttgtatatttccccttcctcacaattgtttctgaaataattgctttttttggaattagactcaaaattttcaatcgaaaaaatttgagtgcgtttcaggcctcccacagtccaggaaaaaaatatggatttccatataattggaatccctaa

SEQ ID NO: 65975 - DNA, 1007 bp, Heterodera glycines
  Genomic contig location: Contig_ID=SeqID_1008; Location=1658..2664; Strand=+
  SCN-specific regions: Sequence locations=1-340,363-613,654-863,887 -955,977-1007
atgatgattttggcgaacggagcgggcccgaacgcgactgacagcgctgccatgttgccattggcacatgtgttggaggttcgttagcgggcaaaaaacaaattgcttgaggggctaataattaatttgtgtccgttttttgcatttttactgtgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaatttagaaagttttaccaaaaattatattttcacacattaaggatgaaacaggcaaattccaaattgccaagttgttgctttgcttccatgcacgttgaatgtgccggccggaaagagagacaaaatgtattttaattcttatttttgattgttaacattgaatactttagcaatgaaaaggcattggcgaagctcgtggccaaactgaacaaacaaaaggtctcagaaatttttgtttcatattttccacttggaaaattctttttttttttttgctttaatttatttaaacattttttgtttagaagaaaaagacgggcacaaaatcggaagagtcgaccgttaaaaagccagagtgtgtggatgttgaggaagcaattaggaatgagtgcagcaaatggcactgaaaacgagaagaaatgaacaaaggaaaaccccgagacgcaagggcacgggcgtccgagcactttcactggacggtggcggaattcgaggcattgtattagtgcaggttttgattcgggactttttaattaaaaattaaattttcgattaacaatttgcgacttaaataattttttcctgcaaatgaaaaattggggtttactttcttgacaaacagttaaaaaacacttccataaaaaccatattttttaaagaagcatccaaa

SEQ ID NO: 65976 - DNA, 2288 bp, Heterodera glycines
  Genomic contig location: Contig_ID=SeqID_1008; Location=3015..5302; Strand=+
  SCN-specific regions: Sequence locations=1-137,159-241,263-479,504 -590,612-871,893-1049,1122-1291,1313-1602,1625-1992,2014-2026,2048 -2288
  Gene Ontology: Mol. function=transcription factor activity; Biological process=regulation of transcription, DNA-dependent
atgttaattgaaatggagtcgctgatgtacggcgagggtttgcaagcgggtggccatgaaaaaaacttcgtacaaaagaacttcaattgggttatcgggacgagcaccggagcggtgagagcaaaaattaaaattatcagttttaacttgctaagtatcatatttgtgcaattttgggtctgatttcaaaaaaatgcaaacattggagggggggggggggtggcggtgaagagaaattttcgaaaatttgttaatgcattttccaattaaaaaaattatttgaactgatcaattaaagatgttggacattgcgaatttcagatcgttgcgttggcacttgtctcgggcacctcactgatcgacgcactgtgagtttttgggagatccattttaaaattggatagtcgcagaagagccatttatagttttttgaactttttgaaaaattaattttttttttgtttttgagtgatggtcatcagtgaaatttttaaaatattgatgactcagaacatttgttattggtctctgccaaactgaatattttttcagagggctgaaaattgggtaagcccgtccgtttgttagcctttaaattgggaaaaaattttgctattagaaaattttcaatttttttggttttgctttaatgaattttcaaaaaaaaattgcagattgtttactaccgcaacatacgttggccaaaaaccttcccgacttgtcaaattcgaaacttcacttcggacctcaacgaatacaacccatacaaaaccaacatttggctagcggcgcgctattcaagtgcggcgccaacgtactttgaaagtcgggacaaattcatggatggaggtaggcaaaaatagaaactattcaattattataaataattaactatggatgcatgaaaaatgataaaaatcacaaaatttgatcattttttagtgaaaatctgtcaacaaattttaatcaaattttcaaattttttcccggcgccgcctgccccctcttcccaaaaagttttttttgaaaaagcgcgcctcaaaaaagcgttttattgatttttaaatttggaataaaatttaaaaaaatgatttttgctttatgattttaattattaaaaagttgtagaaaaaatttcgcattttcgcatattttagcttttcgcatttcgctttttttcatttcgcattttttagtttcgcaaatttcgctttttatttttcaatttggcccatccctgctaaaaagtaataccgtttttgcacccaaacttcccccctcccattcactattgatataaaataatgattttgaggtctgctcgcaaacaatccaagcctggaactgttggatgaaataagcaaggaaaatgcattggcaaaacaacacaatgtatgcagcagttgaccagttttatttagttttttttcaatttttacattttcaggaaccccagtatgagctggagtgttttgtttcgcttggcactggcaaggcaccgactgaaccggttggcacaacatcgttggagattgggattattggagcaattaagaatctggcggggattttgatggatcaggtacacacacacacacacactatatatatatgtgtgtgtaaagcaaatcattttaaaagtaatttcaagctgggtttgtatatttccccttcctcacaattgtttctgaaataattgtttttttttggaattagactcaaaattttcaatcgaaaaaatttgagtgcgtttcaggcctcccacagtccaggaaaaaaatatggatttccatataattggaatccctaattatggcccctcgaaaatggtagaactttgggcgccatggtgccgataggcgatgccagaaaattttgattttcattgaatttagttaagaaaatgttgcacgcactttgaagtcataaaacgaaaatttttgcgatttttcaagaaaaatttgtttgttttttgacatttttaaagtttttggttgcagttttgcataaaaatggccagattagatcattttaacaatcattctcatacatatgttttccttttttcacataaaattctcttcttatttcggttttgattttagcttacaaattttctacaaaaatttttcatggatttggacgcatttcttcgtttcttcgctggggtttgcaatttattttaatgtttgtcttaaacttttttttttgtccagccgcagcagcagccggcaccaatgagtatttacgaacgctttaacaaggaagtttgcgaaaaaaacccttga

SEQ ID NO: 65977 - DNA, 1005 bp, Heterodera glycines
  Genomic contig location: Contig_ID=SeqID_1008; Location=5497..6501; Strand=+
  SCN-specific regions: Sequence locations=1-337,360-626,650-859,884 -969,992-1005
atgatgattttggcgaacggagcggacccgaacgcgactgacagcgctgccatgtcgccattggcacatgtgttggaggttcgttagcgggcaaaaaacaaattgcctgaggggctaataattaatttgtgtccgttttttgcatttttactgtgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttgataaatagaaagttttaccaaaaattatattttcacacattaaggatgaaacaggcaaattccaaattgccaagttgttgctttgcttccatgcaaagttgaatgtgccaggcggaaagagggacaaaatgtattttaattcttatttttgattgttaacattgaatactttagcaatgaaaaggcattggcgaagctcgtggccaaactgaacaaacaaaaggtctcagagatttttgtttcatattttccacttggaaaattctttttttttttgctttcatttatttaaacattttttgtttagaagaaaaagacgggcacaaaatcggaagagtcgaccgttaaaaagccagatgtgtggatgttgaggaagcaatttggaaggagtggcagcaaatggcactgaaaacgagaagaaatgaacaaaggaaaaccccgagacgcaagggcacgggcgtccgagcactttcactggacggtggcggaattcgaggcattgtattagtgcaggttttgattctggactttttaattaaaaattaaattattcgattaacaatttgcgacttacataattttttcctgcaaatgaaaaattgaggtttactttcttgacagacagataaatgaacacttccataaacaccatattttttacagaagcatctaga

SEQ ID NO: 65978 - DNA, 499 bp, Heterodera glycines
  Genomic contig location: Contig_ID=SeqID_1009; Location=503..1001; Strand=+
  SCN-specific regions: Sequence locations=1-274,295-499
gtctgctcgcaaacaatccaagcctggaactgttggatgaaataagcaaggaaaatgcattggcaaaacaacacaatgtatgcagcagttgaccagttttatttagtttttttcaatttttacattttcaggaaccccagtatgagctggagtgttttctttcgcttggcactggcaaggcaccgactgaaccggttggcacaacatcgttggagattgggactgaacttattggagcaattaagaatctggcggggattttgatggatcaggtacacacacacacacacacactatatatatgtgtgtgtaaagcaaatcattttaaaactaatttcaagctggggttgtatatttccccttcctcacaattgtttctgaaataattgctttttttggaattagactcaaaattttcaatcgaaaaaatttgagtgcgtttcaggcctcccacagtccaggaaaaaaatatggatttccatataattggaatccctaa

SEQ ID NO: 65979 - DNA, 1029 bp, Heterodera glycines
  Genomic contig location: Contig_ID=SeqID_1009; Location=1675..2703; Strand=+
  SCN-specific regions: Sequence locations=1-340,363-581,603-769,791 -1029
atgatgattttggcaaacggagcgggcccgaacgcgactgacagcgctgccatgtcgccattggcacatgtgttggaggttcgttagcgggcaaaaaacaaattgcctgaggggctaataattaatttgtgtccgttttttgcatttttacagtgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaattgagaaagttttaccaaaaattatattttcacacattaaggatgaaacaggcaaattccaaattgccaagttgttgctttgcttccatgcacgttgaatgtgccggccggaaagagagacaaaatgtattttaattcttatttttgattgttaacattgaatactttagcaatgaaaaggcattggcgaagctcgtggccaaactgaacaaacaaaaggtctcagagatttttgtttcatattttccacttggaaaattcttttcgatgccagaaaattttgattttcattgaatttagttaagaaaatgttgcacgcactttgaagtcataaaacgaaattttttgcgatttttcaagaaaaaatttgtttgttttttgaaatttttaaattttttggtagcagttttgcataaaaatggccagattagatcattttaacaatcattctcatacatatgttttccttttttcacataaaattctcttcttatttcggttttgattttagcttacaaattttctacaaaaaattttcatggatttggacgcatttcttcgtttcttcgctggggtttgcaatttattttaatgtttgtcttaaacttttttttgtccagccgcagcagcagccggcaccaatgagtatttacgaacgctttaacaaggaagtttgcgaaaaaaacccttga

SEQ ID NO: 65980 - DNA, 2358 bp, Heterodera glycines
  Genomic contig location: Contig_ID=SeqID_1009; Location=2802..5159; Strand=+
  SCN-specific regions: Sequence locations=1-340,363-613,654-864,889 -1133,1155-1279,1301-1497,1519-1603,1625-1987,2012-2098,2120-2358
  Gene Ontology: Mol. function=transcription factor activity; Biological process=regulation of transcription, DNA-dependent
atgatgattttggcgaacggagcggacccgaacgcgactgacagcgctgccatgtcgccattggcacatgtgttggaggttcgttagcgggcaaaaaacaaattgcctgaggggctaataattaatttgtgtccgttttttgcatttttactatgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaattgagaaagttttaccaaaaattatattttcacacattaaggatgaaacaggcaaattccaaattgccaagttgttgctttgcttccatgcaaagttgaatgtgccggccggaaagagagacaaaatgtattttaattcttatttttgattgttaacattgaatactttagcaatgaaaaggcattggcgaagctcgtggccaaactgaacaaacaaaaggtctcagagatttttgtttcatattttccacttggaaaattcttttttttttttgctttaatttatttaaacattttttgtttagaagaaaaagacgggcacaaaatcggaagagtcgaccgttaaaaagccagagtgtgtggatgttgaggaagcaatttggaaggagtggcagcaaatggcactgaaaacgagaagaaatgagcaaaggaaaaccccgagacgcacgggcatgggcgtccgagcactttcactggacggtggcggaattcgaggcattgtattagtgcaggttttgattcgggactttttaattaaaaattaaatttttcgattaacaatttgcgacttaaataattttttcctgcaaatgaaaaattggggtttactttcttgacaaacagttaaaaaaacacttccataaaaaccatattttttaaagaagcatccaaaataaacaccaatatcattcgataaacctaggtcttccattctcctgcaaaattccaaaaaattcgttctgcttcaaaaaagtcattgcccgaaaacctcaaaaaaaaaattttatctaagcattttgtttataaattttccgaaacagagaatattctttaaaattttgcatcctaatagagttatcgaatgatataaagaatgtttaatttgagtgtttctttaaaaagttgtgatttacttcatttgcaaaattatttattggccgtgtcttttttatggtcatgtcaatgcaatagagcggcttaccaccatatttttcgctatgcttatcccttatcaaatttgcagatgttaattgaaatggagtcgctgatgtacggcgagggtttgcaagcgggtggccatgaaaaaaacttcgtacaaaagaacttcaattggattatcgggacgagcaccggagcggtgagagcaaaattaaaattatcagttttaacttgctaagtatcatatttgtgcaattttgggtctgatttcaaaaaaatgcaaacattggagggggggggggggggtggcggtgaagagaaattttcgaaaatttgttaatgcattttccaattaaaaaaattatttgaactgatcaattaaagatgttggacattgcgaatttcagatcgttgcgttggcacttgtctcgggcacctcactgatcgacgcactccgactttacttgcgcctgaaggattcggtgtttggcgcccgggcgcagctgatcggttacaacgcgcaaaatttggaaacattcctccaagcgcagtttggcgaacacaaaaaaaaatggccgaattatcgcgtggaaacattaagtgagtttttgggagatccattttaaaattggatagtcgcagaagagccatttatagttttttgaactttttgaaaaattaattttttttttgtttttgagtgatggtcatcagtgaaatttttaaaatattgatgactcagaacatttgttattggtctctgccaaactgaatattttttcagagggctgaaaattgggtaagcccgtccgtttgttagcctttaaattgggaaaaaattttgctattagaaaattttcaatttttttggttttgctttaatgaattttcaaaaaaaaattgcagattgtttactaccgcaacatacgttggccaaaaacctccccgacttgtcaaatttcgaaacttcacttcggacctcaacgaatacaacccatacaaaaccaacatttggctagcggcgcgctattcaagtgcggcgccaacgtactttgaaagtcgggacaaattcatggatggag

SEQ ID NO: 65981 - DNA, 360 bp, Heterodera glycines
  Genomic contig location: Contig_ID=SeqID_36728; Location=391..750; Strand=+
  SCN-specific regions: Sequence locations=1-74,96-140,162-327,349-360
atgaacgtgaaattgagtgatggtaaaggcagctttgcggaccgtgttttgttgatggaacggtaaatttgaaatttaattgaaaatgccaaaaagaatatttacttaattgaatcacatttatttcaaatatttgccaatttttatttcttaatatttgttttttcagtctttgtccaatggtcaacaaaatgggagtagctgcaaacaaaagcaacctgatcatgcagccacttgagtaagttttattgaaaattcaaatccttcaatatttcttataaaattatttgagcataattagtgtggggtttaaaacgattttgtgtttttaatattttggcaaaagatattcaatagcca

SEQ ID NO: 65982 - DNA, 927 bp, Heterodera glycines
  Genomic contig location: Contig_ID=SeqID_7791; Location=456..1382; Strand=-
  SCN-specific regions: Sequence locations=1-927
atgagcccacctgcatcaaatttggcttcaccgtatccttcatcagcacagccaacgcgccggcaacgcaaagatcgtccgcagttatcggattcatgtcccgatcatttgctaccacaattttgccaatccgttcgcgcaaatccgccagccccatgcattgggccagaatggccattagctgagaggggtggagaaagtttttggatgaattagttagttttttcaacaaaaaaaaatccaaaaaaacggctgaaaattgttttcttgaaattttgttaattaggcctcgagagtctcgagccaaacaaaaaaaaacaatccatgccgacattggcacggcatgttagtgtaacaggttgtgtaaaaaaaatcactgcagagtttggaattccggacacaatttggaattcatcatttttatattttctaaaatttcattcattttttatgtgcaaggttggcacggcatagatgaacgcacttcggatgagacggtgatggcatattcggtggtccgcttgtgcttctgctcttgcggtccgtgcccaatttcaacacggcgcaacatgcgatcattcagatcaaccacacggcccaaatagatctgatcacggtccaaattcagtcgggcaaactgtcgtcgctgatcagtgctcagctgttccgcgtcctcaaccgccggaaggcccaagcgttggaggcgacgcttttgcgcatcgcaaagcggacgctttcctgtgccaaagtgtggaaaattgtgtgatcaaaatggcaaaatgatcggaccaatgtgtgttgatcagagacaaatctgatcaatgaacctttaagaaaaatgatcaaagtatctgatcaaaatgttcagctgaatttgatcagaatatggacaaaattaagagtcatttaaaaaatgatctaaataaa

SEQ ID NO: 65983 - DNA, 4114 bp, Heterodera glycines; identical to SEQ ID NO: 7791
  Genomic contig location: Contig_ID=SeqID_7791; Location=1..4114; Strand=+
  SCN-specific regions: Sequence locations=1-927,974-1391,1425 -1729,1758-1963,2003-2130,2160-2311,2333-2648,2681-2905,2932 -2991,3013-3172,3194-3563,3585-3640,3670-3732,3754-4057,4079-4114
  Gene Ontology: Mol. function=formate-tetrahydrofolate ligase activity; Cellular component=mitochondrion; Biological process =purine base biosynthesis

SEQ ID NO: 65984 - DNA, 604 bp, Heterodera glycines
  Genomic contig location: Contig_ID=SeqID_36733; Location=80..683; Strand=+
  SCN-specific regions: Sequence locations=1-58,80-111,135-163,243-604
atggaaaatggcaaaaggcaaagcgaacagagtcagaggatggaagccacaaaaacggaggagaagaagccattgaagcaaataatgtttctggacgattatgaacaagttcaaggagaggaagagggaaacgaaatggcaaatggaagggaagggcagcggagagaagggggaaaagagggggaggaggaggaaaaggaggaagaggcatttgaggaggaagagaatgaggaggaggaggaaatgttcttcttcaaaccgagcggtgggcacgccctaagtaaggacaaacggacgaggaaatgggccatcccaaaaggacactccgttttaagggtgccgcaaggatatttcccaaacccgccaaattggcgcttattgacaaaaaaagcattgttttaaattttaagcaacctaattaagcaaattttataccatttaatagctcttattcaatactctctgtataggctataaatttctattcactcatcaaaaattttaaaattgctggccaatagaaaataccgaaagcttggatttaaaatttttgattttgagaaaaataaggacgtcgaatttatgaaatgctaatggtggcgga

SEQ ID NO: 65985 - DNA, 723 bp, Heterodera glycines
  Genomic contig location: Contig_ID=SeqID_36734; Location=1..723; Strand=-
  SCN-specific regions: Sequence locations=1-73,95-226,255-723
ccgaaggattccgtctccccataaatctgggcgcatcggttcagggggactgccccgaaaacccaaaaaaaaattttttggataaaaattatttaaatgaactgactagataatatttaaaataggagatttctcttcctttcagtatccctgcaaagtttggtgcgcttctgatcagtttctgaaaaaaaagttaagcctaaactttttggcttgtttaaaaaggaatttaaaaattttttaaaaattttattcatctcccttttcgatagaaaaagcatcagagtgcctaaactaacatgtaaataaaatttggtgcgtttcagagcattttctgataaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaaaaagaataaatcgattttttcaagtgtccgtttggggtact

SEQ ID NO: 65986 - DNA, 677 bp, Heterodera glycines
  Genomic contig location: Contig_ID=SeqID_36738; Location=182..858; Strand=-
  SCN-specific regions: Sequence locations=1-261,317-677
atggttttcactggcattgatcgactgattggaattgcttttttggaattgtatgaaaaaatacaatattatcaaattgttaattacagtaattttcagttacgataaccttaaaaaacgactgtatttggcactgttaacaattctttctgtggtctatggtgtctgcttctctgcttcggtgtaccaaaatgcaattatggaaggtgatgagttgaccaccggatcatatggcgattttttaaaggtgttgtttattgcttttttattactaatttaaatattatatatttttagaataaatcaattttaaatacaataagttttatgcttatttcaatgtctttcataatttatgtttgtcttggaattgtggtacatctcaaagcttcaggtaaaaaaagaaaagaaaaagcatatggccctctcgtcggcaacgaaattgccgacacctcattgcactgcattcagtgaagtaaaaaaaatttttgctaaatttttggctgaaaattatatcactataacgtcactatttcggactttttttcactattttggcacttttttagttaactatttcaacatgtttcgtcactaaaagtcgcgaccctaatcattatcttatttcaaatttgagtgtttaaatttgccggaaaatttttggaaattgtaataaa

SEQ ID NO: 65987 - DNA, 367 bp, Heterodera glycines
  Genomic contig location: Contig_ID=SeqID_36739; Location=412..778; Strand=+
  SCN-specific regions: Sequence locations=1-3,25-48,83-137,159-216,241- 367
  Gene Ontology: Cellular component=nucleolus; Biological process=growth
atggccaaatattgtttaagtaagaaaaaaagtcaatcaaaaaaacagtaaaattttccattttcagaaaaacaaagcaaacggttgacctgcaagaagaagttcaaaattcagcgcaaagttcgggaacactcgcgaaaacttaagaaaatgtccaaaggtaaaaaattaaaacgaaaaccccttggatttttcggaaatttcattgccctaaccctaataaaaattttaaactttagaatccgagcggaaaaagaagacggaaaagcaaatttccgtgcccagcaaatgtccattcaaagaggaaattttgatggaggcggaacagaaacggacggaggcaaaggtttccccaaaaaaacattag

SEQ ID NO: 65988 - DNA, 1263 bp, Heterodera glycines
  Genomic contig location: Contig_ID=SeqID_7792; Location=581..1843; Strand=+
  SCN-specific regions: Sequence locations=1-5,28-490,512-987,1009-1263
atgtcaaacgaagaagaaaatgttgaagagcaaagagagttttcccctcagcaacagcagcagggcgaacttcgctatttccacgagggatttacttatgtgaaagatcggctcagtgccgacggcacaaagttattttggcgatgcgggaaaaagattagttaatgggtaaatattaattgactcattagtgccttctgttttaaacgatgccaaacgcatgcaatgggcgcatttggacggatgccaaagacggcactttcctttcgatgaggacgaaacattcgtgcagagaggggagggaagacacggacgaagccgactcccacggggacggcaccgggcctatgacccaaagtgccacggccattgtcaaaggtccgcgggagggcgcggcacagcgcaaacactcgcggcatttgcttttcactctcggaaatattcactttcctttccaatcgcttgtctcatttcgattcaaagtttctttttgggatgaaattgctgaaatccctcccttaatttaaagaaagagtcggtactgaaaaagacattttcagttgaagcgggcgacagtttgaccaatgccattctgggcattttgccccaacaatcggccgacgacgccgaggctggcagcactgggaacggaccaatgcattcagcggaacatcaccagcacgagacggaccagcaacagcagatgatctcttcagggacgggtgccgcgtcggtggaaggaaatgccatcgccgcgggggttcggcgccattctctgctgggaccgattccaatacgttcacagcaacagcaatccgtcgaaggccaacagtcgaccattggccagccgatggtgcgcaatttgccacctgcgactgttcgcactgcgaattttgcgcaaaatcatccggtgggcaagggacttctgaatgttttttggcaactgtgacttcgtttcgggaacattctttctcactgtgccgccccatttcaattaattaattaattgagcagcaatcgctcgtcaattcgcagcatccgaccgtggccaacaattgccattccgagcagcacttcgccggtcgcaagaggcgggcattccctccgccgccgcagtcgtcggcactgccgctgaacggcttctcaaattgtgtcggcgaagacggagaaacggtggaacttcgactgaaacgcctcaaatgcgaactcattgaggtgggagcagcagctaattgtgagagaaacaccacaaaatggcattaa

SEQ ID NO: 65989 - DNA, 928 bp, Heterodera glycines
  Genomic contig location: Contig_ID=SeqID_7792; Location=2513..3440; Strand=+
  SCN-specific regions: Sequence locations=1-888,910-928
  Gene Ontology: Mol. function=structural constituent of cuticle; Cellular component=extracellular; Biological process=cell-cell adhesion
atgtccgacctgcccaccggtactgtaacggtggcggtcattctgtccgtcatttctctcagtgccattctcgtcggagtgccgctaatgctcaacgatttggtgaaccttcagcttgagtttggactgaaaagccaagcgcacttggacatgagcaacgttttgtggagagacataatgaaagaggtggcgacgattggccaatgggacaaaagggagcaaaagcagacgatacggaagcggagacaatgtgcgaaagggacggacaattgaccactcgaaacaaatgccgttcagacggaagcggaaatatcggcggagggggcgcgagcagtccaagtgccacttgccctcagggagcgcgaggggccccgggagtgccgggggcaccgggagagccgggtcaatcaaagccaagagcgaagttgctaacaaagaattgcctttaaggccaagacggacaacccggcacttcgggattctcgggctttccggaggattttgctcacgtgtcgcagtgccccacttggtgatttatttcgccatgacttaacctgtgtttctctttgttaaagtccaattggtccacctggccccccgggatacaaaggaaggagaggctttcgcggtgaaaagggcccaatcggtacacatttaaatagcccaatggcgtcattcaattttaattttaaaggacctcccgggtcgcctggtcgcgatggccatcccggtgagcagctaatgaacggattaagccgtgtgaggggaaattgtactgtttttttatcaggtgacgaagggcccgaaggcgaaattggacttcacggagatttgggagagcctgggccgagaggccctcccggcgagacgggcattggatacgcaaagggcgagccggggcccaagggagagcacggacagccggggg

SEQ ID NO: 65990 - DNA, 2162 bp, Heterodera glycines
  misc_feature (2068)..(2068): n is a, c, g, or t
  Genomic contig location: Contig_ID=SeqID_7793; Location=1..2162; Strand=-
  SCN-specific regions: Sequence locations=1-1103,1135-1143,1167 -1247,1269-1683,1724-1748,1796-1870,1892-1911,1933-2162
  Gene Ontology: Mol. function=neuropeptide receptor activity; Cellular component=integral to plasma membrane; Biological process=G-protein coupled receptor protein signaling pathway
gcgtttttcaacgaatgtgtggacatgaaccacttcctgtgggagttccagcgtgatcccacctcgcgtccgatcaccgccgccattttcgccgttgtctattcgctgatcgttctggtcggcgtctctggcaatatttgcgtccttttgtccatcggccggacgcgttctctgcagacggtgtccaacctgttcatcttcgctttgtcctgctccgacatcgtcgtctgttgtgtgtccgccacctttacgccttacaccgccttcactaaagtttgggtgttcggagttgcgctttgctctttggccaatttcaccgcggtcagtactttttggctaattggcattggcattgttttgccatttgtcatttgctaccactccctccctcgtccctttagggtacatccctttgcttttccatttttgtcctcgccgcaatttctgtcgaccgttttttgctcattcgctttccgctcaacaatcagcttcggcataaccacgcgttgctcattatcccggtgaggaggagggaaacggaattatctcaatttgcatcccatccaaaccaacagattctttgtttgttcgcaatgttcgtcagtttcccaatgattttcacacaaaaattgctgcggatggagggatactgcggcgaattttgcgttgaagattggggcacaaatgaattgtatcgtgaaatttacggcacccttctgttggtaggcaaaaaagctttaatttataaaaaacaacgctattctggacttttgaaagattgtccaattcttcgtgcctttgctcataattaccatttgttacatcggaatttcggttcggctgaacagagtgagtcgaatcagccaagtgatcagaagactgatcagtcaaaactaacgaatttagaacattttgctacgccgtaaaaagatgggcaattcgtggctgcgccatcgccaatcgatggccgatcggagaaggcaaaggacgaatcggatgttcattctgatgtacgatctcccacagccattaattgatcaatcttttccttttagggtctgtgccttcgttctcaggcaatttcttccccgccccccaaatttagcaaatttttggcaattttttgccgatttcagttggatttggttcattctgttcaaccttttgcgcgacttgggccttctcccttactttatccgagagcaggagtttctgtacgggatcatcactcatgccattgcgatgacttccactgtaaatttcaaattgtcccctttttagccatttgtcccccccccccaatttttgttaagatttggaaccccattctgtacgctttgctcaacttccaacttcgctccgcttttctccgtttggtgcccgaaaatgcgcggaaatttatggcgaagcgaaaattcggacaattggggagcaaatccaaactgacgccgagggatgccaaattggtggccccgactttgctaatggcatccatcggccagcaaaaacaccgccaaacgacgatcgctttaacggccacctctcccctcgtagtgccaacataaaatgcgaaaagaaaggacaaagaaagccaaccgaagaaaagccgacacaaagccaaacaaaacgatggcaaaagccatcgaatggcaaaagaaaaacggaagaagtggcgacgaatggacaaataacaaaacaaaaattaattgccttttgatgttttggccaatggccgaacaaaaccaatcaaattttaatatttattattaatttttattgttttaaagaatttattgaagtcagaataaattcatacattagcagcagtgaaattaaaataacattttgtatttagccgaacttacaaagtgaaaaagactatttcatttagtaattcaaatggataaaactaattgtttattaaaatattaattgcttttgctttcgcttctcaaaatgtcttaaaggtgtcgcgtgcgaagggcggcggcaagtgccaatttgttataggaagaagaacggggagggaaaacagcagcggaaggtgcagcgaaggaagacggagcgngaggcgcagaagcggcgcgttgcgaagcgtacggcggagggggcgcagcgacgggacgcgccgaaacgggcggatggagggcggaggctgaaaa

SEQ ID NO: 65991 - DNA, 92 bp, Heterodera glycines
  Genomic contig location: Contig_ID=SeqID_36743; Location=261..352; Strand=-
  SCN-specific regions: Sequence locations=1-92
caagggaatgttattattgtcacagaggtcgactgatggagctgtacggggacaacggtcaaagcgtccaattagaagccgtagtagaccga

SEQ ID NO: 65992 - DNA, 724 bp, Heterodera glycines
  Genomic contig location: Contig_ID=SeqID_36744; Location=193..916; Strand=-
  SCN-specific regions: Sequence locations=1-123,147-724
atgcctaaaattaaatctaaatgtgaatggatgcgcgagtgagtcaacagtgagtttcactgtcgaaaaccttgagaaatttttgatttacaattacaaaaacaaccgatataatttatgaggaataaaattttttaataaatttagacccctaattttcaagtttttttgtgcatatttggtgcatattttgcgatttttgtgcatatttgatgcatatttggctattttatttgcatatttatgtgcatattctggtcacttttcgtgcatattttttgcagccctgataatgacatcagaatcgaaaaattttaaaatgtgttttttgagcttttttcttcaaaacaattgagcaaaaaaaaataatagttaaagcctaaaaatcgcatccctagtaataaaataatgcttattatttcctatttccaaaaaatattatacatatgtaattcttttagaaaaattttctatcttttcaaaggcaatgaacaaatgccaaaaaagggtggcactgccagcagaattgattttgggaactgtccaaggcaataccattggcaaagtgccacacaatgaaagcaaaactgagaaaaaagtcgaagaaagcgaacggcaaagaaatgctactcgtaactgaattgagaaaacgatcgaaaatgctaacaaaattggtaattgaaaattaaaaatcaaatttaaaaatttcattttaccaaataaa

SEQ ID NO: 65993 - DNA, 721 bp, Heterodera glycines
  Genomic contig location: Contig_ID=SeqID_36749; Location=1..721; Strand=-
  SCN-specific regions: Sequence locations=1-192,216-358,380-721
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatatatccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccatttggggtactcaaacatttatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaa

SEQ ID NO: 65994 - DNA, 851 bp, Heterodera glycines
  misc_feature (748)..(748): n is a, c, g, or t
  Genomic contig location: Contig_ID=SeqID_36750; Location=522..1372; Strand=-
  SCN-specific regions: Sequence locations=1-315,338-572,594-851
atggcattgctttccgaccgtttcgatgttttggttgacacgcattttgatggaaaaagcgaattgacaatttggaaagcaatcgcaattcgcaaggacaaaggaccaaaaccgaaactgtctgtacagatcgatgacaaatttgtggattttcctctgccggaccattcgctgcccagcaaaattcgctttaaggagcttcggattaagtaaatcaaaaactatacagaaaccaattaatatggttggtcgtcgtcttcattgttcccccttttcagctacattgaccattctgtgctcacatttatccgttcaaacaagccaatttgggacagaagaggcaccaaattggatttggatgtgccttcagacaacccaactgatgtccagccaatttgggatgtttttgtccgtcaaatttggcccatttttgcgacaaacattcgccagttgggcttcgaagatggcaatcatttggacaatttgcttcgtcgcacttcgccgacacttctcactgatcttgatcaattgatttcaatcgattgcggttatctgtgccccgatggaattgctgacgatgggccaaatggaattgctgatcaagcgttgaccaaatggcttcacactccgacaaaaaatgggcaaccgaagcgattgtatcgctataattattttggtccacagaatctcgaatgggtcaacaacttcaaagaggtggcccgccatatttttttattaatctctttgnttggatcaatggcaactcgtacaaaaaaaaatttttctaagaattttcaactaaaacttagtatttttagataaaaaaatctaaaatggattttctagcctag

SEQ ID NO: 65995 - DNA, 364 bp, Heterodera glycines
  Genomic contig location: Contig_ID=SeqID_7794; Location=503..866; Strand=+
  SCN-specific regions: Sequence locations=1-364
atgcgtacgttgatcgcctctctcagcaccgacaaattggtcaatttactaaacattgaatacgcgccggaaggcacggacaaacagctgacgccgctgatgctcgccacggtgttgggggacgcgcaaatggcccaaatttttgtgagttaattcaatggcattctccgctgatttatgcactgattcaatgctattgtcagcaaaaaaaaaaattcaaatgttcaaaatttaaaaaaaaatccgttttttatttcagctggagaaaggggccgacccccacagaatgtgcctaaagaaaatcaacaccgatgacaatttaatcagtgaattgagagaggaaggcgaaaaaatggacaaatga

SEQ ID NO: 65996 - DNA, 1563 bp, Heterodera glycines
  Genomic contig location: Contig_ID=SeqID_7795; Location=1352..2914; Strand=+
  SCN-specific regions: Sequence locations=1-21,43-96,118-124,146 -203,225-240,262-905,927-982,1004-1393,1415-1563
atggcggcacttcagcaggtaattttgatgtttaaatttgaatgcttccaacttttaatataacacaccgagagtgcaccattttatagtcgttaccatcaatgtcaatttgatttgttcttcaaaatcattttcagttttatccaacaaaatccttttgattttctttgtatgtatcgaaaccttagcatgaggaatgaatgcttttgtctaaaatgaaatttcaaatattcggttttcaactgaattgagtgtcatctttggtctctcattgtcctcgctatctgtgcgatatttctttgacatgtctatcctttagttattttgtttctccattttcgttccttgacctatgctttcatagcggtgcttttggttctctcagttttcctgggcttttccttcggtttgttgtgctgcgactccaaaacatttcgccggataaagccaatgatctgaggacaaacacaagaggaaattgatcaaatgttttcttgttgttttttcatccagctgtccaaaatgaaaatgaaccaattcacacgcccttacgcataggaaatgctctgcttgccatgcccgggtgtgcctctgtcttcatgtgttacggcggttgctctacgcgtcaacgagtgccattaaccccaaatccgcttcaaccgcggcgaccctaccggtatgccaatgccaagcagtggggtccaacaacgaatgcttcttcctctggagcgatctatgaattgcttttgtcggttccaagcactgattgccgcgctagacggcttctcatcaacaattcattgtttttccatttcatcaccggcagtaaaatggcaaaaattggaagcgtcctctgccagttttggtaaaactgttgtcaaacaattctcaattaacgacacaaatcactcattcattcacccccacgaattgtcagacatattctaatcttgatttatcgccttttcataacttattcttcaatttcatttattttcaaaggtttttgagtgctaattgcttagaaaattcgggtttctcattaattattcaagcatcccgatttagaacattgtcgaacaactttttgaaaacgaaggtcacaggggtttccgtgtggttcttccccggatccacagcgactcggcgaggcttcacccgattttcacctctcatcatactctcgcaccttacaccaatccctccgctcaaaatgctcatcggttggtccattaattttcgaatttgatttctcttggtttgacaatcatatgaatagaggaattcttttcatttttaaaatgcatcacaaatttagcgatgaccttagttaaactctgttaacgccgatccaaacccttacaaaatcagtttttattaatcctttgttatgaaatacaaaattgaaatttccagagaattgctttggaaaaagcgatcaaccaggagaagagtccgtttatcactttgatctttttcaatttctacactgcgttttgctaaaaccgcttaaaaatgaaaacaccaaatcttcttcttttgtttgaatataattatattaaa

SEQ ID NO: 65997 - DNA, 610 bp, Heterodera glycines
  Genomic contig location: Contig_ID=SeqID_36755; Location=281..890; Strand=-
  SCN-specific regions: Sequence locations=1-35,58-62,87-100,143 -298,407-452,475-610
atgaaggagcagaaaatgaggtaaaaatgtgctgctgcatatattttagaacaaacattgacaatgaaaaagagaaaagaaagagacggggaaaggcgcgacgaaagaataaacgaacgaacgaacgaacgaacgaacgaacttcgttattttgttgtggcagcaatttcgcggtgattgtaatggaaaagggaaaatggcttgaggcaaagtcggaagccccacagggcaattacctgaagaaagacccttagaggacgaagggatgaacggaggaggatgagggaaggccttggaagaagggaagggaaggaaagggatggaagaatgattgatgaagaagggatgggactgaagtgatgatgagcgtagagggaggggggggggcagtggggtggggaaggaaccgaaatggaatacctaactcattttctccatcgggctagtcaaagactaacttttacaatcaaattttaaggcatgtataatttgagtaatatagcaaaaggcatactttttactggtctgaacaaaaaaatgccgaaacacgtcaacagagattgactatctaatttaagatttttactcacttttcttaaaaattaataaa

SEQ ID NO: 65998 - DNA, 872 bp, Heterodera glycines
  Genomic contig location: Contig_ID=SeqID_36756; Location=266..1137; Strand=-
  SCN-specific regions: Sequence locations=1-139,166-516,538-590,633 -678,701-836,858-872
atgttcaacgatgaccaggcaacatttgtgttcatgaacccggcacacagtcaggagcagttggtggccgagcgggacctggtcaaggaaatgctgcagcaggcgttggttcgacatcgtcagcttgtcaaccaggcatattcattcatttttatatttttttttgggggggggggaattgtcggagccatggacagcaaaatttgtaaatttttggactggtatgtctgaaaattttttataccgcattttgtattcataatttgagaattcgctgaaaaattggtaaatcaaccgagtgatccatggagaaatccactaaaaatttgatagtcatcttaaaggaaaaatcacgaaaatataaattccattgactggggaagagacctaaaaaaaatccaaaatccaactaaattccatggaccagaaaagtgtgactcggttcattatttcgattttgtctggttttcttgggattcaaataggaaatttaccgaaaaatagtagatgaacctaaaataaataaaatttaatccttacgcaatctgttatttatgaaaattatttttccaaattttttttcggagtttaaaaattacgaaagggaatggcaataacaaagaaaaactaagaatttccagcagtgaacccatgacaaattaatggattttttcatggattaaaaaaaaattttttttttgaagatggcccaacagtcggccaagggcggctcggagcgcgagcgggaggccaagcagcaaattctgcaacaaaatgcgcatttgttggacatgtacaagcatttggtggcctccaaactgatcactccgtccgacttttggtccttccattataaaacggtaacaaataaa

SEQ ID NO: 65999 - DNA, 237 bp, Heterodera glycines
  Genomic contig location: Contig_ID=SeqID_36758; Location=13..249; Strand=-
  SCN-specific regions: Sequence locations=1-237
atgtcttctgctcgcaacgaacttcaggcaaaagccaccgaaatggcaatgcgcatcaacaatgcgaaggcggtgaaggaggagcgaaagcgcatggcgtcaacaaaaccggaaagcctggtacgacgccgctggaggcttcggtcaagcgggtcaacgacgacatctccggcagaaatttggccaaggctcactcgcctagcccgcaaaagctggcgcgttcgaagaccatgttaa

SEQ ID NO: 66000 - DNA, 548 bp, Heterodera glycines
  Genomic contig location: Contig_ID=SeqID_36760; Location=1..548; Strand=-
  SCN-specific regions: Sequence locations=1-191,215-548
tatttacatcattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaatcatttatggggagcaaaaatccaacgcagaattaaagtacaggctatagggaagctattcccgaaggaattcggtctccccataaaatctgggcgcatcggtgcggggggactgccccgaaaacaaaaaaatcgatttttttctagtgtccgtttggggtactcaaacaattatggggagcaaaaatc

SEQ ID NO: 66001 - DNA, 768 bp, Heterodera glycines
  Genomic contig location: Contig_ID=SeqID_36761; Location=808..1575; Strand=+
  SCN-specific regions: Sequence locations=1-567,589-768
atggaaccccgaaaacgatcctctaacttttccattgatcatattctctccgcgcccaaaaagccccgtcaaggcttcctgatcaatgaactcttgggtgtcgtacacttccttggatcggtgcagcaaggcgaaggaacatcaaaagaggcaaaggactacgttaaaaaattggacaacagcatcgagcacatggccaaattccactacgtcaaagtcaagtcaaagttcaccattacggatttgccgagcacacctgaggcactgttggctgggattttccaacactgcatcgacgaagcaattgttgaaagccgtgagcgcaacatcgaacctacacacctcggctgtatgatcagcagtcctatgttggaaggcggagatatcccaatcccgatacgacaaatgacaaacaacactctcgacaccattctcaaccagttcaaaaaagtggcgcagtccaaacaacagaaaaatgtatcgttatggggtgagccgtttaccgtcaccatcacgactctcgaccgtaatggactaccatccaaacgtcgtgtcaaagggggagctcgtcgccctgtcaaaacggccgttcaccaccgaattaatgaccaatgcctgattaaaattcgtaataacgacaaccacttctgccttttctacgcgctgcaggcaacaatggtcgacaaaacatgcaattggacacgatggaagtttttggactacttgcacgacagacacgaaaagcagggacaactccatcatgatact

SEQ ID NO: 66002 - DNA, 141 bp, Heterodera glycines
  Genomic contig location: Contig_ID=SeqID_7797; Location=831..971; Strand=+
  SCN-specific regions: Sequence locations=1-141
atggctacggaaataatggcactttttggcttaacggattcggcctggttggacagtcggcatttcacgaggcgatgttgtcggatcggcgttaatttgttcacttgtcggatgattttcacaaaactggacagcgaatgg

SEQ ID NO: 66003 - DNA, 1962 bp, Heterodera glycines
  Genomic contig location: Contig_ID=SeqID_7798; Location=569..2530; Strand=-
  SCN-specific regions: Sequence locations=1-101,123-270,293-346,376 -595,618-745,767-856,880-894,916-954,976-1034,1056-1082,1104 -1378,1400-1445,1482-1594,1617-1637,1659-1962
atgttttatgctcgccattttgtctctcttgtgctcattttggcattgtccatcgatggtgtgaacggtggaccaaaaagagagaaaggtaacgaacggggttaattatgatttgaaaataaaagggatttgaatatattcctttgagttttttctttttaaaatcaaaggtaagaaaccgacgtctcaaacaatttttcattgcaacgaggctaattacagagaaacagtccaacaacttaccggtgggttttataaataagccatcaatttaaaatttcatttaattaattgttaagtatatgaaatttggtacaatgtcaaaaggacgaacaattaattgtcaattgtataaaaaataaataatagttttttgcacttttaagtttttttttaatatgtttgaagtttaaaggaagggttccattaggccgggaggagaaaaggcaaatcaatgaatgggaatttaaattaatagaatttcaatttgaaagatatttgagttggagaatcgaaatttctcgagattgagactcttctgactgttgtacataaattagaaacttttaattgcgttttggaggaaaatgagggcaaaattaaattttgatttaaattgagtaaaaatttttcaggaagaaccggaaacagtagcattggatcatccaatttatcagccaatccgtttcactatggccaacagcctacggataacaggcagtctatgccatcatcaggtaaagcaataaattagaattaaatttgaatgacatttgagtctcgggattgggacggattggcgtggatttgtggaaggaattgagaagatgtatgaaaagatttgacaggaaacgcacattttcaagaaattttctttttcttactgtaaattttctgaaacacaaaagactcattaatttttgagtaataaaatatgagcactttatatccgacaaatttattatattaattattgttttaggttcatattggcgagacttgatcagccaagtcgaaggatctgcagcaggaaacgcgttcaattcatcatcaaatttcgccgcaccacagccaccaacaggtaaaaagcaatgaatttaatattaaagtcggtggcacttcgtcgctttggcgatttttaaaaatgcccaaattttggcaaaaatttaaaaaagataatatgaattttatgtgttatggctgctgcactatttcaggccaatcgtctgtatccttcaattcattgccaaattctgccttcatttcgtttaactccaacaattcacaatcatcacaacaaggtgaacagagttggaacattggaaataaatataattctaaaataagtgaatttaacaatcattcgaaatttaatttttgtgtgttacacttttataattttcctattaataattcaaaatgagcaaccatggggtcatttcttcaaaatttattattattaactaataattattaattatgattaaggtggaaatcagcaagacgaagtgttggatgttgagccaataaacaccttttatccatccgccggtggccatggctttgctcaaggccgttcttcaaaaggatctaaaagaaaaggaggaagacattgagaaaccatcggacgctaaacggaggaggaaaaagaaagtttcgggaattggcatttgacaatttggcattttccatttggctttttttctgtgatttggcattttggtaaatttgcttttgctggattcggttattttaggttatttaaccaagagatcttggagtggctaacaatacgacatccatttgctacaattatgattaatgttagaaaattgcgctgaaaatcattcacactaaccacactaatttacgccttggttagattggcgccgttttgtcgccaaaaatttcttaaattcctcttcagattttaacatgacaattcgagagaatctgaataaa

SEQ ID NO: 66004 - DNA, 723 bp, Heterodera glycines
  Genomic contig location: Contig_ID=SeqID_7798; Location=4180..4902; Strand=-
  SCN-specific regions: Sequence locations=1-132,157-182,232-446,473 -598,620-723
atgtgtgcccgtgttgggtgagttggacttgcgtttacaaaaagcgcaaaatttgaaaatgccaaaaatggtcatggaaagggttgtgtcttgccgactgagttccggcaatttttttaacggagcaaaatgaaatttttgaaaattttatatcatttaaaaatcgttgaatattaagaagctattattataaattattggttaattgattaaacaattttaaaaattattgtacaacttttctagctcagtaacatccaatttgaaccatttcattttaataagtgttattggattagctgattggaatgttaagtgatttgttggatttgatttaatttaaaaacacgtcatcattggacgaaccaaaaatccgatttgtaggcttaacccattattttctcgattaatttaatttctaaatttctggctttatgattgcattttatcaaaaattaaatgacatttcagaaagaaatccgatcactggcgaggtgaagatgccgaagaaaatcacaatgtgattgagtttttgacagcaaattccaaggatatgattttaaggaaatccgtccgccatttctatgctttttgatcgcttccattaattatataattaccaattttcatttgccattaacaaacaaatccatcttctgtctgtctaaatcgaaacttgtaatacaaaaaaaatcatattgtgaaaaatgccattttaataaa

SEQ ID NO: 66005 - DNA, 652 bp, Heterodera glycines
  Genomic contig location: Contig_ID=SeqID_36762; Location=875..1526; Strand=-
  SCN-specific regions: Sequence locations=1-312,335-524,562-652
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 66006 - DNA, 310 bp, Heterodera glycines
  Genomic contig location: Contig_ID=SeqID_36763; Location=19..328; Strand=-
  SCN-specific regions: Sequence locations=1-76,102-262,291-310
atgtcaaacaatccgctgcagcctaccacgagtttgactgacacaaacgaattacatctgctcgaaatgctgacatttgaggaggaagaggaggaggcaagccagggaagaataattgcttcggcaagccaaaacgaagatcaaactaggaatctttctagggaaacttgtactaatgaattcggtgtaaaatcagttgcttcggcaagcaaaatagaaggggaatgcacgggtcttatggaaggaaacggggcaggaaacagtgaaacaaataaaaatataaatgaaaatattgcttcggcaagccaaa

SEQ ID NO: 66007 - DNA, 155 bp, Heterodera glycines
  Genomic contig location: Contig_ID=SeqID_36765; Location=90..244; Strand=-
  SCN-specific regions: Sequence locations=1-52,74-155
gaattggaggattgtctagagggcccagcacagtatttcaacgacataagccgaagaagcagcagcagaagcgccaacgacgacgacgagcaggacgaggaaatggcaaaaatgcgggcactgaacgaagtgtgccggcaaagggcggaggcgca

SEQ ID NO: 66008 - DNA, 564 bp, Heterodera glycines
  Genomic contig location: Contig_ID=SeqID_36766; Location=584..1147; Strand=-
  SCN-specific regions: Sequence locations=1-297,319-564
atgatcaatttatggaaactttttggcaccggatttcgatttacggaaatttcggggcctcggattccaatgatcaatttatggaaactttttggctccggatttcgatttacggaaattttggggacttcggattccaatgatcaatttatggaaatttttggcaccagatttcgattaacggaaattttggggccgcggattccaatgatcaatttatggaaaatttttggaacaggatttcgatttacggaaatttgggggcctgggattccaatgatcaatttatggaaaatttttggaacaggatttagatttacggaaattttggggcctcggattccaatgaacaatttatggaaatttttggcaccagatttcgatttacggaaatttgggggcctcggattccaattacaatttatggaaaatttttggaacgggatttcgatttacggaaatttgggggcctcggattccaattacaatttatggaaaatttttggaacaggatttcgatttacggaaattttggggcctcggattccaatgatcaatttatag

SEQ ID NO: 66009 - DNA, 454 bp, Heterodera glycines
  Genomic contig location: Contig_ID=SeqID_36767; Location=42..495; Strand=-
  SCN-specific regions: Sequence locations=1-37,101-140,169-454
atgattttgaaaaaagaaaagaaaacaaaaagccataaagaaaacgaagaagaagaggaagaagaagaagaggaagaaagtagcagcagtagcagtagtaatgaagtttctgatcagcagagtaacgacggtaaactttcaaaaataaaatatatttataaataaaaagggagtgatgcgcaaagcgggcctaatgagtatggccaactgcgtctgaacaaccttaagcagtgccataacaagtgctacgatttatagttgctaaaaactgccaaaatacttagttaatttttagtttcaaaaaataaccccaaaatagatgctaaaaatgggaaaatagttgctaaaaacattcaaattttggggtataatatcgtaaaattttatcaaaaaagggtacaaaattaagtcaaaccagtattgagataaataatcacaaattcttgtcaataaa

SEQ ID NO: 66010 - DNA, 332 bp, Heterodera glycines
  Genomic contig location: Contig_ID=SeqID_36771; Location=141..472; Strand=+
  SCN-specific regions: Sequence locations=1-217,239-332
atgaccactaactttctcattgtccttcaaactcttgactcaaaatcttcaaataaaggtgcccagacatcaattctgtccgagagttgtgctcgacgctgtgacattttgaaatacgtggaccgccgttaccgagtgcaggcccatgggattggcgggtcgcaaaagatggtagggaggtatgttaacggtccctgaacatcccaaagggagtaagaatattaatggttgggtagttttccagaatcttcgcctgtcaagtgcaggtcgatgacaatgtttttgcgtgtccctttgaagtgatgagcgacagagacgtcgacattttgtga

SEQ ID NO: 66011 - DNA, 2526 bp, Heterodera glycines
  misc_feature (2427)..(2427): n is a, c, g, or t
  Genomic contig location: Contig_ID=SeqID_7800; Location=1133..3658; Strand=+
  SCN-specific regions: Sequence locations=1-199,221-827,851-1135,1158 -1195,1217-1502,1524-1572,1670-1950,1972-1989,2012-2056,2081 -2249,2271-2526
atgagtgtaatgcctaataacgaccagcagaagcagaatttggacaccaaaacatctcaggtgaagaggacatttagtgatttaaacaacaccttatttatgggtgtaaagtctgttggccagggatagggagacctgaaaacaatgacgttcaaaaactcgaagtgatagaaaagtgatttaaaaaaaacaaattttaggaaaacggccaattgtcagattcacacgaaacggcagttataaaagcgccgagtggagggaacagaaaagtgccaaagaactgctggaagaaggttaacattgacttggagtacaacacgagcagagaaatttcgaggaggcgacagttggcatggcgtggcgaaagacgcggcggcgaaacgtacggacggagggatcagccgaaagagcagaggaagggaagcgcaagagtggcggaagaaagcagcgccaggaaagacgaagcagccgaaaagagggacagaaacgaggcacaaaaagagacggcaggggaagcggaagacggacgagcggagggaggaggagacgaagagacggcacggaagaggacgacggccccgacaggcggcacaaagacgaagaacggaccgaatgaggacggggcggagacaggcacggaccaacaacagcaacagtcgagggactactggtaatggcagacggggaaacggcacggcatttggagggggggggggtgaaatctgaaatatgccatgggagacacggcaatggtagaaaattgaatattataagagcatttgtgcacttctcatccatttcgcatttattctttaaagttatttgacttattctgttattttatctgtttcccatgtgcgtcttcataaaggctggtgatttttattttcactgatcattggtctgctcactgatagataatcattcatttgattggtgaactcttaaagggattaggccagctctattaaatgtcatccataggtcttttttaaacctggaatgtcaaataagaaattccctgtaattcatttacgtaataaattcccataaaacatttcgtttttgaccagagagatccaaaatgccctttgcaattttatttttctcatttcgtttcattgggtttctctgctccttcagttcatgtttttgtttatgatcggacttcgcttacaatttgagactaaatccgattcttcatttgtttacattacatcttgtcctcaagaatttaatcatacctgctaaatcagaaacaaaatgcaatgtaatgagaatatttcctaattttgacaatcctcactcgtattccttctgttcctaaaaagggacggagagcagaaaagaatcccttcccagaatgggatgtaaaatccaacgattcacaaaattcactgattcatttcttccttataaaaataaatgttatgtatttttgccttgtattatttactgatctttttgcactgtcaaattgtttatttgtcatttagtgcctcaccactccctcacttcactgtttttatgcttttacagtttcacctccttagaaaggatttatcatcgcaattcctttcccattcgctgccttttctctagtgtcctactattttcatttccttttttctttcccttgctctttcatcccctttctctgtttctcttttatgagtgcctttccacaattcgttctccactgttgtgtaataataaccacatctgtcccaccctcttttagggtctgttggtcaaaatttacttatacctatttaattttgcattgcttttctcattttttctaaatgctgattgtgattgaatatgggcggtcggggtggcaatgattttgattttgctgctgatcagagtgttttgtcttgtctgtattgatatgttatgatttgatttgctgtttcgcacctctcttaagcaccagcggtgctcccaaaataaataaatacacaaaaatttcaatttattttccaatcttttctctctttcccttctcataaactcgtccatttcttatttattccatccgttttactctcacacatttcttttccattttttcattccaacgttagtcttctcccaacatttacactttctgtccatccgtcgctctttcttttccttcgttcttttgcttttctgtttcttttcccattctttaccattgacacttcgtcctctcttccgtcctctcctctttttcgcgtgtgttcacagttactcctccaacaaccagacaattcattatgcactgtgccgctccactccttcctccccctctaaaatgccttaccacgccttcccttttagaaaacacaattaaataacaattcattgtttcattgacttaatagaaaaaaaaacaacaacaaaagtcggctaatgtctaaattttttttataggtactntgatgaaatgtccaacggatattattaccaacactcgggatcgcatggatggaaaaagacgggcacggaccaaccacaacaacagcccagggactattg

SEQ ID NO: 66012 - DNA, 647 bp, Heterodera glycines
  Genomic contig location: Contig_ID=SeqID_36773; Location=1..647; Strand=-
  SCN-specific regions: Sequence locations=1-205,360-391,414-647
cggcgggtcagactccgttggcgagtcagtgccatccgccgcaaattccgcgccgaaactcatttcaattgatcacaatcagaaatattgttgagggactgcgcaatgcatcagagcctatttcaacctcacaggaaaagctgagcagatatccgtgcgaagatgaagcaaaggtggacacaagggaagaagtaatcggtggtcggggagagagggaaggggtaaggggaagagagtgatcggagagagagagggaagggggagagactgatcggatgggagagggtagaaagggaagagagtgatcgaatgggcgagaatggtgtagaaggggtaaggaatgagagaggaaagggaagtaacgcggtaaaataatgatcggagatagagggaaaggaaagagagtgagcgggtgatcggataggcgcgaatggggtagagggggtaatggattaatctgagggtgtagtaatgtggggaaaaaagtgatcggtcagagaggcaaggggtaagggggaagagagtgatcggagagagaacgtgaaaattttattcccgaagggggctgacactaatgccgtgactgccattgcctaatgattggctaaccaaattcgtcacttcagacactgctttgctgtgcactg

SEQ ID NO: 66013 - DNA, 63 bp, Heterodera glycines
  Genomic contig location: Contig_ID=SeqID_36775; Location=40..102; Strand=-
  SCN-specific regions: Sequence locations=1-63
tctctattaatcccgcagtctctaattatcccccagtctacgaggtgttttaaaaaataatcc

SEQ ID NO: 66014 - DNA, 728 bp, Heterodera glycines
  Genomic contig location: Contig_ID=SeqID_36781; Location=127..854; Strand=+
  SCN-specific regions: Sequence locations=1-614,637-728
catttcaatcactggcactcaacccaccagcatttcaatcactgggactcaacccaccaacatttcaatcactggtactcaacccaacagcattccaatcactgggactaaacccaccagcatttcaatcactggcactcaacccaccagcatttcaatcactgggactcaattctgcatttcaatcactgggactcaacccacctgcatttcaatcactgggactcaacccaccagcatttcaatcactgggactcaatccaccaacatttcaatcactggtactcaacccaacagcattccaatcactgggactaaacccaacagcattccaatcactgggactcaattctcctgcatttcaatcactggaacccaaatcattccaatcactggcactcaacccaccagcatttcaatcactgggactcaacccaccaacatttcaatcactgggactcaacccaacagcatttcaatcactgggactaaacccaacagcattccaatcactgggactcaacccacctgcatttcaatcactgggactcaacccaccagcatttcaatcactggcactcaacccaccagcatttcaatcactggcactcaacccaccagcattccaatcactgggactaaacccactagcatttcaatcactgggactcaacccaccagcatttcaatcactgggactcaacccaccagcatttcaatcactgtga

SEQ ID NO: 66015 - DNA, 1369 bp, Heterodera glycines
  Genomic contig location: Contig_ID=SeqID_7803; Location=1032..2400; Strand=+
  SCN-specific regions: Sequence locations=1-93,116-293,315-455,478 -649,671-744,768-858,880-1083,1119-1369
atggttcttcactcggtaagaattaacggttgaaagttgttcttaaaatatctcgcactaatgggttgtgcctctcctaaattatagcacagcaatttttttaatttataatattgtttagtaagtatcttcaatttttactcggtctcgaaatttccactctcgagcggactttccgtttaaaattaaaaaaagcctggcatcatgcaaaagcccaagtgttatttattagcctacaattttttttagaaaagctgaggctagaaaacatgattccaaaaaacccttataaggatatcaggaaatgtaaaaatttggtgcttcaaaatttcttttttttgtccataagcgtcccaaggtgaggtgaatttacgaaatgtcccggcacggattgtgccattggcgctgtgtcataatttttctgctgaattttcctccgatcactttttttccagcaactccgtggcgtacacattgcgaaattggcgtggcccccgaggggtgtccagtcgccctatctgagcaaagcaatggccgcgatcgaagagaaccgcagtctgtcgctgtatgcgttggcggtcggcaccgcacttgcggccgccctttggttcggtcgcggccgaacgtctccgcccccgggcaaccgtttcctggcggagcccagcgcggacagtctgctcacctgactgatcagtgatcaccagggccgttgggggactgatcggagtgcggaatcgttcattttgatcacttcttttgatcattttgttgtgatcgacgaacgcaataattgatggatgctttaacaacctttgtttataattttctcagtaaagaattttaacatatttttgtttgaatatatttagggttggtaggggccggaagagtcccaaaatgccggccgatggaagaagccgactttgtgagcgaggaatgagcccaacaacggcgggagcccgtaaccgtcacccgtttttaaattccaaaatagcttttttggatttgagaatacaaggaaatatatttcttaagaattacataatttcattttttcgctttcattcatgaaggctatgtgttgaatccccttttgacaaaatcatttatttaatttaatgatcaattttcacttatttattttgtacaacttttcttctctctccaccgatttcctctcccatcctaaccaatcgttacactttactgtaaacccaagccaagccaatttgtgtccatcccagctcactctcgactccaccccttttctcttttgctatttaaactgaattcattccttgcattattacccttttttttactcactttgactcattcccattttacttgcctttctcacttttgctaa

SEQ ID NO: 66016 - DNA, 534 bp, Heterodera glycines
  Genomic contig location: Contig_ID=SeqID_36784; Location=622..1155; Strand=-
  SCN-specific regions: Sequence locations=1-205,246-534
  Gene Ontology: Mol. function=rRNA primary transcript binding; Cellular component=nucleolus; Biological process=35S primary transcript processing
gcgaatctcaaggagcttacgcagctgttttccgcatttggtgaactcaacttcatccgattaccaaaaaaggtaaattcagcaaaataaaagggaaggcaaaagtgagaatttttggtttcggagaattattatgtgcctttttggactgtggcacaattggctagaaaccaaatattttggaatatccaaggcatacacttggatatttttaaatctaaatattttacaatattatttttattcagcctggctccgaaggccaccgcggcttttgtttcgccgaatttctctccgtgagcgacgcgcaccgcgccatggacgcgctggtgcattccacgcatttgtacggtcgacggttggtgttggagtgggccaaaccgagcgaagaaagcgcggaggagaagcgacagcgaacgcaggacagaatggcaatggccgcgggcgttgccggggcgaagaaaaggccgaagatgcgatcattttagagccagtttcaagaattggcactttttaaccgttaattacattaaa

SEQ ID NO: 66017 - DNA, 56 bp, Heterodera glycines
  Genomic contig location: Contig_ID=SeqID_36787; Location=77..132; Strand=+
  SCN-specific regions: Sequence locations=1-56
gctatagtgaagctattccggaaggattcggtctccccataaatctgggcgcatcg

SEQ ID NO: 66018 - DNA, 230 bp, Heterodera glycines
  Genomic contig location: Contig_ID=SeqID_36790; Location=274..503; Strand=-
  SCN-specific regions: Sequence locations=1-53,81-105,127-230
atgcattctttcaagctttttgcatcgctctttcttgtactttgtgtggtaggttttaaattttttaaaaataattttttcccattttattgaattatcttttgttttttaggtttcacttgtcatctgccaggacaagccagcagcagtaaaacgggggcatcttcttaattagaacaattagttaacctaaagaaaaaccaaaaacactgatcaaaaacaaaaataaa

SEQ ID NO: 66019 - DNA, 1237 bp, Heterodera glycines
  misc_feature (1021)..(1021): n is a, c, g, or t
  Genomic contig location: Contig_ID=SeqID_7804; Location=23..1259; Strand=-
  SCN-specific regions: Sequence locations=1-44,80-121,168-227,256 -320,344-407,429-848,872-957,984-1237
atgaaattttccattaactcatttgcaaaagttgaaaatgtaacattaaatttttttaaattttataattttaattattgactattgaatgctgccacgataaaatttgttgtcatatgccaaaatataattttaaaaaaataaaaataacaaaaacattatttaaaccaccagtaaaaatgctcaattatttaataaacaataaattaagggttttaattgtctgcaattaaattttaaaaaatttaaaatttactccagtggctgcattatcatgttgtctttgtttgcagcttctcccattttattgaccattggacaaagactgaaaatggacaccaaattttatgaagaaaaaaaaaattggaatttttgtgccaatattcattaagaataaaagtgtggcattttaaattaaatccaaatttaccgctccatcaacaaagcattgtacgcaaagctgcctttaccatctttcaatttcacgtccaattgtctaaacaaatggaaaaagttgtggagaaatttttttgaaaataataagcaattttttttcgattacaaaaaaaatgtatttttaattgtaaacatcaacactttgtgaaaaattgtgatcaatttgctaggtcaagaaaacccgagattgggcgcccagcagtactgacttttcaacgtacaattagactgtgatttagacgatttaaaattgggcatgaattttcatttaaaaaatcgtgtcagtgaaagtcagaaaaaaaatattcatttcgttttaagtttgataaaaaaaagtttatggccaaaaaatgcagaaaaaatttttggtcctaaaattggttccacaaatgaattttttctttcataaataaattgtcaaaaaggggagcccacttgtattggtgccaataagcgtcacaatcggtcgtgggaaggaaaccctaaaagaaaatagaaatcaaattaaattaattttaatttattttcaggttacagctttgacgtatcgaatgatcgaaatgtntcacgttggagttcctttccgctggggttctcacacgagatgcatccgtccagcaacagcagcaccatgtctgacgaacgagcgagggaacgcggagcattaagcattttttattcgggtttaaggcccccccccccctcccataattacggggattacgggttttcatgctgggtgatttcgtgcaagctgtcattttattattttttcaataaa

SEQ ID NO: 66020 - DNA, 571 bp, Heterodera glycines
  Genomic contig location: Contig_ID=SeqID_7804; Location=1893..2463; Strand=+
  SCN-specific regions: Sequence locations=1-202,232-354,415-456,485-571
atggataccagattcgtggtaagtgcccccgaaaacgcaaggaacttgtttttatgacaataaaattttcactgacgcattttccactgacgcattttccactgacgcattttccgggcgcctttttgactcccaaaatttctaatgtaccacttttcctttttaaaaaaaaatctctcctcatacatttttttagcaatgctttaatttattttttcaattaaaaataatgctttcaaaacaaaagcagttttttaatttttcctagtttttagataagtttttgagctatttggttttttgggggagggtctatttttggcgtttttgatctaaattcttctcattttttttaaaattacatttcaacaaaatttattttggagaaatttttattacatttaataaaaaaaagaattggtcggcataaataaagtcaacaaactaactttgtcgaaaaattttcaaaaatattaatatttaagttttttcccgatttcagatcagactccaccttccgaccatcgacaaatttgagaaaaactttatgattaatgaccatgtcatgcag

SEQ ID NO: 66021 - DNA, 1770 bp, Heterodera glycines
  Genomic contig location: Contig_ID=SeqID_7805; Location=1264..3033; Strand=-
  SCN-specific regions: Sequence locations=1-40,62-66,88-286,308 -429,451-815,838-909,933-1176,1198-1287,1316-1459,1490-1720,1742-1770
atgattaaaaaaaacttgtccttgactgttttcaaacatgataaaaaaaattttaaattttgcttcgaaacaaaaaagctcaagggctatcgaatacagtacgagttggcctagtacttgtacgagtttgccttctttgttcgagcccataacctttttagctcaatttacgccgaccaactcaatggggcactgcccgaacttgtcaagctgtactttaatgatgccccaccgaacactaatcgacgcacgttgaccatgcaaatgtgtgtggtgacgaattgcgagccgaagaattgttgtaaattgaccgtttgttatgtgggacaaatgaatcccgccaatgggccgctcaattctcgatttgaattggaaaattttgaaaagagtgaaattgcggaaaaatgccgcaaggcacaaaagaaatcttggccccaatttggtgacaaagttcttcatggatttgaactttcttattattacgtgaacaaatcgttgatggtctccacttcgtttaacccgataaggtgattgtcgagattaatttcaatagttaattgacagagattagtagtgtaacaccaccgttaattatccatgacgagtaataattttttttgcctcagcaattccaaaaataaatagaatttttgtaattaaagaattcgtagttaattgtaattttgttcctaaacgttataaggcaaaaaaaaataggttttttttggatacatcactttctacaatatttttcaaatgtaactgtcggatatgtgtcagatttttcgcatccgaagatttaagccttattttggtttttttttttaaaaaaaaattgacggcaagtgtacggaccgtgaaaattcctttatccaaatttggttgtgcttaagtcaatactttgcattcaacgaaagcaatgtcacaaaatgcatcgatgtgattcttggcgagaatggatatttggatggatatgttcaaggcgagcgaaaacagttgcacgagacatacaaagtgaggcaaatgcacaccgcactgctgagcatggagaatggcatcaccgcattggcatacgactttttggccggcattccccaggggggcgcgttcggcatcatcggagacggcggcgcagtgggcgcagcttcatggattactttggcaagcgtattttaagaataatttaatgttattaatttccggtttatgtcgcattttatggagctgaaggatctaattctcttaaaaagagttgccagtccataatactcaatggttgtggttgtgttaattttaaaaaatttatagaataatactaacttttttttcctaacaatttgttatttttttggaaatatttcgacttggcgctatcggcacgaagacccgctcccccattatttttttgaaaaagtacggcaaaaaaaaacacattttcgagttaatagatgacaattacaaaaaaattttgattattaaatttttatttgcataactatttataattgagttttaacttaaaaatcgattaaaatttgttttgttttttttgcgattttaaagttttaataacaaacttgaaaacattggtccgatcaattcaaaattgctgatcactgtttagggttcttttttgtcccaatttactcaaaaaataaatgaaaaacttttttagaagggcgatgggctgtacaaatgcaagggcaaacagtgcaaggacagcatgccaaaataaatgaacggaactctttaaaagtctaattgaataaa

SEQ ID NO: 66022 - DNA, 49 bp, Heterodera glycines
  Genomic contig location: Contig_ID=SeqID_36798; Location=25..73; Strand=-
  SCN-specific regions: Sequence locations=1-49
ggaagctattccggaaggattcggtctccccattaatctgggcgcatcg

SEQ ID NO: 66023 - DNA, 778 bp, Heterodera glycines
  Genomic contig location: Contig_ID=SeqID_7806; Location=551..1328; Strand=-
  SCN-specific regions: Sequence locations=1-54,77-130,173-206,228-778
atggacgcaattcttgcaaccgattggctccacaatgcgttcccagagcgaaagacaacaacaacaacaacaacaatttctagtgtggaagaagaattagacgatgccgtcaaagcagtgagttttacacaaaaataaatttaaaaaaataaaataaatgaataaataaaatcaaggaagagcaaatcagttggcttaaaattatcgaagaggaggaggagcgaggaaatgaattgcaaactggtgaaatggaagtggaacgagcgaaaggtttggttgtttacaagaaaaaaatgaaaaaaaatttagagattgagccgccaaagcgacaacacttacagtccaagtgtagctgtaacgaaaagcaaaagagtgtcccgctgattgactttctctgccaacactacaaatgttctgttaaagagcttcacgttctgcttcagacgctgaacaaacgtcgcgaaatttcggaaatgttgcgctctcagcttcagttacgcaccaatcatctgcgtcctgcctggaaaaattttcgcgtccattgcaacgaactgacaattcatcctgctcaaactgcatatgccatgcgcggttatcttggcattacggttttttaatttaaatttatcagctcctcaattgtatagatatacattgtttttaggtccgtatttactactatgtgaagcatggcgtaaagctcgtttatcctcagcttccctgtgttcttcaatttggcggtggtgccattgttctctgtttccgcttgagtgtctga

SEQ ID NO: 66024 - DNA, 1667 bp, Heterodera glycines
  Genomic contig location: Contig_ID=SeqID_7807; Location=534..2200; Strand=+
  SCN-specific regions: Sequence locations=1-288,311-435,478-592,614 -672,694-1667
atgcgtcatgcaatgcgaatgtttctcgtcccggaggacgtctttcagtcggtatttgttcaacaccacacaacagcagcagcagcagcagacggtgccgacggcacaccaattgggcttttgcgctcgcgcatccaacaaattgagcgcagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaattcagcaacgccgctgccgccgccgcaaacgatcaatcattcaacgccaaaaagattggagaaaaacattgtaccatcagcgtttgggttgaggaggcaaagacaccactacacacaaaaggctggggcattatcaaatcgcagacctgcccaaaaacaacaaagaaaagcagcagcagcagaaacaccaaacagcagtggaaatggagaaacggaaaaagaagaggggaatggagatgatggggaacagtgggacgacgcacaatcatcatcgtccacggcgtcaacaggtggtgccgcagcaaaaagagtgctcagagcaagagatggggaagcaggaaaaggaggaggagaaacggctgatcgccttcaaacaaaacacaactaccaaatgaccaaaaatgcactgatcacacatattcgaaaaaaggggcacagtctgggagtcagtgatcagggaaaggttttgcgcgcagatgggtccgagtttaaaacgagcaacgtggaggcaattgtcagccatttgttgaacagggacaagcgaagcgaattcaaaaggccgcctgtgggctataaggaatttgctgataaggctagagaggatccgttgctaaaaaagtatttgtttccggaacagcctctacaatttggcaaaggcctgactgactttaggcatggaaaaagacataaaaagaagtgcgaagggggaggagggaaaagtgtcttcaggttcaaaccgacactatggtgatagaccgaaagaaagaacagctgttggaccaactgtacaaagatgttaactcatcggtcagctttaccagcgttgagccgcttttgcgcgaggcgaaaaaggtgaacaatcaaatgagtagaaaggatgtagtggactatttggccacccaacgcacatacaccattcatagacaagcgaagaggcgctacaaacaactatcaacactcgcttctggactgcacaccgaatggcaagcagacctgtctgtctttgacaaattgtcgcgagagaatcacggctacaagtaccttcttgtctgcatcgacacattgagcagacagctctttgttgagccggtgaaaagcaaaaagagctccgacatggttgctgcttttgaacgcttgtttaaacgctccaaatacataccatggacattgttgaccgaccaagggctcgaatttaaggcaaaagaggttcaggaatatttcaaaagtaaaaacgtgaaaaactttttcatgtacacctcaccgcgaattcacgcagggatggcagaacgggccaaccgaaccatcaaagagcgactttatcgctatttcacggaacggggtacccaaaaatgggttgatgtgatacagcaaattgtgcatgga

SEQ ID NO: 66025 - DNA, 1604 bp, Heterodera glycines
  Genomic contig location: Contig_ID=SeqID_7807; Location=2791..4394; Strand=-
  SCN-specific regions: Sequence locations=1-113,135-248,311-558,603 -833,864-920,942-947,969-1181,1203-1267,1291-1303,1326-1604
atggagagccacacaacgcacaaactgccatctacgtatacagatgagcagttacttgctgagcagttacttgcgttcatagatctcaaatttggtaatttaagcagcttagagcaaaaataaaatgtttttaaggtggaataggtaacgaaattgctcatcatggaaacgagcaaggtgggaaaggtgatatgcgttcgattcgatctgcggcatacacatatgtaagttaccttttttgctctcactaaattattttctatataatttaaaattaataaaattaattatttaaaaaatttatataattgcgtcttctacctcgaaaaatttctgatttatcttctcgaaattttggtgtttcgaaaagcgaaatattggcaggccaaatgtcaattaactttcgataaaataaaaatttactttaggctcatatgccacaggatccagctttatttatctattttattttatcgcaaaatttatttatttttggtgcggtatctcgaatcgagcgtcgcccgaatcgccaaccaccgaaaaatttaaaattctgagtttttaatttttaatttaatcttatttactttttcatttaatttgagcagaaccctatctttagaatataaattcataatttttgaatttcttaggtggtgaagcagatatttggacttaaaaaaacgggactgtttgctcttccgactgtacttagcaccgatgttgagagccaaatgcaaaaaatcattacagaaagaaaatgtgcagtggttgctcgacttcaacaaccagaaatcaaagacaaaaccgagcaggtaataatttgtttattttgcgtgtggttaaaaacaaaaattttatttggtaaaatgaggcttctctaaaattgtgatcgccacgaggcgccatttagaaacaattcacatttgttctaaaatttttcttgtatcacaaaaataatgaatctaaaatgtaaatgtatccgttcaactctagctaaattttttgggctaggtctgtgcttaggctttattttgaaaatttataggcgctattgaacttcaaaattaaaaaaaattcaaactattccggttaatgattttattcaatattcagtgaattttaattattttattcgaaatccaacaaattttcagaaaaatgtattggcctttaaaagcttctgtaaaggtccatttttccatattttcgattcggttcaaaatcttgtttaaatgcaataatatatgattcgctaaacgctttctaaatattaattaattttttaatctctttagagttgaaaaaagataaatttttgattatagactccttgaaggaattgatttgactgaaaccactgatgaggactcgtcacaagaggtccgagtttaagtatataatcatatttctattaaatcacaggacgctaattaccatgaagaaataacctacgtgtttggactctgcgacaattatcaggtcaggttagagcaagcatgtaaaagttgcgtgaccggaaattgcgttagtggaaaatgcgtcagtgggaaatgcgtcagtagaaagaaaatgcgtcagtggtacaaattttttgaaataaa

SEQ ID NO: 66026 - DNA, 135 bp, Heterodera glycines
  Genomic contig location: Contig_ID=SeqID_36807; Location=491..625; Strand=-
  SCN-specific regions: Sequence locations=1-135
ggaactgctggcggtaacaatgcgaaagggccggctggtggcggagtccaactcggcgatttgttgcaacacccggaaatgcttcgtcagttggttggtcaagtgccggttgatagcagtgaggcgacaacgaag

SEQ ID NO: 66027 - DNA, 1144 bp, Heterodera glycines; identical to SEQ ID NO: 36808
  Genomic contig location: Contig_ID=SeqID_36808; Location=1..1144; Strand=+
  SCN-specific regions: Sequence locations=1-365,387-580,602-1144
  Gene Ontology: Mol. function=alpha-12-mannosyltransferase activity; Cellular component=membrane; Biological process=phosphate metabolism

SEQ ID NO: 66028 - DNA, 365 bp, Heterodera glycines
  Genomic contig location: Contig_ID=SeqID_36809; Location=84..448; Strand=-
  SCN-specific regions: Sequence locations=1-74,96-223,277-365
atggttaaaaaagctgaaaacaatttgaaaaaatttacaaacgaatgggatgaaatggtcaaaaaagcgatgttagaaggaaatttaaaattgaataaaatggtaaacataattattaatgagcccagcgaattaatgcagaaattgcatttcaaagagttgcaaaaatattttgaaaatgaattaaaaaatgatgaaaattttgcagaaatattggaaggtgattattaaaattaaatttattaataaatttattgaaaaattacaaatattttagatttgcataaaaataaaagcaatgagagagaaaatttattaaatttgttaatgaaaaatgacgcagaaaagtttatacttcaaataaa

SEQ ID NO: 66029 - DNA, 143 bp, Heterodera glycines
  Genomic contig location: Contig_ID=SeqID_36810; Location=464..606; Strand=+
  SCN-specific regions: Sequence locations=1-143
atgcccccgtccgctgatgggcacaggtcgttcgagatgacttgtggacgctgcccaacattacggggcagctgcctcacgagccatgcttttggggtgcttccatacgttggagctgtggtataccgctcagtgctgcacat

SEQ ID NO: 66030 - DNA, 440 bp, Heterodera glycines
  Genomic contig location: Contig_ID=SeqID_7808; Location=727..1166; Strand=+
  SCN-specific regions: Sequence locations=1-273,351-440
atgtgcaaacgcatactgatccagccaaatgtttggcaatttgccgctgttttcacaatgaatccacgaacattggcagggattagaaaaaagactgaactcttgtttggaatacttgacaacaggtagataattgttggcaaaatctaaaaggcaaaatttggaaattttttcggaaatttcctcgctttttattgcacatattttggtgtttcccgccgttgtaccgttcatgcgcgaaaaccgcaaaaaaggatatttcgctaaaaccgcaaaaattttaattattaatttatttaaaatgttattaagtaaattaattgaataaaattatttattaatttattaaagtaaattcctgatgacatttgcggaccgacttttgcggaccgacttttgcggaccattatttctgggttgaactgtctaaaaaaacaaaa

SEQ ID NO: 66031 - DNA, 839 bp, Heterodera glycines
  Genomic contig location: Contig_ID=SeqID_7809; Location=565..1403; Strand=+
  SCN-specific regions: Sequence locations=1-115,150-233,255-423,465 -662,692-780,818-839
atgaacgactgcttatcattcattattcgttgcaattcttatcaaatcctgagattgtttttcattaaattaaacagacaaatatctcgtgagtagatttcatcgtaaacaaaatttgggcatttaaatatatgttttaattttatcataaaattcttgaataatcttgggatttctaattgattttgttggggatctcatcaagggattggcggaaaaaggttaaagaaatttttaacttaaaaaactgagtacttaagagaatcgtgagctcttaatggatttctttcctatccacgtttttgtggatgataaagaaatcagtgtccatcttgacgaattcaaagtcgatatcttattccccaaaattgctgctttgtttgaatcgcctgcggcttcttttgaccaaatttgtttttatggttaataaattaaataattattatctttttttatttatttttgttaggtgttgatgggtcgccaaaacgaattcagaaagaagaaaagcaacttgcactgttgcttttgtatgcatcacacaactttggcaaattgaaattgtttaaatgcgatgactgacttatcgtagaatattttgatattaatcccttatatatttggatatattttattttttaaacttactcgtatatttttggttatttttattttttaaaatcaattatttgtttcacttaaattgtagttcatattgttaaatttatttttttaattcactaaattatccgcaaatgtcgatccgcaaatgtcggctaaccatttaattcaatcaattttgatctatgatcacttgaaaatgtccacttttgaagtaa

SEQ ID NO: 66032 - DNA, 332 bp, Heterodera glycines
  Genomic contig location: Contig_ID=SeqID_7809; Location=2032..2363; Strand=-
  SCN-specific regions: Sequence locations=1-137,165-332
atgtgtgtaaaattcatcgataggtttctcgacaaacaacgtgagaaatctcgggctgtaacacatttgctcaaatgataaaaatattataatgttattcatagagcagaatttgctctttcagatatgattgaaactattaaattttttattaaaaaatttatgtcgcttgttcaaaattcatagatttttgagcacccatgaagtcaaactcgcaaaaaaaattactcataagaaattctttttcgtggcataaagccgcagttcaaatggtaggtcgttattcctagagaatgactaaaatatggggtatgactcttatcataaataaa

SEQ ID NO: 66033 - DNA, 465 bp, Heterodera glycines
  Genomic contig location: Contig_ID=SeqID_7810; Location=1418..1882; Strand=+
  SCN-specific regions: Sequence locations=1-247,270-440,463-465
atgccggaccaaatgagatttgggacgagaaaattggaggaaaaaggtggcaaaaaagagaggcggatgaatgagaggcacttgacgaatggcaccagaaaaaggtaagacgaagagcatttctgtcgatcattcttactccatttcagaaggggaatcagccggcggcggtggactaggcgcataaagctataatttgaaaagtgcaagaaaatatgttttaatgaattactaaaaaaatcaatggattaattttaaataaaaataaacaaaacagctcttttttattataggtttttatgggcatttgaaaattgcatttaatttgtttgatacgttagcttacttcatttagcaggtcgctgacttcactcatgaacccgtcccaggcatccaaagtggcgaaaaaggtgaccatacaaacgtcccattgctgtttgattttaaaatatttaattaaaagaa

SEQ ID NO: 66034 - DNA, 782 bp, Heterodera glycines
  Genomic contig location: Contig_ID=SeqID_7810; Location=2189..2970; Strand=-
  SCN-specific regions: Sequence locations=1-85,109-340,373-415,437-782
atggcttttccatatttagtcaatgtcccattaatagaggtatgttttgtacatatttattctcatctccatttaagctcactttccactttccttttcaattgtcccattttccgacttgtcggcaaaccgcccccccccctccccccccaaaattgcttaattgtccccatggatcacctattggtaaagcatcgttctctcccagccgaactcttcgacgaaatgtcccgtttcgttcccggccttttttgccgtaaaattttgagcaaaacaaactcaatattttaccttttgtttcgatgcacaaaacgtgaaaaacgatggaaaatcgaagtacaataatttttaataataattttgaaaataattgctctaatttgttgccagtgggaaataaattgcagaatggttttaggtttatagaaattaaaagaaattttggccaccttaatattttttacttttttctgagccttaaaaggttttcccagataaatacaggtgtaggcttttcaaaatgacagtttctaccagcaaatctctaaaaaattgtcctaggacttggaggcacgtgaggccaataccacttatgtgtcaactggcccttctccgcacacaatccaggcactgattcctcgtctacactggagttgggcttctttctcttttgatcatatccacgatctcatcaattactgttacgttggtgctaatgagagacgcttcattgtttctcttctgccaccgcatggccacggggtttaagccatttaaataaa

SEQ ID NO: 66035 - DNA, 1566 bp, Heterodera glycines
  Genomic contig location: Contig_ID=SeqID_36813; Location=145..1710; Strand=-
  SCN-specific regions: Sequence locations=1-236,258-492,517-518,597 -733,813-831,881-881,904-929,977-977,1060-1060,1096-1254,1276 -1484,1506-1566
atgcgttcaagtgctggtgatcgaatatcaagaccaacttttggccgttggtccgactctgatcaaaaacaacgaggtaaacaggctgaagacgctctaccgactgatcaatcggacacccgacggaattcccaatttgctcaacgtcttgcacaaacacatcacggcagaaggactcgccgccatgcatgaacacgcggcggaaattgtgacggtacatttttggaattcgatttagaaaaaatcatcgaaatttgaatttaggacagcgaaaggtacgtggaacagttgctcaacatgtactcagtgttctccgaactcgtccgagatgctttttacaacgactcgcgctttttgaccgtcagagacaaagcatttcaagaagtggtgaacaacacggaagtgttcagattggagttggacccaaaccgaacgaaaaggttgaaaatgcgcaaaagcaattttaaaaataaatactaaacagtggacgcccagcgaacatcgagtcaaagtgcccggaattgctagcaaattattgcgatttgttgctcagaaagtcggccctgacgaaaaagttttcttctgaagagatcgacgagagactgaacaacgtggtgagttagggcagggcggtccaatggttattttacatttgaagtacaaaacggaaaagaaatttgacttctttttggtgttgttacgtattccgcatatttcgccacttcgttttttagcttttggtgctgaaatatgtcacagctaaagatgttttcatgcgttatcataagacgcacttgagccgaagactgattttcgagttggtggccgaccaagaaaaggaggaaatgctcaacttggccctaaggaaatcgctggaaaagggcagctgcagccaaatggccggttgacggaacactgaacgacagacattcattttggtttttcagattgtgtaagcgtcaaaattctgaatgccagagcatggtcgaggagtcgagaccgttcgcacctgactttgccacgggaattggaggatttgaccccggaagttgaggacttctacaaaaaagcagcactgcggacgaaagctgaattgggcccaccattggtccacgggggacggtaattagcaaattaacattgaaataaagttcacaaatgccaaatgttctgtcgaaggtttcgttcaccagcagagcgggaaggttcgacttggaagtgacctctcatcagatggccattttgttctgttggaacgacagacccaacgacaaactttcctttgcgacagagtcgtctcgcgactgaattgtccgagggcgaattggcgagaagtcttttggtccgttctccgttttggctgcttttcactgctttccttttttcagactggtgaatttccccaaagtccgaatgcgactgatcctttgcgaaatcgcccaacaaccgttgaccccaaaaagcttcaacgagccggcctcgggagttgaaatgttggcaatgcttcacgccattgttccgaaaaagccattcctcaagggcgaggcgcgaattgcatgcggatga

SEQ ID NO: 66036 - DNA, 357 bp, Heterodera glycines
  misc_feature (9)..(9): n is a, c, g, or t
  Genomic contig location: Contig_ID=SeqID_36818; Location=276..632; Strand=-
  SCN-specific regions: Sequence locations=1-131,190-318,349-357
atggcacgnatggcattggacctgcggtatgtggcactgcacgagattggccatgcacttggccttcggcattcgacctaccggcactcggtgatgaacagttattacaggtaagcagaaaagggggggcaagagatagagtgagaaagatagagagagaggaaaagagagagagagagggagagagagtctcattagggattagctaacattaccatttatacagacaaaatttggcacttttggatgaacaaacggaagagttcaaactgagcaaagatgataaagcggcgatttgggaattatttggggagaaatgccaccagaagaaaaagaggaggaaaagctgacaataaa

SEQ ID NO: 66037 - DNA, 565 bp, Heterodera glycines
  Genomic contig location: Contig_ID=SeqID_36820; Location=387..951; Strand=+
  SCN-specific regions: Sequence locations=1-42,134-480,503-532,561-565
aaaggaaaaaattgcaacaaaagtcatttggcgaaatatttggagaaaaatgggaagaaaaagaagaagaaaaaagagaaataattggaaaattttataaaataaaagagaaaatcaaggaaaagggaagaaatattcagcaaaagaatggagtaaaatcaatgcgaaaataaagaaaattttcaaaaaaagaatggaaccaaaattataacgaaatttgtaagaaaattggagttagtcaaagaataattgagaaatggaagaaacaatttggattaagcagtaaaagaataacggagaaagaaaaaatggaaaaaatgaaaaaatattggcaagtaaaaaaagaaaatccaaaaatgagtgacacggaaattggaaaaattttgaaaattcatcaacagagaatttcagaatggaagaaacattttggggaagaaattttgaaggattgaaaaaacggaaaaatttacgaaaatttggataaatttatttaaaaaattatctgcgctctaaaaaatagatttgttatataaattttcaaaaatattgtatttgtatttgataa

SEQ ID NO: 66038 - DNA, 693 bp, Heterodera glycines
  Genomic contig location: Contig_ID=SeqID_36821; Location=304..996; Strand=+
  SCN-specific regions: Sequence locations=1-48,70-121,150-328,351 -443,466-670,692-693
atgttatcgttgatggtcttaacattgctgagaatggaatcgtcagaattgtgcgggacgaaaattcattatgcccgagaatttatgaagtgcgcgcttgtgcgttcgattctcatccgacttatatttatgaatcaataaatttttgcagatgtccctttttcgctttacgtggtatgttatggtgttgattctaaacattttttgctagcccaccaattaatatgtcaaaaaacattgaaacaacctaggataaataatattgaatgtttatttatatgcctgccttccacagtttatgagaatttccaatttttattgctaatagaccattaaaacataatatttttcttatttagttctgcatgagaacaacgcttacgtggttggtcagttatatttttgtagtgtttgatacaagcgtcggtgttccgtccggccctttggtgcaaaacaggctgattgtgagcctagtctggcataagcctggtttcagacgactggtgatagcgaaagtcctatctctagggctacacattcgcgctctggacatttgcgcctatgtacaaaatcgggttcaaacttaatttttccaatccctgatagcctaaactgaattaatattaagaaaataaggtcttttgttcattaggagcattgattctgttgtttgaaaattgatggatttattca

SEQ ID NO: 66039 - DNA, 205 bp, Heterodera glycines
  Genomic contig location: Contig_ID=SeqID_36821; Location=1199..1403; Strand=+
  SCN-specific regions: Sequence locations=1-205
agccaattccctaccgccaattccctactaaggcatttgggccatttccataccaaaagtgttgaatattgataaacattgagattaaaacacacaagaaaatttattcactgctttttagacagctcgtcaagagctttcggatgataccaaatttatcaagattcgatcgttttaaaaaagttagaagtgacaaatctctcaa

SEQ ID NO: 66040 - DNA, 2256 bp, Heterodera glycines
  Genomic contig location: Contig_ID=SeqID_94; Location=3394..5649; Strand=+
  SCN-specific regions: Sequence locations=1-1262,1284-1409,1462 -1749,1771-1816,1838-2086,2110-2256
atgaggaatgtgccacggaacactcgtggcgaaatttgtgaactgcgcttcctgccgctggaggacacacagcggcccgacttgttgatggaggtgctcatccagcatctgctagaccgtgtgctggacggtcacccgccgccatccctggttggtctgcagctgcacccaccaggctttgaccggccgtacgtcatccgccttcgcccgcccgagcagaacaacgctgcggcactggcggcagccattgagcggctcaatgagcagtcggcagccggcattgacctgtttgctgggacaacggtcgccaaagttctggcggtgtggccactcgagccaattcgtgcggacccacaaagaggaggtttgttcttcgattttcaagcacattacgttgaaaaaaaaaacaggtggctgtgatttggaggcggaacaccatgcttcgcacaccgtgcaatcattggtcgtgtcgttaacccaaacgaccgtctctgcctggcgcgtgccgtccttctgggtctgcgggaccgcgaaacgagaatggctggtggcggtggccgtgcagcatttacggagtacgcgcgtcatcaggagcaacatgggcgtgacgcagaagagctgctgacgcgtgccggcattccccttgacaaagggatgtacacgctggtggacgtggctcgactacagcggatgttaaacaacacaaatggaattggccaaatccgcctggcggtgtttgaaaaggagcgggaataccttattgtctataagggtcaggggtaaatttctgtcttaaataatggatttcaaatttctggtctaattaaagcatggcggccaaattcaatttgtgcctgctgttggaacgcggccatttcaactaccttggccgcgttgaacaactgttcgatgtccaacgctactgcatcgactgtgagcggcgagcgcacttgcgctaccacttctccggttgtaaagttgtgtgccgcctttgtttgcggtttgggcccgaatatccgtgtcaagcacaacaggtactttcaagataattaatgaaaacatataacaaaaaaactaagcttacaaacggcgcaagtactgcccgacgttgtggtgcgtgccagttcatctttcccaacgatgattgctacgactaccatctgatcgaacatgctccagctccaatggatgcccgaggacagcgtcagcgtcagccaatctgtcaatggcgccgagtgtgccgtgattgtgggcgcatcgcctaccagggcaaacatcaatgcccacgtcaacaaacagccgacaacgggaactgtagacgttgcgacgggcctcacaccgccgaagagccctgcttcatccagccaatttgtgatctgtctgctcggcaacgcgcatcagttgctgttgacaacgacgacaactcagatgacaacggtgacgatgacggcgaagacgacgtattgccgcttcgactttgcttcttcgatgcagagacgtcgcaggacagcccgctccagcttaacaaccgattggtgcagaagcacgtcccgctgttgatcattgcagaagtcatctgtgaacgttgtcttcaggttggcatcagcgtcaacgatgggcttggaagaagagctcctgactgtgtttgcatgccaggaatggtgaggggacaacagttacgccagtggtcttcaccaccgtttgccaacacacgcggagacaacacagctgtgccaatggaggccccgacattcaaccagcgccgtttctactttcactcattcgacaacgaagccgacgacccagtggaccaatttttggattttttgacccatcacggtccaaaaaaggcacacacggtgtgcattgcacacaatggcggcaaatatgatttccacctgatcctggaggcactccatcgccgaaatcagccaccaaagcgcctgtgcaccaccggcctcaagatttactccatgcgtctgtcagggagccaccaacgacgggtcacattcaaagactccatcaattacttcttttgtgaattggatgcgttggtgaagagctttgacctgcccgaacatcaggcgacggtgaagcccttcttcccctacctctacatacagcgacaacatctgctgcaacgcctcgacacactgccagctcgggagttttactccccggacacgatgaaagcagagaaacgggccaaatttttgcggtggcatgccaacaacaacggcaacgggtttcaactgc

SEQ ID NO: 66041 - DNA, 506 bp, Heterodera glycines
  Genomic contig location: Contig_ID=SeqID_94; Location=4527..5032; Strand=-
  SCN-specific regions: Sequence locations=1-178,231-356,378-506
tcaggagctcttcttccaagcccatcgttgacgctgatgccaacctgaagacaacgttcacagatgacttctgcaatgatcaacagcgggacgtgcttctgcaccaatcggttgttaagctggagcgggctgtcctgcgacgtctctgcatcgaagaagcaaagtcgaagcggcaatacgtcgtcttcgccgtcatcgtcaccgttgtcatctgagttgtcgtcgttgtcaacagcaactgatgcgcgttgccgagcagacagatcacaaattggctggatgaagcagggctcttcggcggtgtgaggcccgtcgcaacgtctacagttcccgttgtcggctgtttgttgacgtgggcattgatgtttgccctggtaggcgatgcgcccacaatcacggcacactcggcgccattgacagattggctgacgctgacgctgtcctcgggcatccattggagctggagcatgttcgatcagatggtagtcgtagcaatcatcgttggg

SEQ ID NO: 66042 - DNA, 3108 bp, Heterodera glycines
  Genomic contig location: Contig_ID=SeqID_95; Location=141..3248; Strand=+
  SCN-specific regions: Sequence locations=1-151,173-290,313-429,452 -461,483-690,713-1007,1030-1496,1518-2057,2088-2870,2893-3108
atggtgaggggacaacagttgcgccagtggtcttcaccaccgtttgccaacgcacccggagacaacacagctgtgccagtagacgcgccgaccttcaaccagcgtcgcttctacttccactcatttgacaacgaagccgccgacccagtagaccaatttttggattttttaacccatcacgggccaaaaaaggcccacacggtgtgcattgcacacaatggcggcaaatatgatttccacctaatcctggagtcactccatcgccgaaatctgccaccaaagcacctgtgcaccaccgggctcaagatctactccatgcgtttgtccgggaatcaccaacgacgagtcaccttcaaagactccatcaattacttcttctgtgaattggatgcgttggtgaagagctttgacctggctaacgaccaggccacggtgaagcccttcttcccctacctcttcatacagcgacaacacctgctgcagcgtctcgacacactgccagctcgggagttttactccccggaaacgatgaaagcggagaagcgggccaaatttttgcgttggcatgccgacagcaacaacggcaacgggtttcaactccgtgaacaactcattatgtactgcgccaacgacgtggccattttgagggaatcggctatccgatttcggcagctcatcgccgacaacacgcagggcctcgaccccttcctcaacgcatccacggctgccggtcttgcgctcgccacgcttcgtcgttgtttcctggccccgaatcgcctggtccactcacccgagggcggctacctgcgcggacgccgcgcatcggctgagtcgcagcggtacatccgcttcttcgagctggagaaccccggagcgcaagtgcagtgtgcgcattggtccgtcggggaggcacacattgaggacaccggctaccgcgtggacggtctttggcgacgcgatgcgcctcttcgtcccctggccattgaatggctcggctgttactatcatggtaatttttgttgtttgttttccaaaattgacaaaaaaaaaaaaaatcaaggatgcccaaagtgcttccccgaccgacagcagcgactggcggcggggcggactgcggaagacctgtacgaacggacggagcggcgtctatttgagctggagcacgaacacggttgtgagatccacaaggtgtgggcatgccagtggagtgaacgactacgccacgacccggagctgaagcgacggtacgatgccgtgttcgtcccctgcccactggacccgcgcaacgatgccttgaggggaggccgcacggagccgttcaaactacaccacgtgtgcagcgacaacgaagaaattttgtgcatcgacatcgtgagcctatacccatacgtcatggttggtcatttgaactgttcccttaatttttatagtcaataattcagaaggcaaactgcttcccggtgggcaacccgcgggttctgacgcgcgaggtgctgctccatccccccacggcacccctcccgtggactgcgccggaaaacaacaccttccgggggctgctgcttgtccgagtgctggcgccacgcgacatccgtgtgcctctgctcggctaccgcacaaaggatgagcgcttcaccttccctttgtgtgggtggtgtgccgaccgacgacagcagcggccgtgccgtcacagtgacgacaagcgttcgtgggtgaccgcctacacccacgtagagctgaacaaagcactcctacttggctacatcgtcaccgacctatttgaggtaattagttattataaattttgtataagaaaaaaaataggtgtgggactacgatgagtgggacggcacgctgttcagcagctacgtcaacactttcgtcggtctcaaagtgcaggcgacggggtggccagaaggatgcgccacggacgagcagcgtcagacatttgtggaggactttgagcgcaccgagggcatccagctggaccctgccaaaatggaattcaaccccagcctgcgcctcatcgccaaaactttggcaaactcactttggtcattaataataataaaaaatttatttttaaacgaaaaatttacaggggaaagctcgcgcagcgtgtgggccgaaccgaaattcgctacacgcggacgccggctgaattccacgagctgcttgaagacccgtcgctggacaagttggattttgtccacgtgtccgagtacatggaccgctgtgtcgtgcggaagcgccccgagttcgccaaggccccgctgaccaactgtcttccggtcgcttcgttcgtcacttcatatgcccgcctgcatctgtacgactacattgagcaggtgttggcgattgacggagctgagctgctctactgcggtatgctgttttttcacaaaacatttggtgtacacgcttatgctttagacacggactccatctactacgtaaacaagatgggtggtccgtgtgttgctgagggcgaggcactgggccagatgaagcgagagcacactgatcgcagaatcgtcgagttcgttgcgggtggtccaaagaactacggcatccggcatactgcgcgggacggtacggatgagcgtgccaacctgaagatccgcagcttccgcctgtcgtacgcggcccaacagttgctcaactttgaggcgatgaaagagctcacgctggccacgtacaaaattgacggaccaatgtgagttttgcaatttatcattaagtttgtaaataataaaatcttagcgacgacgtgctggacaatgacgacctctacgtgtacggaggcggtgagcatcgcgccattcgggtcaacttcccacatattgaccgcaacgcttacgccgacctttacacacacgaggcacacaaagactacaggcccttctacgcaaaggggcgtgtccgccccggaatgcagacgcgtccctttggctatgtggaggatgatggaccaccgaacgatggacaacggacggagcgacgaaagagaaattttgttgatcatgaccccgcccaaccagggcattccgggtggttttgatgttgtctttttattttttgttcatttcattcaaataattgtaaata

SEQ ID NO: 66043 - DNA, 709 bp, Heterodera glycines
  Genomic contig location: Contig_ID=SeqID_95; Location=3764..4472; Strand=-
  SCN-specific regions: Sequence locations=1-205,227-499,521-629,653-709
atggatttaattcttgccaccgattggataaacaacgcttatcccgaaatggatttacaggacgccaacaaagagccaacgaaaaagcaagaggaggaggcggatgatcccagttggatcagcctgattgacgaggagatgaagcgcgagccgctcgctccaattggtgaggagacgccagcaacaagttgcttttgttttaaacgtatatttaaatttaaatttaggcactccaaaaaaatgtgcatgtgccgaacgccgtcgccccgttccgctcgtggaccatctctgcaagcggttcaaatgcaacgctcacgagctgcatgtgcttttcaaaagcttagagaaacgccgggacattgtggagcatttgcgctcgtccactgcgcaccgcccacctgcgcccgtccgtgcgcaattttccggtccgctgtaatgacctgtccatcctggacacccactcggcccccgcgtaccgaggctacctcggcataacggtatttttatttgttttgtttgtcggtaacaaaaaattaaaggtccgcatgcactattacataaagcatggcatccgcttgcgccaccccaacttgccgtgcgtcgttgaatttggaggcggagatcacaaaacttttttccctcttgaaattttgtccattgttttgtagatgtgttcaatttcaaattgtactgttgtttttaaaataaa

SEQ ID NO: 66044 - DNA, 2236 bp, Heterodera glycines
  Genomic contig location: Contig_ID=SeqID_95; Location=4538..6773; Strand=+
  SCN-specific regions: Sequence locations=1-44,68-630,652-676,707 -826,848-1390,1418-2236
atggacgccttccaacaatttaaaagggaggatggacaatttcgtcatccattcacaatgattgtgtctgggagcacaggaagtgggaagtcagagtggataatgcgtctgttgcgaaatgtggacaaaatgatctctacccctgttgaacgcgttatttatagctatggtgagttgaacacaaatgtgatgaatctgcagcgcgccggcaaagttgccaatgtgccagtcactgtacacagcggcgtcccacgcgcggaacaagtgcgggagtgtgccaaaaaagaaaaaaccttgctggtgctggatgatttggtggtgggtatgagtcaacaatatttagacgcactcttcacccgtggctcacacaattggggcgtcagcgtaattttggtgactcagcacctgttcaacaaagagctgcgtgtggcgcgcactaattcacactatttagtattaatgcgtaatcctgcgggggcgttgcagatacgcaccatcgccacccacctcttcccgtcaaggactgcccattttattgaggcctaccgggacgcatgcgcaaaaaattttggataccttctcgtggacatgcacccagagagtccggaagatatccgccttcgaacaaatatatatgaacaaaaacaaatagtttacctaccaaaatgaaagggtcacaaataataacaataaataaatgctttttggagacactgtgtaatgccaaaaaggcgaaagcccttattcgatatgcatccgatgagcaacttttgtgccttgtcgaaatttgcctaaacattctaaagggccgagtccctttgcgtccccggtatttgaataagctgaaagctcatgcacaggtgcttcgtcgtctcgccagcacacgctgctcgcgctctgccaaaaaggttttgctacaacacggagatggcctcccagctattgtggggctcattgcgtcaattgctctcccgcttattgctgatgtcattgaaaaatataaatagtttccaaaaaattaaaaacaagaaaaaatgcagcatacaaagcgctatttgttagtccccgaagagatttatcagagtttggcagcaccgccaccatctgacggaacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatcttaaagttgggcgtgcgcgaaaagaaaatgttgaacaattagaagatactgatgatgatgatgattatcaaaacccacggtcgtcaagttcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggccaatccggcaaaggaatttataaaaacaccccacttaagtttaagccatcattatggatttgaaaaagcttcgcttgcgcgagtttttgtacaaggacctaagttcgcctgtcgcattcacgagcgttgaaccgctgctgagagaggcgcggaaaagtcaaccaaaaatcaatcgaaacgatgtccaaaattatttgaccagccaacgtacatacacactgcatcgccaggcgaagcggcgctaccgccgattgccaacattggcgcccggcttgcatactgaatggcaggccgatttagctatttttgaccgacttggtaaacaaaatcgtggcttcaagtacttattagtttgtattgatacccttagtcgacaggtgtttgttgagcccgtaaagaccaagacgagcgctaacatgatcattgcctttaatcgtatattcaaaagatcaaaaatatatcccgtggaaggtgttaacagatcagggaaaggaattcactgcccgggcagtacagcagttcttccgcacaaaagacgttga

SEQ ID NO: 66045 - DNA, 2789 bp, Heterodera glycines
  Genomic contig location: Contig_ID=SeqID_1011; Location=351..3139; Strand=-
  SCN-specific regions: Sequence locations=1-247,269-346,368-429,453 -585,611-1413,1435-1480,1502-1620,1642-1680,1705-1717,1751-2748,2770 -2789
  Gene Ontology: Mol. function=protein binding; Cellular component =nuclear body; Biological process=mitotic cell cycle
atgtccaattgctcagtggtaagtgacttcacatatttgacaacgttcagaaagccttcaaacacatccgaggaatcttccgactcaaaatacattcgcatcgttctttgaattatgtcaaatttctccatgtcgaaggctctattaatttccttaattcaaacggacagatttgtttatcgaattttgttactcacttcatgggtttttttaattttccgaacacagtcttggaaagatatttttgtgtccaaaatctcttcagcggaaatcataggcgcgccatcaagttcgaccatcttaattaagagaaaagcgtattaaaatccaaaaaaatgaagaagagtaaaatataaaatttaaaaaagattagcatggcgaaatgttttttgtaaaaaatttgaattaaattctttgaattcgcagattttcaaatttcagtttaaaacttccaataaatttatttaagattgtcctcagtttgtctttttcatccttttgacttctttttgtcatttccgatgtctcttaatccatcggctgaccctttggctggcatttatcagaaagaactcactgaatacgacttggttttattttcactatacttttctaaactttttctttagaatcgattgccgcatactctgaaaaagggggaggatgatcagttgctgaagcggtccgatttgattgatacgctcaacacggaattttcatgtccaatttgcttggatttgctgaaaaacactatggtcacggtacgaatgggtaacattctgtcgaaacccaaaagttgaacactatttgtaccattttttctgcttttgtttgcttttacgttaaaactttaaggaatgtcttcaccgtttctgttccgaatgcatcaaaaaatgcatttacaagggaaatgtaagacaaatgaccaccattatttaatttatcaatggaatgaatcttagagggaatgtccgacttgtcgaaagaaaatcatttccaaacgcaatctccgagccgacccaaacatggacaaattgatcgacaaagtaacagcagcaacaaattccaccgttcttctctggactaacggttgttcttccgtttttcagatttggcctgatcgtgagcagtacgaagcgttgcaacgcgagaaggcgcaaaaatggagcaaacatttcgatgttgtcgcattgcaacggagcattgcggagggaatgcgggcgcaagcgaaggcactcattcgccattcgaatgccgacgtaaacgaaccgacgacgacgaaaagggcggaagggtcgggacaggtggcgaataaaggtgcgattgggaaaaccatgttctaatgcaccgtttcttgtcctttatcagcgactcgttgtgccctccacgaggctttcagaatttaaatgtgactaatattttaattgatttgttccagcaaaaaaagcttcgccacctattcaacacaatgcaatctgtgctcccaaaaaactatgtcttcttcctcgtcatgtgatggaaaatgacatcgcaaatggtgagtagtaagtaataaatgggactggtgtctaaaaagcaatcatttcgaaattttgagattggacatattgtggtaatgtgttgtttttctgctgcttttcatgggttttccttataaaactacagagaaattgtgaagggacaaatttctttattaaaaatgcaaactgacaatgactattgttgttgttttctttgtttattgttgttttcagctgacttttacactgattcttcctctgaatctccatcatcttcatccggcaaagacacttccttcgacccaacttctgatgcggggaagggcacgcaattgtccaaaagtctcatcgtcgacgtggacgtgggtctgttcaacaaaagcgttgatgaccgattcatcggacaattaacgagcagagaagctgaattaggcggtaaaagaccatttattcgaattggccattaaattatagtgaaatgtgacccaccaactaaccccctcccgtccccaatatccatttctaatggttatcactgctaattgttaaggtgcgtcgtcaaatgtggcaatgccgtcgcctctttcgtgtcaaactgtggaggatgaatcgtccggaatttggaccgcctcttcctcgtcgtctccttttcccgccaatgaaattctgcgtctttacaccccaaatcctctcgatgattgcaacaccaattttgggtgatctttttgacgtttatttgtatgactattggatgatagtattgtggttcattattttgaattaatgtttaatttcgaggagttcagaattaacgtttcgatggaatcggcgttgagagagtacgtgtcgaagacgggtcagttgggactgatcacagttgaaatcgtacctttgcccaaacttcgccgacccatcgacgaacgttttcgaatgaaattaatgcatcgggcgaccggttaattcatttgttatggtaatcggctcataattttttttccagtggaagaacttcgtgttaaattcgtgaacatttgtaaaaacatggccaaagtcgaactcagtttcttcgttcaggtgacactccgcggataccgccttttctcgtcaagctttgtttattttttcagttgtataataataaaatgactcgtctttatgctaatgaatcaatgtgcacggtgttggcattggcgagacggccgaacttcttcgattacccaactgtctttttcaacattgaagccatttgatcgcttattgctgaataaa

SEQ ID NO: 66046 - DNA, 1089 bp, Heterodera glycines
  Genomic contig location: Contig_ID=SeqID_1011; Location=5011..6099; Strand=+
  SCN-specific regions: Sequence locations=93-111,162-411,433-873,895 -1089
atgtatcggctgctctccaaagtcgaccaataccccgaggcgtcccgaatcgttttcgaccgcacagacgtggccaagccgacgctgtccctttctggagtgtccgagtacttcttgaacattaaattagaaaaaactgaacgcgaaggcaattggagtcagcggccgctccgtctcgagcgtaagtgcattttgatggccattctttggcatttattttcagagaaaaaatacgcggcgcaagacgcgcactgtctgaatcggatcttcagaattgtggcatcgaaattgaaaagattgaaggacaatgaacttgccaaggagttgaaacggcactcactgatcgatttcaacgaagaaaaggcaaagccaacgatggcaattccgctgctcagcggacaattggtgcgagtgaaggaaggcgaggaggacttcattttgaacgtgcaagtgagtggaggggaaggccagcagatgccgaagccaacaatgccattttgagaaagccgccgtggaaattgagcgatcagccaacggagtgttggacggcttcagaaccattggagatgtccgcttcatcgtcgactcgatgcttttcgggttgggcaaacgtttacgcaagtgcggcttcgacacgcgaatgattggcgaccgtgaacaaattgtcgagttttgcaagcagtcgaaggacgaaaaatttgtggtgttaagcgccggcaaaggacataaacaggtcaattgaggcatttggagaatggtgtcatggagatttattggttatgttttgcaaagccatggcgacacttggcacactttcagctcgccctccaaatgccagacaatgaagtggtcaatgtgccaattgcgaccgacggcaccaccccaccttccctgttggtcaggaacttgttggacgaactccgcatcattctccgtccttccgacatgtggtcacgctgtgtggagtgcaacaagcggtccttcgtccgtataccaaaacgaattgtgcagaccttgtgctttatgaccgcagttcggcactcggccgaatggatgggtgtcgatgaacaggtcgacaaattccaatga

SEQ ID NO: 66047 - DNA, 1245 bp, Heterodera glycines
  Genomic contig location: Contig_ID=SeqID_1011; Location=3377..4621; Strand=+
  SCN-specific regions: Sequence locations=1-186,209-323,346-1183,1206 -1209,1231-1245
atggttgaagttgcgattgctcaaattaaaacccttttggagaacgaagtgccaaaggctgtcttttggatggaccatttgaatctgcgcgaccatttcccatttaacacagtgagttttgattcggaataattgatagacttttgatataatttaatgaccctatttagatcgtttgtaaacttattttggaaaaccaaactgctttgatttatcctttcgtcggtgaaagtcaatttcgacgtaataaactcattcattatttggacaatttgttgggccttgttttgcgcaacagacgagcggaggatgaatatgagcgggaaattatgaaaaaccaaaaacaattggagaaggttgggtaaggggccagagtacaaattggggcagtcaaaaatggcgattcttttcgtaaattttcagaaatgtcgctttctcacttttaattgttattgttacccttatactgttccgcttaatgctacgagaaacttaatccctatttaaatttagctcaccagaaagtttgtcaagaatttcgaattaacggaaagtgaagtgcctaatttgatgaagcttggtacgcaaaatgctttgttatacaatcactatcgttggtgccacaaagaaattacatggagtcaatttgaggagatagcgcgcgtaatacttttttaatttgtgctttttgccaattgttttttcttcccccccccccttcgttttctttccattctctcctttctgctgatttctttcctcgtcctacctttgcgttttcgccctttcttcccacttttctgtctctgtttcagcatgctctgcagttctcttccgatgttcgtgaccattacttccgccgtctgttcgagtccaaattgccagaacgagcgtgtcattttgcggaattgcttgaactcagtgagcacgattacatccccgaattgaggcattattgtcagcaaaacgcggatgaagtgcaacgaatccgcaaccaaatcagaaagtgattttatccgattttctttccattttcgcacatttagagacattgccattcgcctgcagaaccaacagattgaagagcagtgcgtctgcgagttgacccccggccaccaaattgtcctcgtcgacacgtggccgaagttagagcaactgattgaccatcttcggcacgacaacgaggaactctttggcatcgatgccgaatggcgtcctcactatctttgcgcagcagaaaagtga

SEQ ID NO: 66048 - DNA, 682 bp, Heterodera glycines
  Genomic contig location: Contig_ID=SeqID_7811; Location=980..1661; Strand=+
  SCN-specific regions: Sequence locations=1-2,24-57,79-597,631-682
atggtgattttttgggtaggtatttttgtggctgatttcaagaaaatgaaaagagatacagaggcagagaaaagtgagtaaatagagaaaagttaggattataaaaagtaagaaaaaaaatttttattacctaataaatgaattatttgagggccgagtctgaaagtggtctccaaaaacggcatttttcggaaccaccgctaacaattttttttgtaatgccatttgaaaacactgaatttacttaatcttggctaaatcggccacgctgagtccgaatatggccttagatttgagctctgtgtcaatgagcatgtacagcttgaacttcatgcacgaagttgaagcagtacaagctctggttgaaaagataggacagatttaaggccatatttggattatacgaccctaatttgttatacaaaaccgtttcatgaatgattacaaaatttctgggcgcgctttttcaagaaatttctaattctaagaaaatatactctttaaatatttggtcagtcacctttagttggaaggggccggcggtgccgatagacgccgtcggaccgggacctagcttttcaaaatccaggacctggaaccgggacctcggatgaccgggaattcccggccggtcccggtcccgtgactctagttttacgtgttttctttcaaaaaatcctaa

SEQ ID NO: 66049 - DNA, 1227 bp, Heterodera glycines
  Genomic contig location: Contig_ID=SeqID_7813; Location=329..1555; Strand=+
  SCN-specific regions: Sequence locations=1-89,112-211,233-301,323 -636,676-1227
atgttcaaagcgatcagcaagttttgtgccattctgatcattgacatttttggcatagacgccaccgtcgcactccatgctgctgtgagcagtgtaaaagaaaaaagaaagtttgaaattacgaaataattcataaaaattggtgtcaggccgtaattgagataaaactgagatccgagaattttggccctatttggaatatagcaggacttgaaattatatggaaacctatttttctcggggctttttgattccaaaagactgaaaatgttatggaaatttactcgataatattgttaaatttaaattctttcttataaaattggggaatttgtagcaaagttattttatatgtatattttacacgaaatttcagcgccgccaaggagaaaaattaggcatttatagccgtttttcgccaaaacaaagactaatttggccactttgggaccaaatttcaaaaaatatggtaaagtgggggtctggtgatgccgctaggcgccgccgggaaaatttttggacctttaatgcaattttttaaatttaacatggtaatttgttgtgtggtcggcaactgaaaaatagggaaaaaccagcagcactaaattaatggacgaaattgcttctgcggcttatgagaagaacatcacacaccagagaaagggaggaacaagttgcagtttggtgacgtgtttcacacacatttgtatgttctctaaccatatgacagatatacagcaagaggaaaagattgtttggcagagagaaaagcactcaacgcacgagacgaagtcaaacgctgattggctgaatcaggccgaaggcgggcggcaggccggcaacgagagggaaaaactgttagccagagagaaaattaaagacacactgcttggcagagagaaaagggaaaagtgaaattttggcgtattatctcttcatttttaatcggaaaacaattttatctcgttgacttggatcctagtaaatccgctttaaattttgcataccattagatagagaattcttgatctaatataggctttttgtataataattgagatatgttttttaaatccaagtttattgtcattaggagacctaaatctcttatagttgttgattcttttatttatggccatatttttgcgattttatatccatatttttccgagccctactaataattgtttgtacggacaaatttggagaatcaatggaaagcagcca

SEQ ID NO: 66050 - DNA, 228 bp, Heterodera glycines
  Genomic contig location: Contig_ID=SeqID_36822; Location=60..287; Strand=-
  SCN-specific regions: Sequence locations=1-228
atgtcagcggcactcaaaccgtcggactacaaaatattcccaaaaagtcagaaatgcgtcccctccaatggcaccgaatcaaccgccagcggcgcaaccgaagattcattctcagcagaggatcgaaaaacggactggcgctcaatttatttggccgctttggtgtgcttttttggccaagttcagttcagcattttcctcaactcgcaattcgcctttatgaaaacg

SEQ ID NO: 66051 - DNA, 959 bp, Heterodera glycines
  Genomic contig location: Contig_ID=SeqID_36822; Location=366..1324; Strand=+
  SCN-specific regions: Sequence locations=1-110,167-295,318-336,383 -467,489-768,791-959
atgaatttgttcttttttcttatcggaacagaacaacatgggtcatgggattggttggttgtggtcattgcaatgattaatattaatgagtgtgtgcacacacaaaaaccaaatttatttgaaataacaaataaaatatgaaaataaaagaaaaataattaaaatactaaaaactctaaaattccatttatgttatttgaactttcgacaacagaataatgcaactttattgcagcaatggccttctccatttggtgctctgcttcaaacaaaatgttaaaaatagcggcgtttgtgtgtaataatatgataataattgtggattaatcgttatgcaaaatattttttcatttttatattaaagaaaatataaaaaaataatccaattagggaaaagaagagaatttttatgttaaagtgcctatgaaaaaaaagttttaatttaaatgcaaatattgtgtttcccgttgaattgatggatgaattaaagacaattatgaaataagaaacaatgttttttttcattaaatgatagtgaaatgaagagactcccaaattttatagcctcagattcgctgatgtaattgatgcaatttggccggttgatccacctacacttcgaatggctttatcacgggatgaaactgacaaatgaacacattggggagaagaaacattgacgaactgataaaagacaaacgaatggaagagataagagataagcagcaaagctaaaacagaaatttgatcaaattaacaaatgttttgaaatatcaacaaaatgaaatgagtacatttgtacgcagcgattgggggaaacatagggacaaatgataggagaaaggccgaaaagaaagaagcacgatcagaaacatctgaccacaacttacgggaaggcctgtgctaattgaacgttacaaaaaaatgttgaaaggattaattacactatttggagtgga

SEQ ID NO: 66052 - DNA, 385 bp, Heterodera glycines
  Genomic contig location: Contig_ID=SeqID_36824; Location=1..385; Strand=-
  SCN-specific regions: Sequence locations=1-246,268-385
gttggatttgtaattacgtgtggctggacattcttccatcttttgactatgcccaactcggtctccaaatggcactgctttcttaccgtttcaatgctttggttgacgcacattttgatggcaaaccggaattgacgctttggaaaacaacaaaaattcgaaaacaaattggagtgccgaaatcggtgttggcaaattatgccgattctgtgcaatttccattggccgaccatccgttgcccaacaaaattcgctttaaggaccttcgcatttcgtaattcaaaattcagtgaatttttcaccgatgaaagcattccctttttttcaggtacatcgatcactctgtcatcgcatttctccgttccaatcaacaaattttcgacaa

SEQ ID NO: 66053 - DNA, 282 bp, Heterodera glycines
  Genomic contig location: Contig_ID=SeqID_36825; Location=35..316; Strand=-
  SCN-specific regions: Sequence locations=1-25,48-198,221-282
atggtatgtcaataaagtatttctgatttttaaacaaaaattaaaaattcagaaccaatggcacggcaggtgctgcaaaagcatgcatcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaa

SEQ ID NO: 66054 - DNA, 499 bp, Heterodera glycines
  Genomic contig location: Contig_ID=SeqID_36826; Location=68..566; Strand=-
  SCN-specific regions: Sequence locations=1-127,150-226,255-365,387 -418,444-499
atgccaccaaaaccatccggcaaaggagcgaagaaggcggtcaagtcgaccaaggcggtgcgcacgggagacaaaaagcggagaaaggcccgcaaggagtcttactcggtaggtttttttctgcattttcagggatttttcaggagggttggaaaaattgtttttgagttttcaatgatttgacaaaatgaaattataaatttaacccgccccccccccgcccttcaaaattttgaaaaaaaaataaaataataggagactcagaattttgaaaattttttataaaaactgatgacaagctaatgtgataaaacaggttaattatttcctttcagtatccctgcaaagtttggggcgcttctgataagtttctgaaaaaataagttaagccgtaaactttttggcctgtttaaaaaggaattaaaaatttttaaaaatttattcatctccctttttgatagaaaaagcatcagagtgcctaaactaacatgtaaataaa

SEQ ID NO: 66055 - DNA, 983 bp, Heterodera glycines
  Genomic contig location: Contig_ID=SeqID_36827; Location=1..983; Strand=-
  SCN-specific regions: Sequence locations=1-78,163-288,373-426,454-983
gggtgtatgcgtacagagtcaattacgacacgctaaactggcgaatgctaattgcgcaggtgctttttattacaaaggaattaaattttaaattttaattattttttattgattaattgaccaataaatttttagtgttaattagttattatttttttaattgaatgatttagctgcataagaatcatcaagagataccgacaatgtcgcgcatgcaattaatcgtcgatggcgaaacatttttgcgccagtcggccaacactcagttatttgtccaacttttaaggcaaattttttaaatttttattgaaattatgaatatttctatttcatcattaaattattaaaaacctaaaatttattttaaaaaatcgaaaaatattcacaaagcaattttaaaagtcatagcacagcaacccaatttcgatcattaaaaaattttaaaatcatttagtcactagggctgttcaagaattgaatttctctggagtcgagaatctgagatcaagatttggcccgagatttgtaaaaatccctccacgttttcagctatttggcccacgaggacgaccttggcgtgttgttggtcggcctggacgcattgcatgcgctattggagctgttcagtgccagcgatgtgttcggcactatgcttgtccattttgtgccggtaattcaccagttggaccgtcagctgagcttgactgctgcgcacggcactgatcccgagttggccgctctgtggctgctcagcccgctgcgtttggccaagctttatcagcttcgatgtgctgcaaatttgggcacttgcgcagaaaccaaacaggtccatctggactaaaaatggcaccacgaaatgctgggataaatcatgcccaaatctggcatttatgatttctggtacaaagctagtactctggtcgagttaatgttcgacaatctcttgcaggtgcgccggtggctcgcccatccgaccgctttag

SEQ ID NO: 66056 - DNA, 222 bp, Heterodera glycines
  Genomic contig location: Contig_ID=SeqID_36828; Location=648..869; Strand=+
  SCN-specific regions: Sequence locations=1-222
ttcgtttggttggtcgcctttttcggcaccgctttcctcaacattacgttcggcttggccctttctctgctgttctccttggccatgttcggccttcgcaaattgaatgatgccatcgccacaaaagggcgacgcgcttcgcccgaatcgtccgccgacagcgaaaggcaattggcaaaattgccacaaattgtaaatgttacgctagcggaggaaaagtga

SEQ ID NO: 66057 - DNA, 181 bp, Heterodera glycines
  Genomic contig location: Contig_ID=SeqID_36829; Location=707..887; Strand=+
  SCN-specific regions: Sequence locations=1-181
tacagtttctttctttttaatcaacaccagaaatcaccaaataaaaacaacaaaacaattgcgaatacttccacatgaatacactgtctcaattaacaatctttgccttcttcgtctcttttccttcctttttcgtctcttttccctctggccccttttgcgctgcgtttttcgtctctct

SEQ ID NO: 66058 - DNA, 306 bp, Heterodera glycines
  Genomic contig location: Contig_ID=SeqID_36830; Location=41..346; Strand=+
  SCN-specific regions: Sequence locations=1-156,227-306
atgcacaaaacggtccctaaattgaagatcacattgccaaaattggatctgaatgatcctgccagtttggcggcatttgcatcgcccgaatcattggactcgcaagaattggacgaagacgacattttgttggacaatgaatggaacgaaccgatggacgatgaggaggaggaggaggaagatgaagatatgatgatgatggaagaggatgatgacaacaatgatgtaggggacctttttgatgtagaagatgttccaccagcggaagcaatgctcagatgcagtcaaaatcggtgattataaaaa

SEQ ID NO: 66059 - DNA, 818 bp, Heterodera glycines
  Genomic contig location: Contig_ID=SeqID_36831; Location=59..876; Strand=+
  SCN-specific regions: Sequence locations=1-192,216-358,380-818
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaa

SEQ ID NO: 66060 - DNA, 2063 bp, Heterodera glycines
  Genomic contig location: Contig_ID=SeqID_7816; Location=1266..3328; Strand=-
  SCN-specific regions: Sequence locations=1-116,168-246,268-451,473 -564,613-732,754-930,952-982,1021-1064,1089-1176,1200-1317,1349 -1499,1570-1690,1712-1809,1832-1835,1872-2063
atgaacaccgaaaaagacatgatcaaagccattgaaacaaaaatcatcgcattggaggaacataaaaagaatgaagaaatttttattggcgttttgaaagaccgatttggaaagggtaaaaatgaaaatttaatttataaattttaatatttttaatttaatttttagagcttttaaaagctgtgcacccggacattcgcaagaatattgttgaggtgaaagagaacgaatagatttataaaacatgaaaattattttagaagttttcgtacccaaaacaaaactattgggatgccaatgccagtcacaatgatctcgaagtctttggcacggaatctttaaaagtctattacaaaggcgatgggagcggtaagtgaattaatttctgaaaggtacgaaaaattcgagttacaaatccacaaaatcggaataaagcatttctaagaaaggacggggacatggagaaaataggttaattttccgagttacagtacgtggagttacagttggtgagctcccttgtaggctaatttatactgagttatagacatacagtaatggatgaattatttattaatttttaatactaatatatattttataaaaaaataacattaaggtcgtcgttctgtcttcgctaaacattcaattttgttcaccgaatcaggcatttttttcttcgaaatcaagattaaaagttgcaaaaggtagcactaccatatgaaacatatgaaaatggttgatttttattttcaatttcagtctttgctcattcggatttgccaccaaagcgatgccattggacggaagtgttggccaaaattgggacagttgtgcatatcaaagcgatggccaattttgggtcaatggaccaagcaatattggaaatgcgaacttttctcgtggcgatttcgtcggttgtggcattaatttggccactcgtcgggtcattttcacaaagaatggccaacctttgagttgcttattttattttaaattatttatatttcaattatttttcagatacttccgatttattcctttcgcctccttttggtcttccattgtttccatttatttctttgagtgattctggcgatttaattgagacaaattttgggccaaaattcgaatttgaccccgcaaaagtccagcagcaggtgaaaaagagagaacaaatataaattatttaatttaaaccattaaggcatcttcaaatttccggcaaaattattgggatgccaatttttgtcatgagaatctcgaaatcattggcaacaaaagtctcattgtccattataagaaaaattcttatggtattttttaaaaattatataataaataaattctatttcttctaaaaagatgcatggcgttccgtcttcgctaaatatccgattttgctcaacaaggattcgtctaacattttttactacgaaattttagtcaaaaataaaaattagtaatttattttgtttcaatccaatttatcagattactaaaatttgaaattattattaattttattcatttattattttaattgtatttctttttttaataatttttcattttcagttggttcattagctttggattcgccgtcaaacagaagacaaaattggatggaataattctatatgaaaagggcatttatgtatatgaaagtgatggtgaaatttggttaggcaactcaaaagaaaaaagaacaaattacgaatattcatacggtattggtgatactgtaggaatgggcatcaatttggccactcgacagctcttttgcaccaaaaatggacttcgtttgggttggcaaataataaacaaaaatgagcaatttttaaaataatcattttaattaacttttttatgaccattaatttttatttgaattatcaaaatcatttaactttttttataggtttctctgatcttctcgttgatccatctttcgctgatgattcttttcatcccttccttactttgggtcattctgatgacaaaattgaggcgaattttgggcccaatttcaaattcgatttggcaactctctgaggaataaa

SEQ ID NO: 66061 - DNA, 1118 bp, Heterodera glycines
  misc_feature (1009)..(1009): n is a, c, g, or t
  misc_feature (1087)..(1088): n is a, c, g, or t
  Genomic contig location: Contig_ID=SeqID_36832; Location=47..1164; Strand=-
  SCN-specific regions: Sequence locations=1-247,290-719,758-771,793 -815,871-1118
atgtcattgaaccgtttttgtgccatttgttgttcccaaatgtatcggcgccattggtcacaaataattagcaaatatttattggccattattcttttgttcgctttggcaatttctgcaccaattctttggcattctgtgtgctttcggttgtctgaagtgagaacaccgcttgggcaaggacagcacaaaatggacggccccgtgttcatggaaattccaacacaagtaaaaaatggaggagcacaaaataaagaaaatttattttaaaacttgaataaattattttgagcaaagattttccgatttttttttacctcgttggcatattgtgtgcttttgccattcttagtagaggtcggcattttcaaactgcaggcctcgtgctcgggcttaaatgttttttgaatggttgcccgacggacatgtgttttttcaaaattctggaaagatgattataaaaaattatataatcttctatttgcttgtggttataatttgaaatgacgtacgattccatattcataaaagctttaatttttttagccttaaaatagcttcggagataaagttgatcagagtgatcagacacaataacataatcagacagtcagaaaataagaaataatgtacaataaatttctagagatatcactaaaaatcgaactcaaaataattttttcctgcttatacaatgggttattaaatacaatagtaagtaatttatataattttttttaattgttttttttattttctaaactctgattcaaaacttttttgaaaacctggcattggaattatgatcttcggtctaatttttaatttaaaattattaattatttttaaaataatatttttctaaattttcatcattttagcaaatttattacaatatcaccaaaatgtttgccatttgccacttggcttttctgctctttgcttatccgttaatgtgccgaaggatttaggcaatgaatttgaagcagaggagtcaccgtggttgaangtcgaatggtgtacggcatcattttgctttcaattgcaaatcttctctttcgcatttatctaatcacttgggtaattnnttaactctttattgatagcaaataattaaa

SEQ ID NO: 66062 - DNA, 104 bp, Heterodera glycines
  Genomic contig location: Contig_ID=SeqID_36833; Location=1082..1185; Strand=+
  SCN-specific regions: Sequence locations=1-104
ccgggactcaaatgtcccgctcaggccaaaaattttttctatttccgggaaaaaatcgaaatttttccgaaaaaaataccagtcgatagagctcgaaaaactat

SEQ ID NO: 66063 - DNA, 222 bp, Heterodera glycines
  Genomic contig location: Contig_ID=SeqID_36835; Location=810..1031; Strand=+
  SCN-specific regions: Sequence locations=1-85,125-149,200-222
atgtcggaagtcggaactcggaagtcggaagtcggaattccgtgccatccctggtacacaatggttaaaaagggtacaatcatggttttaaaattaaataaatttccttttattaattaaaaaagagagttttaaaagtacaaggattgaatatttatttaaattgaaattaattttacaaattctaatttaaaaaatacaggagttctttaataaaagtaa

SEQ ID NO: 66064 - DNA, 192 bp, Heterodera glycines
  Genomic contig location: Contig_ID=SeqID_36838; Location=326..517; Strand=+
  SCN-specific regions: Sequence locations=1-162,184-192
atggtacaattggcaaacggagggggcgcaattggagacgaagttgggacggaagcggaacagcagcagagggacagaatgggaccagcaaagaaaaagacgaaaaggccggcggagagggaacagaacgatgatcaacagcagaaagggcagaggagggccaaggagagggaagacaaagaggagaagaaa

SEQ ID NO: 66065 - DNA, 109 bp, Heterodera glycines
  Genomic contig location: Contig_ID=SeqID_36840; Location=117..225; Strand=-
  SCN-specific regions: Sequence locations=1-109
atgtctgaggaaaaatttgaagatgttgatggctctattattggacagaagcgacaaaatactgaaaacggcggcccggcctcgaagaaggcgaatgtgattgagtccg

SEQ ID NO: 66066 - DNA, 1456 bp, Heterodera glycines
  Genomic contig location: Contig_ID=SeqID_7819; Location=601..2056; Strand=-
  SCN-specific regions: Sequence locations=1-149,171-391,414-915,945 -953,975-1274,1297-1456
gacgaactgactgaggcgatgaaaaggcgcgacacaacactaaccattcatttgttcggacgacgtgggcagaacacactttcatttgacgagtttcagaagtacggtaaattaccgtgttcataacataatacggtatcatcggacgaatgaaaaaacagagatgaatcacccacgaattattgttggttcagtttttaccatcgtctccagcgagaaatcattgaaattgagttccacgagttcgcccggggcaaaacccgaatttccaccgtcgattttgcccggctcgtcctccgatactccattttgcacaaggaggagcattcgccgtacattcgaagggcgtacgaacggaggtggcactttttgaggacattttgaattttctaataaagaatatttacaaaaaatagtcattcgaaatttcgcttttttataccaaactttcaattggcattagtttggctttggtattctgtgattgtaaccgggcgtggcttattaccattttcaatgatttagatgaggcattaaatgtttcactgtcagtgagtatgatgaggaggtgagtgggcgaatagatgggtttgaatggttcgcaatttcattgtcagggcgttacactgcagcagttcgagcagttcagcatgttcctcaataatttggaagagttcaggtgaaacggatttcctattttttgcttttatttttatcccgactttctccatttttggaccataactttttcccttctcaaccatattaagtattcttggtgttgttcgatagctttatgtgtctattattaacgggcaaatattcaaaaattttcgttgtgtcataaaagttatggccagaaagaactcaaagactcagttttttaactttttttggcctgcttttttgtacatgaataaaaaattttgaaaaataatttttatgactttttccatttttcctatcactttttatgtctttcattcccatcactttctcgatcattttttttttgttgtctttttccatttcccgatcactctctccttccttcgttctttcagtaaggctgtgcgtctctattcgttggccgatatccccgtgtcccaaagtgagttcatccgtgcagtcaaatgctccactggcttttcgcttgactcggcactcgtccgcgtaatatacaaaatatttgacgcaaatgcggacgacaaactcagctatcgcgagtttattgcggtgatgagcgaccggctgagtcgcgggctcaaagtcagtgcaattaatgggaaattaattacctgatatgggaattggccatgggttaattaccctattgacaggcactttcaaaaaatgaataaataccaaacatttccatttccagaagcaacggacagagcaaatgttttggctgaactccttcaaagaatgtgtccggaacaaattaagcggaatt

SEQ ID NO: 66067 - DNA, 721 bp, Heterodera glycines
  Genomic contig location: Contig_ID=SeqID_36842; Location=619..1339; Strand=+
  SCN-specific regions: Sequence locations=1-87,135-631,653-721
  Gene Ontology: Mol. function=ubiquitin-protein ligase activity; Cellular component=proteasome complex (sensu Eukarya); Biological process=protein modification
actgcttcatcccgtcgtttgcaaaaggttgactaattacgggcttttaactttattaccatatgggatcagaacttgaatctcttggctgacctaaaatctcacttcagtgcttttttaaaaattctttttcatgattgaaactattcttctaccttactaaaatatttactatatttactaacaggaactttccgaaatgcgtgggaacaattcgggcgctgttcgtgttcttgaggttgatgagtctaatttgcttcgctggagccttatgctttatccggtaatgttttatacgttatagcaaacaaacaattagattaatgtgctttctttaggaccgtgaaccatacaacaaaggtgcttttcgtgtgaatgttgattttccaactgagtacccattcaaaccgccatccgtgacattcgcaaccaaaatttaccatcctaacatcgacgataagggccaagtctgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcaggtggagtgtcttgctattttaatttttcttacaattaattttagaagactacacgaaaaagtatgccgaacgtcgcgactgagtt

SEQ ID NO: 66068 - DNA, 451 bp, Heterodera glycines
  Genomic contig location: Contig_ID=SeqID_36845; Location=124..574; Strand=-
  SCN-specific regions: Sequence locations=1-210,232-451
actgacaattcatcaaaaggatcaatatcaagcccaaaatggaccgactaaatacgaaccgaaggcggaaggacagcacgtgacgagttcagtaacaaccgcaggtgttcaatacaacaatatcctgacgtttcaaaacattttttgagctaactcaattttttttagttttattctgtggaattgtgtcgggattgaccttttttagttttataatatcaaaataattttcaaaatcccagaagcaggaaagtactcgagttcaagcggacacgcgagttcgtctgaaagtgaggaagaagaccgctgggaggagccaagaaagcggtcgcgaaaccgggaaagagatgagcgaaacggacgccacggggaaggtgaagacaaagcagcgaaacggtggtacaaaagcgacgagtcgaaggaagagaaaagagatggaaaagggagagag

SEQ ID NO: 66069 - DNA, 349 bp, Heterodera glycines
  Genomic contig location: Contig_ID=SeqID_36848; Location=253..601; Strand=-
  SCN-specific regions: Sequence locations=1-224,253-270,292-299,322-349
atgattcgttcgcttctcggctcgcccctcgaaacaactccgcttcgccgaccaccagcgggcgattttcgccccgttcgtccgcaccgccaactccgtctgagacgggcgccagtggcgccggagggggcggcagcggagggaaaaaggcgcgcaaggcgaggacaattttcacggacaaacagctgcaggtggcaaaagcgaaacggacaaaattcaaacaattttaattgtttttaattattttaggaattggaaacgatgttcggatcacaaaagtacagaaaaccaagaaaatgcaataagcaaaatgccaaattattgaaggtatttgtcggtgcaggacaga

SEQ ID NO: 66070 - DNA, 253 bp, Heterodera glycines
  Genomic contig location: Contig_ID=SeqID_36849; Location=121..373; Strand=-
  SCN-specific regions: Sequence locations=1-43,83-253
gcaatttacaaagtcatccagcaacttgatggtgagagattacaaattaattaattttaattgaatacatttaatttaatttctttttagaaacaattcccgagttctttcgagagccccaatttgtggaacttcttgaacaaaacaactaatgatgatcgtgaaaaggaagagatgaaatggaatgaaatttacctgctgcccagttatcccaattaaatagctatttacatatgctaattaaccaattaaa

SEQ ID NO: 66071 - DNA, 831 bp, Heterodera glycines
  Genomic contig location: Contig_ID=SeqID_7820; Location=194..1024; Strand=+
  SCN-specific regions: Sequence locations=1-49,87-561,584-831
atggcaagtcaagcggaaatggcaaatttatttcggcaattaacggatgccctccaaaacattgcaacccaaacaaacccaaacccgaataaacaaaattccgacctattcactacaattaattcacaattgtctgagtttgtgtataatccggaaacggattctacatttgacatttggcatgatcggtttggcgctttcatcgagaaggacggacaacaaatgccagacgacatgaaaacgcggttacttttgggtaaaatgagttcacaggattacgcgaggtattctgagagtattttgccacaaaatccaactgaccttggttatcaggcaacggtaaataagctgaaaagcttgttctgccagacaaagtcaatttttgtgaaaaggtttgaatgttttcaacttcagagggcaccatcacaaagcgtaatggactttgccgaacaggtcaacgcctgctgcgaaaaggcgcaaatggcactttcaaaagaggagatcaaggcgctaatttttgtaagcggtttaaattcaggtgatcgagatttacgtgagcgatgccttaaattgttggaggagagtcggacaaagaacgtggcgatcaaattcgtagcaattgtcgaggagtgccgcaccattttgtcacttcgtagtgcagcggcagctctggaacaacccggccaatgtttcaatgccaatgcaattgctttaaaaccccaacaggcaaaagagcgacatagtcggcatcaaaagttcagtccttcatcacgccgtgaaaacagcggaaatcagtcccgctctccatcattgaacattcgccgatcataa

SEQ ID NO: 66072 - DNA, 1920 bp, Heterodera glycines
  Genomic contig location: Contig_ID=SeqID_7821; Location=444..2363; Strand=+
  SCN-specific regions: Sequence locations=1-353,395-425,448-1721,1756 -1779,1803-1895,1917-1920
atgttgtatgggaggaaatttacactattaacggatcacaaaccgttaattagcatttttgggtctaaaaatggcatcccaatttatacagcatccaggctttcaagatgggctttgacactgttcaatacgatttcaaatttagtacatttccaccaaagattttggacaggtcgatgttctctctcgattgatcatgcagcaccgcgaggcacagcagacgacgaccatgtcatcgcaacggcacaaacaattccgatttcaattcaagttcagaagattcaattgaacatgccacggctgccgttgagtatgttttgcatgcaccaattaccggtgacagcaacagaagtggcagagaaaacaaagcaggacgaagagttgcaagaagttttgcaaaattgtcgtaatcattggccaaaaacggcacattcttcccttctttctgcattttatacacagcgtgcacgtctcacggaagttgatggttgtctgctcatgggcgaccgtgttgttattccgagttcattgcgcaaccgcattctcacggcattgcattttacacatccaggaactgtcagaatgaaaagtttggccaaacaattcgtttattggccaagaatggatttggacattgaccggtgggtgagaaattgtcaggagtgtctgtccgctgccaaaatgtcaccgaaagtgccgttgagtccatggcctttccaagcgaagtgtacgaacgattgcacatggatttcgccggcccgtgtgcggatggaaataaatatttggttgttgtggactcgtacagtaagtggccagaaattttcaaaatgaagacgacgactgctcgaattttggtcgataagtttagtcttgttattctctcggtatggctatccaaaagagattgttaccgataacggacagccatttaaatcatttgaaatttccaaattttgcagagaacacggaattcggcacacttttgcaccaccgtaccatcccatgagcaacggtcgcgctgagcgctttgtggacacgctgaagcgtcagttaaagaagtgtggggaaacagattcgcattgggtccaaaactcgttgttggcgtttcgcagcacgccaaacgcaagtctaaacggcaagacgccagctgaattgtttctaggcagtccagtccgcacaattctgtcattagttaggccagacgaaaagaaaaagcattcggacacaactgataagcaataccggcacaaaatggcacaacaattcaaccgccattatgggacgaaacaacgcacgttttgcaccgacaatccagtgcaatttgccaactacaggaacggctcaaaaatgtggttgtcaggaagaattgtttccggaaatggtgtcgtttggcgaatatattccccacagttaaacgcagtggttactcgccattccaatcagatcaggaaatcttttcccatcccgtacagagacagttcagaaccaaacgagcaacaagatcaggatgaacagcaacaagaagcacctcagtcaccacgtcatgtgcgatttgccgacgaggagaatgagccgcttgaacatgtccaaatcattgagccaagacggtcaacacgtcaacgaaaacaaacacaaatatttgacatggacacgacgagagcaaaatacgatcttgtcaatcccgggcaaaatatttaaaaagggagatgttgggataagacaaaatagacatgcattaatttattttctctatcttttcccttcgctattttccctcaatgtcttttcctttctctctgcccgtcgaagtgcataaatagtgactgttcctttcgttctctccccattcattcgcaatttgccttctcttctcttcattcactctctctctcctcagacttttattatttaattttgtca

SEQ ID NO: 66073 - DNA, 708 bp, Heterodera glycines
  Genomic contig location: Contig_ID=SeqID_36854; Location=173..880; Strand=-
  SCN-specific regions: Sequence locations=1-101,123-375,402-519,542-708
atgccaaaggaaatggcttcttcaaatggctttatcggaagggtgcgtttgtagcttgttgatcacctgctggtcattttttacttaacagttcgaccattctcccccgaagtttttctttgctgggaaaagcaagcgctggcaatgacaccgctgggacccctcgctctcagatggcattctaagctaccaagtgagcgccattagttttttttttgcgcaatctctgatcactaaatcgcctaaaaatagaaatttgaaaaaaaatttggacaggcaccacgctgagctgattaattatacaaattttgtttgactcattccataaaaaacgagccggggatgccaaaagagagcggttcggactggcgtttccgtttctttcttttttaaaaatttgtcttgcaattttttaactgatttaacctattacagctcaaaaacgtaatttttcttaagtcgggcatccacttaaaaaagtttcacggctgcatatttcagcttgacaatgtggccaatttggaattgttcaccaaagttcgaattttgtccgacggacaaacatttttggaggcggccaactcagtccaaagtgcgcaacaaactgaaggcgccgccaacgaaatgccattcacttacgtggacaaagtgcgcatctgcgacacggccaacggtgatgaggtgaaccaattgaatgcttattcctaa

SEQ ID NO: 66074 - DNA, 686 bp, Heterodera glycines
  Genomic contig location: Contig_ID=SeqID_36858; Location=29..714; Strand=-
  SCN-specific regions: Sequence locations=1-686
gactcaacccaccaacatttcaatcactggcactcaatccaccaacatttcaatcactggcactcaacccaccagcatttcaatcactggtactcaacccaccagcattacaatcactggcactcaatccaccaacatttcaatcactgggactcaaccctgcattacaatcactggcactcaacccaccaacatttcaatcactggcactcaacccaccaacatttcaatcactggcactcaacccaccaacatttcaatcactgggactcaaccctagagcattacaatcactgggactcaacccaccaacatttcaatcactgggactcaacccaccaacatttcaatcactgggactcaacccaccaacatttcaatcactggtactcaacccaccagcatttcaatcactggactcaacccaccaacatttcaatcactggcactcaacccaccaacatttcaatcactggcactcaacccaccaacatttcaatcactgctactcaacccaccaacatttcaatcactgggactcaacccaccaccatttcaatcactggcactcaacccaccaacatttcaatcactgccactcaacccaccaccatttcaatcactggtactccacccaccagcattacaatcactgctactccacccaccaacattacaatcactga

SEQ ID NO: 66075 - DNA, 605 bp, Heterodera glycines
  Genomic contig location: Contig_ID=SeqID_36861; Location=81..685; Strand=-
  SCN-specific regions: Sequence locations=1-108,180-202,231-605
atgccattttgccattttagctttgctgccgttgaatcacgagagcttatttgttagccaataaatcagttgcattgaaattctttctttattcacctttcacatatttttttatttccttttttattatttttaagattttatttttgtaaaacattttatttttaattttatatttaacccttaaggatgatcaaatcatttttgtttcgcttttctctttttgccctagcaatacatggtgctgtttcggtttttattggtcagtttttttaattaatttttcttttcaattaaattccaatttcatagatccgatcgaagtgaaacatttggcgctatttttgctcgacttttataaagaattctgtgatcaaaacgaacaatttgccttttgtcttgcaactcaagcgaacattttggacacatttcatgtggaattaaaacatcggagtacggaagtgatgaaaagcgagaagccgcaaaacggcggccaattgcttttattcatcgaattggaaaagcgtttgaaaatgaaaaagcaaaggccggcagaccaaacgggcggcgcaatttgtcgatttgccggtaaagaaacagcttaa

SEQ ID NO: 66076 - DNA, 960 bp, Heterodera glycines
  Genomic contig location: Contig_ID=SeqID_7823; Location=6..965; Strand=+
  SCN-specific regions: Sequence locations=1-148,171-172,194-960
atgtatggcacgtcaaatgtctacggattaactgttgtaatgggaaggatgctcatggaaggcaattctcctctggtcatcccaattcatcccagaaatggtcgccgttttaccagcgaagaaatcacgacggattcggtggattgtatgcaccattttaataaactttttgttctaatcacaaaaacattaagcgaaatgggagagataagagaagaccaaaacaattcaaactattccccaaatattgttcataaacaaaaaatgtcgcagcaacaaatgcagtcgaaaatgtgcaaagataaaacgagcaaaccattaacaaaggttggacaggaggaattagcgaaaaaatgcgtcagtgatacagtatttgtagaaagcaatatactgtaatggactattaatcttacaatttgtttttacgcctccaatgactataaagtcgataggacttttgtctaacaaaattatggattaataacaaaagataaaaaaactttccttagattggatgatggactgtagtagagccgttggaagataacacacaataagcatatgcatactaagaaaaaggaggggcttcaaaaattagcaaactttcctttgaaagagataatgatgatttattgggggggggggggggaaaggggcataaccaaaatatcctttggtgatacgttctgtggttacaaaaaccgaaaatattgaaatataatttttagcaaaatgtttttatagcaggttgaccaacttctttatgaacttccacaacaaaacaaattctcaataaattcgctttgtcaaccgccagagtttcttaaagtgttcagtgatatgcgttgtttggtgggcgaaaaagcagtttttgattgtgtgcttttgggttctccacgccccgagggtgattttcaatttatatctgaggcattatgcctaattatgcttaacttccag

SEQ ID NO: 66077 - DNA, 837 bp, Heterodera glycines
  Genomic contig location: Contig_ID=SeqID_36863; Location=542..1378; Strand=-
  SCN-specific regions: Sequence locations=1-57,94-99,121-209,243 -303,325-495,536-585,607-837
atgaccgcaacaatcacatggaattcaccaaagaaaaatcatgggcctgaagtattgaataataaaaaattatttaaaatattttaatttttagcaatattttcttttgttcgcccaagaaccggcaccgcaatttcagtattggcgccgttttgaaattggaaaaagcaaacgattcactctgactgaccttagccctgacacgaggcaaaaatttataattttaatatatttgataattagggctgctaattttatgtaaatacatattttttttcctggtttctccatagcctaattagtaggaaaaacactttcttttttgtgtttgcgaacaaaagttgggacttttatttacatatttttacatattttcggatttttctacatattacatatgtacatatttttatacatattttggactttttcgtacatatttcgcaatttttcgtacaatttttcatttttttacatattttgaggatttttgagaatttatagaaattttttgtaaaaaattaaaaatttttttgttgaaaatgtatccctaaaaatcgatttttttcaaaaaatgatatatcaaaaattaatttgtaaaatattcaaatgtgattctaagcctattttggtcatttttatggcattttgtgcctatttcacttacgaagaatttttttccaaaaaataaccattaaaaaaattttatttacatattttcctacatatttgaggatttttgtacatatttcatacatattttagcattttttatacatattttatttacataattcgcaaattttcttacataaaattagcagccctataaataaa

SEQ ID NO: 66078 - DNA, 118 bp, Heterodera glycines
  Genomic contig location: Contig_ID=SeqID_36863; Location=1..118; Strand=-
  SCN-specific regions: Sequence locations=1-118
ttttgaaagataaataccgtaaacagtgactaattactgtaattatggccgccacaattgcgtcccatgcgccccaaatgaaacaacaaaatgtgcagattgctgaagaagaaacatt

SEQ ID NO: 66079 - DNA, 368 bp, Heterodera glycines
  Genomic contig location: Contig_ID=SeqID_36864; Location=473..840; Strand=+
  SCN-specific regions: Sequence locations=1-368
atggataaagttggagagggacactctttgggcgggcatcgacgcgatcctcgcggacgaacaggcgtacgagccgcggtacaaagaggcggcggacgtggacccggtaaattgggggggggggggcgggcggtgattagacttgtttatttaaatggggacgcgagcgacaaaagttcgccgcaaaaaaatatccatagtttttgcaactcgttacaaaggcaactcatataaaggcttacaattagacttgcttgggcctaggggtgcacccatttaaattacataataaaatttcaggaaagaatgcgaaatttctttcattttattgctactaaaattataaattttctaaaaagggttttata

SEQ ID NO: 66080 - DNA, 1273 bp, Heterodera glycines
  Genomic contig location: Contig_ID=SeqID_36865; Location=418..1690; Strand=+
  SCN-specific regions: Sequence locations=1-154,208-330,352-369,433 -470,592-868,916-1041,1063-1248,1271-1273
atgcaaaatataagggaatgctttttagtaatcaccaatataaaatgcattctccaatttgtcttttcacttcttaccattttcttaattcagcaagtaattgcaattattttccgttaatgggcaaaaacaaaactcgtcacttttcagggccattaataaatgaaaaatttacaacaatattttttattttctttttttttttttgccttcggttttctcttattgattctgcgcaacagtttcaaattcatcgcaattaaacagtccaatttattattattattattgttctgttctgttcaaattgcagcagaagtgatacaatcctttagaaaatgaatggttttattgtctaaaaaaatgcagaaatattttaaatttattaattttttgatgaataatttaaataaaaataaaaaagattaaaaacccttttgggtttaggactaaaaaatgcacggtaaaggatattttttaacaaattttaaatttatcttaaatattttttaacaaaaaaatatcttaacagttttttttttatattacgacaaaataaattattatttttattaactttaacaattttttcccatttatttttctccctttagaaatgccgtcattttttgccattttttcattttcgttgctgttcattttgtgccatcattgttcatttgccgcttttttgatcaccaattatccaaatccgttaaacaacgcttcgctgtggaaatgcggcatttcctcgccgggccctttgtgcgacccggactcgctgctcaacgaaacggcacggcacgaggcattggagcttttgaagcagttccaggaccaaacggacattgatgtgggagaaacaatgaaaaaaacaaaaaaaaacatttaaaataatgatatttaaatttaatagagcggatttctcgtttttattgtattttaaaaatccaaacattatttaaggaaatcagaaaaattaaattaaaattccgattattatcatttgtcacatcaaagaaatttaaatgttgaaaaaacataaattattataattttattgaaggacaatggcgatggcagctgcaaaggcaaaggagtgattgttgggttggcgctaacgaaacagccaatcattgcgagggtattaatttttaatttaatgaccaaattaccatggaagtcgatactcattcagtcttcggacttatttggcccattccgttttatcactcctttacactgccgaacaaaatcaaaaagcatattttaa

SEQ ID NO: 66081 - DNA, 854 bp, Heterodera glycines
  Genomic contig location: Contig_ID=SeqID_36866; Location=1..854; Strand=-
  SCN-specific regions: Sequence locations=1-194,218-360,382-854
taattaaatcccttccttcgggggaccgtgccgggttccgcgggggtaagcagtgctggttcggtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaa

SEQ ID NO: 66082 - DNA, 505 bp, Heterodera glycines
  Genomic contig location: Contig_ID=SeqID_36868; Location=145..649; Strand=-
  SCN-specific regions: Sequence locations=1-100,122-300,322-427,449-505
ttggaaaagagcgcaattattggtccaaccgatggcaccgattcgtccgtcacaattcaattcgttacgatgagtcagtgtgacaaatgccgtttatcatcattaattcatttccaattcaggcacactttcaccattttgggctgtgcttctcaaggaacagacatacctggtggaaattatggtaataaggcacaacaaacaattaattgggttattttaaatttcgggtggcgatttgtttcgtcctcttgccaaaacgaccccccccccccctccctcgtaccgctttatcttcgccacattaaacttttttgttttggagagacgtggcgtggtgagtctgaaaatgggacagtgcgaatatttgtaaaacaaatttgttttcaatttcgacaaattttcctttcttaaatgtgtcgctaaaaatgatttgcttttcagttgaataatggacagaatcccaatgaacacgtcacttttatgtgcgatgaaattaagcaaa

SEQ ID NO: 66083 - DNA, 143 bp, Heterodera glycines
  Genomic contig location: Contig_ID=SeqID_36870; Location=534..676; Strand=+
  SCN-specific regions: Sequence locations=1-143
atgaattcggatgggatggattgtgacgagatttgtgctttggaagagaaatggaggcgaatgaacgaatcaaaaacaaaggacggcactgaaatgggaagaaagaaacaaacgacggtttttggacgctatgagtggacact

SEQ ID NO: 66084 - DNA, 1012 bp, Heterodera glycines
  Genomic contig location: Contig_ID=SeqID_36871; Location=228..1239; Strand=-
  SCN-specific regions: Sequence locations=1-35,70-275,297-610,634-1012
atgcggtcgatgaaatggcgtgtgcccggtaatcgaaaaaataattaatataaatttaaaaatatttttccaacaaggtgtaatggccaaatttgtgaccaccattcaaatttggcaattcatcatctccgtcgccattctgtgccacctggggtggcttgttttcgtggaaaaagtatctggtttaaaaaacaaaacattccataaaaaattaatttcgtcttttttaaggttagctgtgacttggacacgagagtgttcacttttgctgtcgcaatggacggtatgcttttttcttactgttgttaattatgttggtgtacggtaacgaaaaccgagagaaaaatgaacttgtaaacaatatttggccattaaacataatgttaattttttaaagttatttgtcaaaaaaatttttggtatgggaatttttctacaaatttctgtccaaaaatgatcagtttgtgggcataaattaaaaaaacttctaatgaaattttgatagacatcattagataaatttcaatcaataacttggtttttatgaaattaggtccaatttaaacaaaaattaactagttttgcataaaaacaaataattatatacgactttttaaaaaaaatttaaaatttccttcatatacagtatcgtatctgattctgttcatcaacttcttcctccacgcctatgtgtacggtggtggcaagtccaaataccgtagtgctgatcagaaactgaatggttcttcgctggctgatcagaagcagcccaatgtggacaagcagcgcaatggcaccattctgctgatgggcaacaacaacaatgccaatgaggcgacgccgcgaagggatggctgatcagtgcaagtgatcagcagaaagtcattggatcaacgatcagaaaaaggaaatgccacaattttggaagctattgaccaaaattgaattaattcaaaaggatttgattattatgatattattgtcggctcattttaatagattacccaataaa

SEQ ID NO: 66085 - DNA, 469 bp, Heterodera glycines
  Genomic contig location: Contig_ID=SeqID_7826; Location=178..646; Strand=-
  SCN-specific regions: Sequence locations=1-18,41-62,87-237,294 -428,451-469
atgccggtagttgctgataacttaatgagttaatatttttcgttatcttttttcactttttcaaaattatgttaataaaaacaatcaaaaaaaatttcggcggtgcctttcggtactgtttggcacccaaattatttatctatctaacgaacaataaaaattaagaaatttaaacagaaaaacaaaaaaatatatatgttttgttaaaaaccatcctggtctgattgcaagaaattctttataaaaatttaaatattgatttaatttttactactttttaatattctttaatagtcaaatatatcaaacttgtcaggttaaattctggagttgcacgggaccgggaattttgacaaaaaccgggaccggacttaccgggaccagaaaagtcgagaccgggacctcagttttcgtccgggtccgggaccgtgaaaaagccgtgaccaaccgggaatttattttccaatag

SEQ ID NO: 66086 - DNA, 279 bp, Heterodera glycines
  Genomic contig location: Contig_ID=SeqID_7826; Location=1896..2174; Strand=-
  SCN-specific regions: Sequence locations=1-21,45-67,111-129,151 -161,183-218,244-279
atggcggtcctggtgagttatttattattattattattattatttaatttaataagtaagtggaagcaaaataaaattaattttagatgataattatttcttttataaatcattcatgtagatcccatgatttgttgaatgaatatgagcattaaaatctgtttttttataatatttaatttgtttgcaattcgaagaccaaaaactaagattgtttcattaatagttcattcaaaattaaatttattcttttgccggttcattagtttagaaaataaa

SEQ ID NO: 66087 - DNA, 705 bp, Heterodera glycines
  Genomic contig location: Contig_ID=SeqID_7827; Location=344..1048; Strand=-
  SCN-specific regions: Sequence locations=1-12,153-223,245-319,360 -390,412-570,606-652,693-705
atggtttgtctgttttttttaatatttttattttatatggaatgaaaattaaatcctaagttaaaaaattaaatttatgagttaattgtattatcatgttatttctaaaattaaattaaaataaatatacattattaggttttataaattttgagttcgttttttctataacttccttttatcattttgatttatcattacaaataattgagaaaatatcctgtaatttaaaattttttaattacgataataataaacactgtttttttaatttctataattcatttcaaattcaataaatttgctcttatctaattggtttttataattactaaaaaaaaatatttttaagtatttttcatctttaaaaatgataattagcttatccaaacaaccaatacacatggaactgccacttgttacttacttaattttttaattttatctattactactttattaagatcggatatttatttgaaatccacttgtagagtaaagaacagcaaccaaaaccaagaaatggtctcaagaatttattttcatttatcttacaacttttaatctatgtatatttttaattttagcataaattattataaattcgtttatatgtttacaaatcttccattttcaagttaccggaattatcttttttattatttttaattattatgctttttaaaatttttgcgcttgaataaa

SEQ ID NO: 66088 - DNA, 499 bp, Heterodera glycines
  Genomic contig location: Contig_ID=SeqID_7827; Location=2037..2535; Strand=-
  SCN-specific regions: Sequence locations=1-168,190-425,451-499
atgaacacacagagatttgcagttgggcctatccgagcggtgggtcgccaacccttctcataacaatcgaattaatgttattggaaaagcttggcccatatgcgttcgtcacgtaaccctaatttttcaacaagaaaaaaaacactccttaaatttagttttggtctttatcaagacttaaaggaggatcaagtgataaaaaagagaattgtgtcacttctttattgataaacttggaaaaataattgatgtattttttggtaattggaaatttcgcaaatcatccatcatctcactggcatcacgctgggaaatatgtcctcttctcttaagaaagtttatcaaagaataccagcataaaatgaaaacgggaaaagcaatgagatagtgggcaagcaatagaagttgtatgaggaagttaggatggtcgcttttgttttcaaatgttaatacctgtagaatgttaattaaagagcctaaaaagacacaatttaataaa

SEQ ID NO: 66089 - DNA, 369 bp, Heterodera glycines
  Genomic contig location: Contig_ID=SeqID_36875; Location=252..620; Strand=+
  SCN-specific regions: Sequence locations=1-369
atgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgataaaattatcagagtgccgaaaatcgcatgtgatctaagcctagcaaaaaatggt

SEQ ID NO: 66090 - DNA, 414 bp, Heterodera glycines
  Genomic contig location: Contig_ID=SeqID_36875; Location=765..1178; Strand=+
  SCN-specific regions: Sequence locations=1-414
aaaatggtgtaagtaaaaatcgtaattacgctcaaaaagctcctcaaacaattttagcgcttccaattccttctacaatagcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgctcccattccttctacaatcgcctttatacatcccattatgagcgataaa

SEQ ID NO: 66091 - DNA, 673 bp, Heterodera glycines
  Genomic contig location: Contig_ID=SeqID_36876; Location=138..810; Strand=-
  SCN-specific regions: Sequence locations=1-438,460-631,655-673
atgacaagcacggaggtgcacaacgtgatcgcattcggtggcatggccagatacgtggagaagaacgtcgaccgaggttttgtgcacattttgttggggattttatacaattttttctgcaacagccagctcacccgatttaaaaatttacgttatttttttctttgctaaggaaccgtccgatttagggattttactttttccttgctaagggaccccatccattttaaatttacgtttttttttgctaagggacccgtgtttacttgaccggacgtcttcactacactggcggtcagctgaacgcggacgggtcgcgctccccgcgcatttgttcagtcaacttggagagcatctacccgttgtccaagccaggtgattgctaaactctatgcaaaactttaaattaaaaaaaaattgtaggcgcgatgtacagcctcggcggcggcggtggtggcgcttctcgcgaaggtgctgatgacgggcttaaggattgaatgaatgaaatgatatcaattgttttgttgttgatgcggacaatatacctatgtgttgtacgcgagcccaattttttgatttttgataaattttgacacaccaaaagcaaggttatactttgtcaaaatgtggaaaaataccatatttccttttgttaagtcctattttcaataaa

SEQ ID NO: 66092 - DNA, 2602 bp, Heterodera glycines
  Genomic contig location: Contig_ID=SeqID_7829; Location=234..2835; Strand=-
  SCN-specific regions: Sequence locations=1-44,68-630,652-676,707 -826,848-1390,1418-2602
atggacgccttccaacaatttaaaagggaggatggacaatttcgtcatccattcacaatgattgtgtctgggagcacaggaagtgggaagtcagagtggataatgcgtctgttgcgaaatgtagacaaaatgatctctacccctgttgaacgcgttatttatagctatggtgagttgaacacaaatgtgatgaatctgcagcgcgccggcaaagttggcaatgtgccagtcactgtacacagcggcgtcccacgcgcggaacaagtgcgggagtgtgccaaaaaagtaaaaaccttgctggtgctggatgatttggtggtgggtatgagtcaacaatatttggacgcactcttcacccgtggctcacacaattggggcgtcagtgtcattttggtaactcagcacctgttcaacaaagagctgcgtgtggcgcgcactaattcacactatttagtattaatgcgtaatcctgcgggggcgttgcagatacgcaccatcgccacccacctcttcccgtcaaggactgcccattttattgaggcctaccgggacgcatgcgcaaaaaattttggataccttctcgtggacatgcacccagagagtccggaagagatccgccttcgaacaaatatatatgaacaaaaacaaatagtttacctaccaaaatgaaagggtcacaaataataacaataaataaatgctttttggagacactgtgtaatgccaaaaaggcgaaagcccttattcgatatgcatccgatgagcaacttttgtgccttgtcgaaatctgcctaaacattctaaagggccgagtccctttgcgtccccggtatttgaataagctgaaagctcatgcacaggtgcttcgtcgtctcgcccgcacacgctgctcgcgctctgccaaaaaggttttgctacaacacggagatggcctcccagctattgtggggctcattgcgtcaattgctctcccgcttattgctgatgtcattgaaaaatataaatagtttccaaaaaattaaaaacaagaaaaaatgcagcatacaaagcgctatttgttagtccccgaagagatttatcagagtttggcagcaccgccaccatctgacggaacaccaattgggctggtccgtacccgaattaaacaaataaaaaatgatgccgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatcttaaagttgggcgtgcgcaaaaagaaaatgttgaacaattagaagatactgatgatgatgatgattatcaaaacccacggtcgtcaagttcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggccaatccggcaaaggaatttataaaaacaccccacttaagtttaagccatcattatggatttgaaaaagcttcgcttgctcgagtttttgtacaaggacctaagttcgcctgtcgcattcacgagcgttgaaccgctgctgagagaggcgcggaaaagtcaaccaaaaatcaatcgaaacgatgtccaaaattatttgaccagccaacgtacatacacactgcatcgccaggcgaagcggcgctaccgccgattgccaacattggcgcccggcttgcatactgaatggcaggccgatttggctatttttgaccgaatcgctaaacaaaatcatggcttcaagtacttgttagtctgtattgatacccttagtcgacaggtgtttgccgagcccgtaaagaccaagacgagcgctaacatgatcattgcctttgatcgtatattcaaaagatcaaaatatatcccgtggaaggtgttaacagatcagggaaaggaattcactgcccgggcagtacagcagttcttccgcacaaaagacgttgaacacttttgtatgctcacttctccccaatttcatgccggaatggcagaacgtgcgaatcgtagcatcaaagagcgcctttaccgctacttcacggagcgtaacacgtacaagtggattgatgttgtgcaagacattgtttgcgcaattaaccactcgacaaattcgagcattggaatgtgcccagcagacgtgaactttaaaaacgcagaagcattgcgacaaaaattacatgatgccgttgaaaatgttgtacgacgcaagccaaaataccgtgtgggagatcgcgtgcgcattgaaaagtacaagcacgtgttccaaaagggttacctcccacgcttcaccaatgaacttttcacggtggcagag

SEQ ID NO: 66093 - DNA, 1058 bp, Heterodera glycines
  Genomic contig location: Contig_ID=SeqID_7829; Location=2898..3955; Strand=+
  SCN-specific regions: Sequence locations=1-42,64-166,188-462,484 -593,617-657,679-1023,1051-1058
atggacttacaggacgccaacaaagagaacaaagagccaacgaaaaagcaagaggaggaggcagatgatcccagttggatcagcctcattgacgaggagatgaagcgcgagccgctcgctccaattggtgaggagacgcccgcaacaagttgcttttgttttaaacgtatatttaaatttaaatttaggcactccaaaaaaatgtgcatgtgccgaacgccgtcgccccgttccgctcgtggaccacctctgcaagcggttcaaatgcaacgcccacgagctgcatgtgcttttcaaaagcctagagaaacgccgggacattgtgaagcatttgcgctccgtccaactgcgcaccgcccacctgcgcccgtccgtgcgcaattttccggtccgctgtaatgacctgtccatcctggacacccactcggcccccgcgtaccgaggctacctcggcataacggtatttttatttgttttgtttgtcggtaacaaaaaatttaaaggtccggatgcactattacataaaacatggcatccgcttgcgccaccccaacttgccatgcgtcgttgaatttggaggcggagatcacaaaacttttttccctcttgaaattttgtccattgttttgtagatgtgttcaatttccaattgtactgttgtttttaaaataaatgttcaacctttatctcgggagcaatttttggcaattgcgcagcgtggcgtaaacactgagtacacaaccccagccgcttccacgcaatcatcatgcgcatacgtgcaacaacaacgactaaaactgtggcagcactggtcttccaatcggcgcgtgtggtcctcaccggagtgccccacccaagcagcgacgtagaacaaggaggcgtgggaattctttaagcaaatggtgaccacctttcacagctactgtgccattggcggttgggcccacggcgtgcgcctgttgttgcaggagttgcgcaagctggcaacctctgcggcatcgtccctgacgctgacgtcaaattctctgaagccaccgccgcagctcccattcagttcg

SEQ ID NO: 66094 - DNA, 247 bp, Heterodera glycines; identical to SEQ ID NO: 62022
  Genomic contig location: Contig_ID=SeqID_36882; Location=508..754; Strand=+
  SCN-specific regions: Sequence locations=1-217,239-247

SEQ ID NO: 66095 - DNA, 346 bp, Heterodera glycines
  Genomic contig location: Contig_ID=SeqID_36889; Location=711..1056; Strand=-
  SCN-specific regions: Sequence locations=1-130,168-294,316-346
aatgtctctctcttcgaacggattgtctccattttatgtgtttttggtgtcttcgtcggactgttcgccttcctctggtcactggtcattctgtttgatttgttctccggttgggagaataaacctcggtgggctcttccggcattggcattttccactttttctttggcatcggtcgccgctgtcatttatttgttcagaggatgcagcgaaaatgacagtaatcatttaaatcaatttgacccaattaatcgctttggcctggtcagacttcgtctcccatttgacctcctccccgtcttcgccttcgtcgtctcccgtcgcaaagtgttccctccactacagt

SEQ ID NO: 66096 - DNA, 971 bp, Heterodera glycines
  Genomic contig location: Contig_ID=SeqID_36890; Location=286..1256; Strand=+
  SCN-specific regions: Sequence locations=1-195,217-380,404-682,704 -872,903-947,969-971
  Gene Ontology: Mol. function=transporter activity; Cellular component= membrane; Biological process=transport
gcaggtatcagttctttctccaacttcggcacgacattcaaacgggccgtttggactgtcctcgagaggctgtgatcgatttggctgcattggcattgcaatgtaatcgctgatcagagaccttaatgccaaaaatggtcactcactttccatcttatttagccgagttcggtgacttcagtcccaaagagcactccatggaatttgtgtcagaatttcgctttcacccggcccaggacgagcacatggaacgcgacattttgcacagctatgccaccaaatgcagcggaatgtcgccctcccaggcggagttggcatttctgaacaacgcgcgactgttggacttctacggggtggacatggtcaaaaaacaaacattcataaattaatttaatttttaatagggaaatcctgtttttttttgtaaattagaaaaaatgccattttcagcatccggtggagggccgtgacgggaacacctaccgactggggctgaccccggtcggcatgcaagtgttcgacgggcgccagaagatcggactgttcgtgtgggaaaaaatccaacggttggactttcgtggacgaaaattgaccctcgtggtggaggaggacttggaacagccggtgagccaaatatcgcaattttggggggtttatacagtcagaaggatgcttatccaatttcatttaatttttgaaaatttgtccgtttttatcatgagagtatcctgcaatgtatgatagtctgactggtaaatgctcgagtaatttgccaatcccggtggatccgatcagtcctttcgggattagtctcgactcatttctccgtccaaataacttctaagaggaattcaaatctctttaatacatccaaaataatttattattaattttctttaattgattaaccccaagttgccatttgctttcttatctgttttcgttttttggcattttccctcttttcccat

SEQ ID NO: 66097 - DNA, 885 bp, Heterodera glycines
  Genomic contig location: Contig_ID=SeqID_36891; Location=118..1002; Strand=-
  SCN-specific regions: Sequence locations=1-141,190-362,384-470,494-859
atggcctatgattatggaggctttaagtctgagagcaattgttcatgccccaattcgcagcttattgccaccaaattcattgtggtaattaatcattgtatagatggttcaattaaaatgaaagtgacaaaagacagcgactttaatattaaattattatttttatttattttaataaaattttattttcgcgtttaggctgaatatgactgtgatgatgatcatgatagcgcaaaaatattgggtggaatgcgaaagatcaatcgtgcgggattgtccgccttgaccggcctcggcctttcaagcccgcgacagagttcgttctcaatgcagaagaggaaatatgcggaggtatagaattgttttatatttgtttgtattcattttttttaaacgaatatttaatccaaaatgtttgataattcagtttaaactttaattagatgttgtccaaaagagtttggaggtgcaattcaaatgtgagcagtgtggccaaattgtgcacaaaacctacgaaattcgccagaatggtaccaaatgggacactttcggccgtcacacggacatacatccggtgaaaatcagtggacccatttacaaccgaacctacgaggacgttgagcgcatttacgatgacatgtggtcggactacagcgtgggcaccagaaacaccaaggattgggtggaggaaatgatccatcgtctttaagaagagatcaaaatgatcgggcaaattatgccataattgattgccctttgggccgaattcttatggaaaattaacatttattcattgcgagttacatcaacgaatttatgacattttacattgccatttgcgcttttgagcttactttgctttgtttattttaacaaaataataaa

SEQ ID NO: 66098 - DNA, 133 bp, Heterodera glycines
  Genomic contig location: Contig_ID=SeqID_36892; Location=728..860; Strand=+
  SCN-specific regions: Sequence locations=1-133
atgactgaatctgacgaaggcaccaattgggttgagtctcatccgtgccgatgtggtgccaaaaattggacagccagtcacatggagcgtgtgatggtcaaactttgctgcggtagcgaagaagtccaaaact

SEQ ID NO: 66099 - DNA, 676 bp, Heterodera glycines
  Genomic contig location: Contig_ID=SeqID_36893; Location=417..1092; Strand=+
  SCN-specific regions: Sequence locations=1-544,580-621,650-676
atgaatgtaattcaaagtaaaactgtaattaagaagaaatcccaatggaaaccgctggagataggaagtaagtctgagagattaaggaacaaagtccggaactttcagtccaaaacgagattttttgttcagcaacgaaaattccggacccagaagaattgcctttcggaattgtacagactgcattccgagcttcagatcggatgcgcacgacctcagaagattcggccgagtcttttgacgcctatggaccggagtgggaagggaagggacggggaattgggaacagaagggaattcagttcgccaaatatgaccagttcggggagacgaatgagcatcacagaacgcttatttggacgtccagtgccccaagaacgaagaaactcattgggagaggaacaaatggggcaggaaaagccgaaaagcatcgcggaggtttattcgctaattattctccctgtattctatttctattacagaacaaagacttcaaagaattaatgaagcgtcagcgaaaaattttgggcgatgatgagtggcaataaagaaaggcaaaagaaaagaagccattagaggaaaacaaagtcggaatggatcaaagggtagaaaagggaatgacaatttatttatttgtttatattatttaacacttcttctgatttttcaataatgaa

SEQ ID NO: 66100 - DNA, 582 bp, Heterodera glycines
  Genomic contig location: Contig_ID=SeqID_36896; Location=878..1459; Strand=-
  SCN-specific regions: Sequence locations=1-144,170-171,234-536,558-582
atggccttggccgggtttgacacgtcaaaagagaaaatgccggacaatccgtgcgataccatgctgatcaatgcattaataatggcatggtaagtccaatctggcattagcatctatttaattttatttagcagaaaagagttgtataaaatggaaaaataaaagttatggattaattaattttttaaacatttaaaattaatttaaaatgaaaattaaatacaataattattccttggttatataaggcttattattagtttatatattttttgattgtttaatttcttaatcaaattaaaggaaaaagtttgatgacaaagacgcaattattttaattgtcgctggtaaattataccgagactatgagcaatatcagctgaattatttgatggaaaatgttggaaatgttaaattggcgttttgacctttttaattattttcatatttgtactttgttctccacgccctttccccccttctcattgtgtttataaggagaccattcccctcctttttggtccttccctcattcattcgtttttattatatttttgcattgtccaccgaccaatcaataaa

SEQ ID NO: 66101 - DNA, 528 bp, Heterodera glycines
  Genomic contig location: Contig_ID=SeqID_36897; Location=28..555; Strand=+
  SCN-specific regions: Sequence locations=1-222,263-528
tcgaatgaacgacgaaacggacgaagtgaaagtgccaacggcgacaaaaaaaagaaagtgaaagtgaagaagggcccggccgactgtacgacgcatttgcgcaagcggaattggtggcggaacggcttaaattgttggactacgagcgcgaatttgtgcccctcggcgacagccttaaaccaattccgaggcaaatgccgatgaatgaatgccatgccaacgaattattttttgattttaattgtttttttaattatttaatgggtcagacattacttcgccctctccacaaacattggcgagcagttccatttgttcaccagcctttgcgcgtggctcatcagaaagtcgggcgtcgatccatcgatggaaatgccacacgaatttgacgaccctaacgcaacgatcgcacaaattttggaatcactgaaagcgaaggtggcgggcggggggagacggggctaaagagaaactgtcgagactcttgaccgagcttttcccccaacaaatcccaattaggatttgcat

SEQ ID NO: 66102 - DNA, 358 bp, Heterodera glycines
  Genomic contig location: Contig_ID=SeqID_36898; Location=57..414; Strand=-
  SCN-specific regions: Sequence locations=1-150,206-358
atgaacggctacagcattctgtgtgtcatgctgctcgtcgagctggtggtcgtgccaattgtcaatgggtcacccgttgtgtaagttgtgtggtgtgccatgaaaaaatcgacaaaatttttgtgcttaatgagtttggcatttttcttgatttttaatatttatatatagaaatgtattaatttaactttttattaattaattagcttaatatttcagtaagtatcaattaggaaaaagaatatcgtttctcaaaattattgagcaaatcttgcggctaaatgttttactatttcaatattttttgacatttttagaatcaaaatttttactattttttctattcaacttttattga

SEQ ID NO: 66103 - DNA, 186 bp, Heterodera glycines
  Genomic contig location: Contig_ID=SeqID_7831; Location=122..307; Strand=-
  SCN-specific regions: Sequence locations=1-31,73-101,123-186
  Gene Ontology: Mol. function=pre-mRNA splicing factor activity; Cellular component=small nuclear ribonucleoprotein complex; Biological process=mRNA splicing
atgactgccatcggagtaccaatcaaaatattgcatgaagcagagggacacattgtcacgctcgaaaccacaattggtgatcaaagccaaacagatgaattttgactgaatatttcaggtgaggtatacagaggcaagctgaacgaggccgaggacaatatgaattgtcagatgagtgatgtgacg

SEQ ID NO: 66104 - DNA, 1037 bp, Heterodera glycines
  Genomic contig location: Contig_ID=SeqID_7831; Location=1099..2135; Strand=-
  SCN-specific regions: Sequence locations=1-205,228-945,967-1037
atgcaggcaattctaacacaaaagaaccgtacaaagcttcaacacaacgggcattcatacatttttcacaagccgagtgccgatggtgaagttcgcttttggtcgtgtgaacaccatcacgcaaaagacatccgttgcaaagggcgccttcacactaacctcaacaacaacgttttgcgtgaagttggaaaccaccaatgtgaaccaagtgcagctcgaatggaagcgcaacgagtaatcactaaaatcaaacgccgggcggaacagacaatggaaccaccagcgacaattcgctctttgtcactgcagaatgtggccacgccagtccttgcgcaactccctaccaagaatgcgatcaaaaaagttttttctcttttttttgttatgagatttttgtgcttaggtaatcaagcgtgtacgtcatgaaataaacgcaccaccgccaattccaaacacgctcacagacttaatcatcccagacgcatacaaaatgtatgggcgcaccgaagaacaaactgaacacgatttggcatttcattgaccttctgcgaaggatcaaaagttatcggatgatgacttcgcgaagtgttcaactggacaagacccaccgcaaaaggcaaagaaatatcgcgaagcagaccgccgaattctcacgatggttcaaaattatttaccactcaacaatggagaccccaatgtttttccacttgagcagcgctttaatcatctatttatcattacctttttgatcggaatttctcgaaattatgaaatgagaccgtgatttgaaacagataaaatgttatttaattttcttgcttgtttgaatagtactgtttattaatattcatactttggtagggaaatggcccaaatgccttagtagggaaatggctggtagggaagtggcggtagggaaatggctcgatccctttgatgagaagcgtcaaagtctgatttttaatgacgcatagtgacttcagaatcgaaaatttcaatacagaaatgcttttttgagctcctttttttcaaataaa

SEQ ID NO: 66105 - DNA, 90 bp, Heterodera glycines
  Genomic contig location: Contig_ID=SeqID_7832; Location=8..97; Strand=-
  SCN-specific regions: Sequence locations=1-90
ttttgcaacctcttcagaaagggggacataattggagacagggcctttaatggagacggggggattatttttcaacagatttttaatgac

SEQ ID NO: 66106 - DNA, 341 bp, Heterodera glycines
  misc_feature (164)..(164): n is a, c, g, or t
  misc_feature (297)..(297): n is a, c, g, or t
  Genomic contig location: Contig_ID=SeqID_7832; Location=1083..1423; Strand=+
  SCN-specific regions: Sequence locations=1-341
agagggatttgcagccgttggttgcttgacaaccccattcggttattcttttttttaatagatatcatttttggttaaggtttggaggggttggccatgtggtgcaaatagatgaggcacttattgcgcgtcgaaagtatcaccgggggcacagagtgcgcganatttggttgtttgggatgtatgacgtgcacaccaacaattggagtggttcgcatcgtaccagacagatctcgcgctacactcttgccgataattgagaatttgtggtggcagggtccagcatacattccgatncaatgggcgcatacatgggtggcgcaattcagccatccctgtca

SEQ ID NO: 66107 - DNA, 356 bp, Heterodera glycines
  Genomic contig location: Contig_ID=SeqID_36907; Location=669..1024; Strand=+
  SCN-specific regions: Sequence locations=1-356
ttatttttttggccttcccccaacaaaacctgtccttccgcttgtcccaaacacaacaacaatttacaagcaatggcaatgtttggcgtttggagggacaaaaaaagcgaaaaaaagagaggaaaataatggacaaaaatggaaacataatgacaattggtaactcataatctaattaattaaatattcaaatgatggaaagaaataaatgaaagtgaaaggcgtcggcgaatttttggtcatttcgccccgagggaaagagcgccaacgaaacgcgaatgaatcttcggcgcggctggtcaattgcacaagggttgggtggatggatcatcaccagcgccagcatcatcagcaga

SEQ ID NO: 66108 - DNA, 477 bp, Heterodera glycines
  Genomic contig location: Contig_ID=SeqID_36909; Location=745..1221; Strand=-
  SCN-specific regions: Sequence locations=1-448,470-477
atgagagtcgatttcaagtacgcacttgccattcaagtacgaatccatgctatgcgctcaacattcaaatcaaaaacaagatttcgtgcatttgagcatgaaccgatcggtgagaattacaaaattcggaaaaaaccctaccagcagagctcgtttttccacgatagcttttttctttggcatccaaatccaacaaatgctctattaaccttaccaaaatcgaaaggattatcaagcctggaaaaattttattaagaaaaaacttcaaaaatctcgacttttttaggttttaactaaattttttgctcaattgttttgaagaaaggagctcaaaaaacgcatttctgcattaaaaattttcgattctgatgtcattatcgttcactagaaatagaaatcactattttggcattttgtcactatttttttcactatttcgacattttttggaaaattccttaacaaaaatgcaataaa

SEQ ID NO: 66109 - DNA, 65 bp, Heterodera glycines
  Genomic contig location: Contig_ID=SeqID_7834; Location=1969..2033; Strand=+
  SCN-specific regions: Sequence locations=1-20,42-65
taaggtaaacatttatacttttaaatgataaattaatgaaattcacactaaaaatgaaacacaaa

SEQ ID NO: 66110 - DNA, 809 bp, Heterodera glycines
  Genomic contig location: Contig_ID=SeqID_36912; Location=1..809; Strand=-
  SCN-specific regions: Sequence locations=1-25,47-178,200-809
  Gene Ontology: Mol. function=ethanolamine-phosphate cytidylyltransferase activity; Biological process=phospholipid biosynthesis
gaccaagaggcccgctccccttggacatgcatttcacgttttctgccttcaactcagacaattatgcaattttctgagggtatttccagtcccgaaatcataaatattcattttcctattacaggccgagctccaacccccgaagatcgaattgtttacgtctgtggctcttttgaccttttccacattggccacctttgcttcttggaagaagctcgtcgtcttggcgattatttaatcgtcggaatatactcagaccaagtggaccaataaacagcttttcctttcaatggcatcttgaattcaattaaggacgtcaattcgtacaaaggacagaattacccaattatgacactccacgaaagagtcctcagtgttttggcctataaggtacctacgtttccacttaatgttattaccatagtaatccattctttttccaatcagcccgtttctgaggtcgtcatcggcgcccctctgtgcgttacgaaagaattgatcgaccgatttcgcattaattttgtggtgcaaggcatccgaaccgaacaccacactgctaccgaggaagcagattgttatgaggtgccaaagtgagggaacaaattggattttggcattggaattgcattttaaggcatttgggaattttcaaaacggttgattctggaaatgagatgacaacggaacgaatcattgagcggatcatcaagaacaggcaatttagtttatttcaaaaggattgacaggagggaccttttgctaaagattggaattcgaacaacgcaatcgtgcgaaagagaggaaagaaa

SEQ ID NO: 66111 - DNA, 508 bp, Heterodera glycines
  Genomic contig location: Contig_ID=SeqID_36917; Location=178..685; Strand=+
  SCN-specific regions: Sequence locations=1-50,83-87,177-383,406 -411,434-508
  Gene Ontology: Mol. function=specific RNA polymerase II transcription factor activity; Cellular component=nucleus; Biological process =embryonic cuticle biosynthesis (sensu Insecta)
atggttgctcacgaaggtgtgatcagtggccacttggacaggccgttttcgaacggcgccgccgccgccgctgctgctgtgcatcaccagcaacagcaacaacaattgttccatcaacgacatcaccaactgcaacaacagcaacaccaccatcaccatcaccaacaacaacaacatgctaaacaacacccttcctcatctgttggtgattgtggcgaagaacctatggacagcgcgagtggcgcgggcacattctgtgccagtagcagcaccatcagcaacacaaccagctcatccaacatggtggagaagtgcgagccgagcacggtggcggacgaggcgggcgaaccgatgccggcgaacattgccagcagcaacagtgggaacaacaccaacaacaacaacgccatgatggagtgcaacagcagtaacaagttggagatgggacagccaccaaatggatcaacaacaacagcaccaaaacagcacccatcaacaaggggaacac

SEQ ID NO: 66112 - DNA, 84 bp, Heterodera glycines
  misc_feature (72)..(72): n is a, c, g, or t
  Genomic contig location: Contig_ID=SeqID_36918; Location=1..84; Strand=-
  SCN-specific regions: Sequence locations=1-1,25-84
cttaagttaaaaatataagaaaattatattctgaaagagaacaaagaaagctattgaatgataccacgaaantattaatttggt

SEQ ID NO: 66113 - DNA, 170 bp, Heterodera glycines
  Genomic contig location: Contig_ID=SeqID_36918; Location=337..506; Strand=+
  SCN-specific regions: Sequence locations=1-1,25-118,140-170
cttaagttaaaaatataagaaaattatattctgaaagagaacaattaaagctattgaatgataccacgaaatattaatttggttgaatttgagccaagctattaatttaattattttacccattttttgttttcaaacccattggcagttttaacaaacgcgccagcacg

SEQ ID NO: 66114 - DNA, 306 bp, Heterodera glycines
  Genomic contig location: Contig_ID=SeqID_36920; Location=504..809; Strand=+
  SCN-specific regions: Sequence locations=1-306
atgaagaacgcgagaatttcactcggagattcgataagcaaatttttaatccaatttcgaacatttggggcttcaattcgttcatcactttcaaggcaattagttataaaacaattacaaatggtaaaaattaattaaggaattgatggacacgcgaaacggactgtacaataagaaaaatacagtaaccctgggcattcaatttactgtggaaggcgaagacggaggtgaacaacaagcgatggaagccgactgaagaagcatttcgaaacacaaagcttgaagccggacactatcagtaccaaa

SEQ ID NO: 66115 - DNA, 126 bp, Heterodera glycines; identical to SEQ ID NO: 54981
  Genomic contig location: Contig_ID=SeqID_36921; Location=396..521; Strand=+
  SCN-specific regions: Sequence locations=1-126

SEQ ID NO: 66116 - DNA, 3320 bp, Heterodera glycines; identical to SEQ ID NO: 1013
  misc_feature (3309)..(3309): n is a, c, g, or t
  Genomic contig location: Contig_ID=SeqID_1013; Location=1..3320; Strand=+
  SCN-specific regions: Sequence locations=1-158,187-258,281-285,307 -513,535-538,560-726,748-838,873-895,917-1097,1120-1230,1252 -1412,1434-1515,1544-1668,1691-2228,2256-2723,2745-3080,3102 -3105,3127-3320
  Gene Ontology: Mol. function=ATP binding; Cellular component=nucleus; Biological process=signal transduction

SEQ ID NO: 66117 - DNA, 894 bp, Heterodera glycines
  Genomic contig location: Contig_ID=SeqID_1014; Location=135..1028; Strand=+
  SCN-specific regions: Sequence locations=1-148,173-633,655-894
atgtgccgccgtcggcggcaagggcgcagccgcctcaccgccaagcagcacaatgttgctggacgtgccagtggttgttgttggccggcacgactacgacacgtacagagactcggtggaacggctgaaagacaccggtaagcaaagcaattaattaaattaattttataatccttaattaccctcattaccgaaaatatcctcacttaggctttgagcttggcctgttaaatgtggaggcggagacggaacttgtccaactgcggccgcacattcagcaaatgatgtgtgaacaccaaattttgccgtacgacccgggcccggactggcgctttctcgactgtgagtttaattctgaaaactcagcgggggtccggcacccgagtcccaaggggtggcattgatcagcggcattttggctagcgatatggcctgctttttttaaattttgcctcacaaattccgtcaatgccttttctcagatgtgtccaacgcggaggagggcactttccgcgtgtcgcgtcaccaggagcagagtcggacggtggccgacgtgtgcacattggaggcggaggagggcaccagcagcagagcgggcattttcattttggacgacgctttcccttcaatgagtgcccgggcggcggccatcggaggacacgaattggtgttcacaccggccaaaatgaggtgacatccaacaccactttcgtccctgatttgaaaaatagagaaaaggacaaatcattttccctgactcaaacggtccccggttttccgattgatcgggctcagattttgatcgatgttcgagccaaagcattttccttggcattctcccgatctctgattatatatggtcccgaatcgactttgatctggaaattaccttaa

SEQ ID NO: 66118 - DNA, 252 bp, Heterodera glycines
  Genomic contig location: Contig_ID=SeqID_1014; Location=1604..1855; Strand=-
  SCN-specific regions: Sequence locations=1-160,183-252
caaagctgcgtgaagtcggcctgcaaaagcacttgcggcgacaatttgtcggaaccgaagtgcacggaatgttacgacaaaccgcacgaatgtgcgccaaaataacagaggacggaatgccaaaacttgaaatggaaacgaatgacaattaattgaggatgaggaaaaggaaaaggagcaaattaatcggaattaaatttaattatttttcgtattttaatttgtggaattcaaagaaaatgattaaacaat

SEQ ID NO: 66119 - DNA, 2930 bp, Heterodera glycines
  Genomic contig location: Contig_ID=SeqID_1015; Location=80..3009; Strand=-
  SCN-specific regions: Sequence locations=1-83,105-383,440-661,685 -1805,1829-1850,1872-1946,1968-2042,2064-2072,2094-2168,2190 -2248,2272-2531,2553-2666,2693-2817,2843-2930
  Gene Ontology: Mol. function=calcium-dependent phospholipid binding; Cellular component=synaptic junction; Biological process=synaptic vesicle targeting
atgaacaaagcttttgcgaccatcgttctgctcgttgtactgctcgctgtcgaggtgcagaacagatcaagttggtgtaacagttttttctcagcaattttctttaaactttccatttttagtcgtcaagcgcgccaaccagcagaacgcatatggagacgagccggtggtgccctcgggtgcgcatcaggcggcaccggcaccagctgagcaaaacgcgccaaccgtgcagcagccgagcccggtaagcccgccggagcaagcacaggcaggcgctcagccgagcccgaacgctgcccccactgcaacacagccgcaacagggcgaagcagcagcggtaccgtacagcggaggagcgaacgcgggcgcacagccctcaaagccagcagaagcggcagcatcggccccagcagcagctgaacaagcgccagcagctgcacccgcgcaatctcagcctgcccaagctgcacccgcaccggcaacagccgaacaggcacctgcatctgcagcacaacccgcagccggcggatacgccgcagccaacgctggtgaacagaaaaaacctgcggaatctgcccctgcaccgtcagcggctgaacaggcgcaagcggctgcaccagcacctgcgtctcaacctgctcaatcagcacccgcaccagctgaacagccggctgctgcacccgcaccggcagcggccgaacaggcgcccgcagttgcagcacaaccagcagctggcggatacggcggagccaacgctggtgaacaacaaaaacctgcggaagctgcacctgcaccggttgaacagccagcagctgtgcccgcaccagctcagcctgctccagcacaacccgcaccagcccaagcagcgcctgctggatatgggaatgctgccgaacagccaaaacccgctgaggctgcccctgcacctgctgcggctgaacaagcgccagccgcagcgcccgctccacctcaacctgctgaatccgcgcctgcaccagctgcagctgagcaaccaaagccagcggaagcagctccaacacccgcagcgcaacccgcagaacatcccgctgagtctgcacctgctcaacaggcagccccatcgcctgctgcaagctctggttacggcgcagcagccgcggaacagccgaaaccagcggagtcagcgcccgcacctgctgtggctgaacaagcgcctgcgcccgcacaatcccagcctgctgaatcagcaccaggtgcagctgcaccatcggaagtgaatattttgcatgactttttgaaagttatttcctttaatcgttagggaccaaaaccggaaactgccgagcaaaagcccgtagagcaaccgaaaccatcagaagctgtttcttatcccgcagcctcaccgcctgaggtgaatatattaaaaaaacaaaaatactttttcactttaggcgcctaaaccggcagaaaacgcgccgcccgcttcgaatgccagcccgactgaagcagggtcagcatcagctgcagctgcgccttccggaggtgccgccgtttacggaaatgctcagccatctgctggaatcccgtcagtcagtgcaccaacttcggaggtaggctattaaaattctttaaaatttttctattttttacttttcagggttctgctgctgccccgccgagtgaagccaaccccgctcaaggcgaacagccagcacccgcagcgcaatctcaagcccagcctgctgaagcagcacccgcaccagctgcagcggaacaaccaaaaccagcggaggcagctccagcaccagcagcgcaacctgctcaagccgcacaaccagctgctggttacggaggagctgagcagcaaaaacctgccgaagctgcacctgcaccagctgccgttgaacaaccaaagcccgctgaagctgctcctgcacctgctgtagctgaacaagcgccagccgcttcacccgctcaatctcagcctgcccaagctgcacccgcaccggcagcggccgaacaggctcctgtagctgcagcacaacccgcagccggcggatacggcggagccaatgctggtgagcagcagaaacctgccgaagctgcacctgcaccagctgccgttgaacaaccaaaacccgctgaagctgctcctgcacctgctgtagctgaacaagcgccagccgctgcacccgctcaatctcagcctgcccaagctccagcttctgtttacggaggagccgagcagcaaaaacctgccgaagccgcacctgcaccagctgccgctgctgcgccggcacctgccgaatccgcaccagctcagtccgcaccctctgccgcagcaggttatggcggcgctgagtccgcgcccgctgccgcacaacccgcaccggccggggcaaatgctgctgcaccagccgagcagccggcacccgcgaacgccggtggaccaagcggtgctgctcccgctccagaagcctcggcgcagccccaaccgtccgcctcggcaccggcggaacaggcaaaacctgcggagtccgctgccgccggctcgcctccgtatgcgggcggcgctgcgccaaaaacggcacccagcggttacggtgcctaagtgttgacaacaacgaggcgactggggacgactgactactgtatgggatgatggattacggtggatctcttagtggtacaaaaagacaaaaccaaaacaaatgatcagtgatcggaagagaatggagatgagtgggagagattattggctgatcgtccattactcagtttatgccactctcattttatgtcccattgattgtgccgtgcccgtctttctcccaaggcattgtttttgttcacctccccccttccttttttgccatcgtttcacattatttccaaatatttttattttttgcatttcgcgttcatttttttgtaatcattggtataataaa

SEQ ID NO: 66120 - DNA, 3836 bp, Heterodera glycines
  Genomic contig location: Contig_ID=SeqID_1015; Location=485..4320; Strand=+
  SCN-specific regions: Sequence locations=1-254,278-336,358-432,454 -462,484-558,580-654,676-697,721-1841,1865-2086,2143-2421,2443 -2756,2778-2851,2874-3477,3501-3836
  Gene Ontology: Mol. function=extracellular matrix constituent conferring elasticity activity; Cellular component=extracellular space; Biological process=cell proliferation
cggcagcggactccgcaggttttgcctgttccgccggtgccgaggcggacggttggggctgcgccgaggcttctggagcgggagcagcaccgcttggtccaccggcgttcgcgggtgccggctgctcggctggtgcagcagcatttgccccggccggtgcgggttgtgcggcagcgggcgcggactcagcgccgccataacctgctgcggcagagggtgcggactgagctggtgcggattcggcaggtgccggcgcagcagcggcagctggtgcaggtgcggcttcggcaggtttttgctgctcggctcctccgtaaacagaagctggagcttgggcaggctgagattgagcgggtgcagcggctggcgcttgttcagctacagcaggtgcaggagcagcttcagcgggttttggttgttcaacggcagctggtgcaggtgcagcttcggcaggtttctgctgctcaccagcattggctccgccgtatccgccggctgcgggttgtgctgcagctacaggagcctgttcggccgctgccggtgcgggtgcagcttgggcaggctgagattgagcgggtgaagcggctggcgcttgttcagctacagcaggtgcaggagcagcttcagcgggctttggttgttcaacggcagctggtgcaggtgcagcttcggcaggtttttgctgctcagctcctccgtaaccagcagctggttgtgcggcttgagcaggttgcgctgctggtgctggagctgcctccgctggttttggttgttccgctgcagctggtgcgggtgctgcttcagcaggctgggcttgagattgcgctgcgggtgctggctgttcgccttgagcggggttggcttcactcggcggggcagcagcagaaccctgaaaagtaaaaaatagaaaaattttaaagaattttaatagcctacctccgaagttggtgcactgactgacgggattccagcagatggctgagcatttccgtaaacggcggcacctccggaaggcgcagctgcagctgatgctgaccctgcttcagtcgggctggcattcgaagcgggcggcgcgttttctgccggtttaggcgcctaaagtgaaaaagtatttttgtttttttaatatattcacctcaggcggtgaggctgcgggataagaaacagcttctgatggtttcggttgctctacgggcttttgctcggcagtttccggttttggtccctaacgattaaaggaaataactttcaaaaagtcatgcaaaatattcacttccgatggtgcagctgcacctggtgctgattcagcaggctgggattgtgcgggcgcaggcgcttgttcagccacagcaggtgcgggcgctgactccgctggtttcggctgttccgcggctgctgcgccgtaaccagagcttgcagcaggcgatggggctgcctgttgagcaggtgcagactcagcgggatgttctgcgggttgcgctgcgggtgttggagctgcttccgctggctttggttgctcagctgcagctggtgcaggcgcggattcagcaggttgaggtggagcgggcgctgcggctggcgcttgttcagccgcagcaggtgcaggggcagcctcagcgggttttggctgttcggcagcattcccatatccagcaggcgctgcttgggctggtgcgggttgtgctggagcaggctgagctggtgcgggcacagctgctggctgttcaaccggtgcaggtgcagcttccgcaggtttttgttgttcaccagcgttggctccgccgtatccgccagctgctggttgtgctgcaactgcgggcgcctgttcggccgctgccggtgcgggtgcagcagccggctgttcagctggtgcgggtgctgattgagcaggttgagacgcaggtgctggtgcagccgcttgcgcctgttcagccgctgacggtgcaggggcagattccgcaggttttttctgttcaccagcgttggctgcggcgtatccgccggctgcgggttgtgctgcagatgcaggtgcctgttcggctgttgccggtgcgggtgcagcttgggcaggctgagattgcgcgggtgcagctgctggcgcttgttcagctgctgctggggccgatgctgccgcttctgctggctttgagggctgtgcgcccgcgttcgctcctccgctgtacggtaccgctgctgcttcgccctgttgcggctgtgttgcagtgggggcagcgttcgggctcggctgagcgcctgcctgtgcttgctccggcgggcttaccgggctcggctgctgcacggttggcgcgttttgctcagctggtgccggtgccgcctgatgcgcacccgagggcaccaccggctcgtctccatatgcgttctgctggttggcgcgcttgacgactaaaaatggaaagtttaaagaaaattgctgagaaaaaactgttacaccaacttgatctgttctgcacctcgacagcgagcagtacaacgagcagaacgatggtcgcaaaagctttgttcatttttggaatactttttgaatataaaaaagaaaatctaaatgtgatcagaaatgtcatttgtcggcttattggggatataaattaaaaaacattgtggcaccacaaaaagccgaaataggaatggcataaatcattttttggtttttgggaaagggaaaagcgctaaaaatttgcacaaaaggaggcgatgcgacgcaatgccgcgggcatttgggcaaatgaatggctgctgatcacttgagcgggggcgagtgactgatcagatagaggcgggacttgctcaatgccccgggggaaagagacaaaatttaaattggaaaaacgatcggtagaagaaggcccgaacaaatgtgcttttaaaataagaaatgttgctttttaattgcaattttgatcagaaaagcgattccgtccaaaaagcttcatccgggcgcaataaactgggttaagtattggtttctccgtcgtcccaattcgggcggattatcctcccctccaccgggggatcgtccctatcccaaacatgattgaaatgactggttgttctcctgcagctgtacagtgtttttggagggctttgggtggaatcgtcccaacaagtcatccatcccatcggcagcttttccaatttatccatccgatcacctctcactctctgtgcccccatattcggcggtggcgtccaaccggtcaaccttcgtcgcccccgccgatcacgtctttccatttccagtagcagcggcagacaattgcaaagtgatcgatggattttggtgggatgggatggactggattaagctgctaatgatgatgattatttgggacgaatttgccgcttcttcccatttgtcccatgactgccggggcggggcgaccgacggacggacaccgaaatccgccgccacacaccattcatcggcaggccaaggtgttggctaaattgatggctcacctgctgccgccgccgctgcagcactaagaccaaaatgcgggccaaatcggctgctgatcggtcggtcggccaatcgacggcggtcccagtggccagaccaacccctgccgactgacgacgacgacaggacggacagaggcggggggggggaggagggaaggaggcagagcggacttggattgtgagcattggcggggaccgcggcggtatttattccctcccgccccattcatcaaacccaaagccattaattcattcatttatgcatcattcattgaacccctcggggtttcccttgggtcggctgatgtccccagagggaacaatggaagcggcggcggagggggggggggagaaga

SEQ ID NO: 66121 - DNA, 638 bp, Heterodera glycines
  Genomic contig location: Contig_ID=SeqID_1017; Location=1651..2288; Strand=-
  SCN-specific regions: Sequence locations=1-269,291-365,387-638
atggcttcccaataccatcggctgaaccaatcgcccgtttttcggacgcccgggcttgccaagctgttcagtcagaagcaggaacaactacatcggcagcagatgatgatggccattctgaacgaggcgcctgtggacacaccgccgctgacggacgacgaggattacggtaaggaaaacggtgaagagatcacagggactgacggatacggtagaattagcaacggcaatagacagcaaaaacattgttagttatttacctttccgtttttcattattcagtttaatttctcattctttctgcgaattacagtaaacgttggagaatgtattatgggatacggtagtgcagccaattcttacattgaataattatgttactaattgataatttttctaattaattagtcgacgaaatggaggacgagtgctgttggcatcggctggtggaggaaggacagcgccaagcgccggcgaatttgcccctgccgacgaatggccacggcacggcacagccgcgccgaaactcattcagctgtgcctcaacaaatacaaactcaaattagtgctttaattacatctctctcgattttttgttgtataattttgaattttgcattttttaaaaagcaaataaa

SEQ ID NO: 66122 - DNA, 342 bp, Heterodera glycines
  Genomic contig location: Contig_ID=SeqID_1017; Location=3279..3620; Strand=-
  SCN-specific regions: Sequence locations=1-283,305-305,327-342
atgcgctttcgcttccgtcgctgtgttctgctgctgctcggcactgtgcttaccgctcttctgatcattttgctggtcacacaacggcacactgtaagtacagtatacggcagggtacggtagggcgcggcaaatgctcttccgtgcctttgacttgttaccttaggaatttggcacttaatttcccgctagcttaacaatagttcgtcatctcagagtaccaatcagcaaggcggtcattcatcaaacggagacgaaatcgggacaaatgagggtaattaatgctgattatcatcattaaaagcaattaaccaaccatttaattatcttctggccaataaa

SEQ ID NO: 66123 - DNA, 564 bp, Heterodera glycines
  Genomic contig location: Contig_ID=SeqID_36923; Location=276..839; Strand=-
  SCN-specific regions: Sequence locations=1-564
atgcttttaagccccgccgtgaggcgggacagttccaaaattttgtaccacattttactgtggaaagtccaagtaccttattggacaactacgtgtcaatgagcacagtcgcctttggcctgttgtggaacggaaaatggaaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttagcttttaattatgctgtacaatgcttttaagccccgccgtgaggcgggacagttccaaaactttgtaccacattttactgtggaaagtccaagtaccttattggacaactacgtgtcaatgagcacagtcgcctttggccagttgtggaacggaaaatggaaatatcagatggggtgcgctcttttctaaaaattcctcttttcgtctaaccatccctcccttttgtgcactatttcgtttcaaaattgaatcatttttttttgtcttttgaaataaa

SEQ ID NO: 66124 - DNA, 390 bp, Heterodera glycines
  Genomic contig location: Contig_ID=SeqID_36923; Location=216..605; Strand=+
  SCN-specific regions: Sequence locations=1-390
gcttaaaagcattgtacagcataattaaaagctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatatttccattttccgttccacaactggccaaaggcgactgtgctcattgacacgtagttgtccaataaggtacttggactttccacagtaaaatgtggtacaaagttttggaactgtcccgcctcacggcggggcttaaaagcattgtacagcataattaaaagctaaaataattttcgtatatttttcacaatttatttcaaaagacaaaaaaaaa

SEQ ID NO: 66125 - DNA, 1115 bp, Heterodera glycines
  Genomic contig location: Contig_ID=SeqID_36924; Location=28..1142; Strand=+
  SCN-specific regions: Sequence locations=1-51,289-309,348-1115
  Gene Ontology: Mol. function=protein binding; Cellular component =axoneme; Biological process=eye photoreceptor cell development
atggaaaataatgtgaatgatatagagataggcaaagttggagaaatagcagaagaagaagaagaggaagaagaagaaaaagaagaagaggaagaagaagaggaagaagaagaggaagaagaagaaaaagaagaagaggaagaagaagaaaaagaagaagaggaagaagaagaggaagaagaagaggaagaagaagaaaaagaagaagaggaagaagaagaggaagaagaagaaaaagaagaagaggaagaagaagaaaaagaagaagaaaaagcgaaagaggaaaaaacggaagtaaaaccaaaatggaaaatttaaaaaaaaattaaattaaattttaattttaagctaccaaataaaaatgtgaagaaaaattattcagaagaaaaaaagcaaaaactcgtgaaaaaactattgaagctaaaagaaaagttaaaaggaaaaattccacagcaaaaaattgataaagcatttgcgaataaagtgggaagagatttcgcaacaattcgcaaatggaagcgcgaatttggactaacaggtggctaattatgcaacgataatgtaattgatacaaaaataactaatattcagaaaaaagacgggaatattcgactaaagaaaaaggggaaattgttgagaaatttgcccgattaaagaaagcatttgccaatgaaaaatgtgaggaaaaaaagacggcacgagaaattgactcaaaaattgaaaaaataattggctttggcattgcgacaatttatttgtggaaaagggaattggccttaaccggtaataaagcagcaaaggaggggaggaaatatttgacaaattattgtaatattattccattaattaggccaataattatatcaaaataatacgaaaaatttaatttcagaaaaatgtccacgtaaaaaatattcgtcagaagacaaaatgaaaattgtgcagcgatacgacgaaatgaaggcagaaacgccgtacctccgcttgaaggacatcgccaaaatgttggaagtgccggagagaactctcatagcaatgagaagggaactaagcacagagcaaagcccaaaagcatcgagtaattaaagataaaagggcaattaagacgctaatta

SEQ ID NO: 66126 - DNA, 104 bp, Heterodera glycines
  Genomic contig location: Contig_ID=SeqID_36925; Location=727..830; Strand=-
  SCN-specific regions: Sequence locations=1-104
aggttggcttttcttctacaacatccaacggcagctacggactgttcgattggcccgagaaaatcacccgccgtttttcccctgggctatgtctgattcggatg

SEQ ID NO: 66127 - DNA, 660 bp, Heterodera glycines
  Genomic contig location: Contig_ID=SeqID_36926; Location=591..1250; Strand=-
  SCN-specific regions: Sequence locations=1-65,88-177,204-204,233 -446,468-599,621-660
atgaaaattgtatactgtaattggaaatcaggtaggttccttcacaaaccaattaacaattaaaagttttcagaaaattttactatagtaaaactctctttcgatctctcatgcattttcctctaccgtattttctcaccagcagtgagattaaatcattaaatcaataatgatcactatatatatatatatatatatatatagaaaaaaattatttttcttttttaaaattgaacagccagtgacaaaaccgtaagccaacaaatgcccgcggttaagccaaaatttcaatacgacgaattgctggaacccgtgcttgacgaaatcgaacatttaattcgcatttcaatgttttattttgacgagaatttcaaacggactgaaagttacaaattgaaaggcttttcccaattggaaacgaagccaattttgctgaacgaaaaacagttgaaatattttcaaaataattttcagaaaaattcggaagtgaaaattcggaaactttttgaggtgaaaatgagcttaatgttcaaaaatacgaaggaaaatgcggagaaggagaaggtcgaaatggaagaagaaacggacgagcaaaagtggaagaaataccgaaacaaatttttgggatttttgaattcgccattactcccaattgtgtga

SEQ ID NO: 66128 - DNA, 817 bp, Heterodera glycines
  misc_feature (49)..(49): n is a, c, g, or t
  misc_feature (67)..(67): n is a, c, g, or t
  Genomic contig location: Contig_ID=SeqID_36927; Location=66..882; Strand=-
  SCN-specific regions: Sequence locations=1-376,398-561,584-817
atgctcgccttggccgttacatcgccatcaatgaagacgacccacgccnacatcgacaaacctcccngatgtgaagctgttaacgtatcaaatggacagcgcattggtgagacatgcggtggctcaggatcttatgcgacgggagactgcagccgatccggaggaactgcagcagcctatctacttggatccggtgcaagaattcgaagcacaggttgttttatctatcctcatagaaaagacaagaaatgggtatcatctttatggtctttggtaaagggatggaacccatccctatgggcattggtaaagggatggagccctaatatcccttttcgtttcattaaaataacgacaagtgttttaaagggtggcgtcatcaccgctgatgacgtgcgtgagttaacgcgcggattgaccgctcttgagctcgatgcgaaagttagagcattgaaggagaagaatgaccggatgtatgaccaaattactgcgcgccttcgacaacagaccgacgcaattacgcggctgcgtgcgcttaaaagcgtgcgacgtcgtagaccagcagttgggcaaaccaagaaaaagacttcagtcagtggaactggtaaggaaaaagtataatcaaaaaggatggctgccatccctttagatgtgatccatccccctagcaagtggtatggggatggtttctctcccagacaattttttaaactaaatattttagttgctgccaaaagacagaagaccgtcccgagaaatgatcaggagattgcaggccgtcatcgcaaagttatcattgacgattcatcagaggaag

SEQ ID NO: 66129 - DNA, 1139 bp, Heterodera glycines
  misc_feature (1131)..(1131): n is a, c, g, or t
  Genomic contig location: Contig_ID=SeqID_36930; Location=233..1371; Strand=+
  SCN-specific regions: Sequence locations=1-550,573-719,743-823,846 -1139
  Gene Ontology: Mol. function=chaperonin ATPase activity; Cellular component=mitochondrion
attctgcgctgaatgaggaggagcctcaaattcggctggaaaaatcgaacattgtccttcttgggccttcgggagttggtcggtttttcttttttttcattctattgagtttattcgtgttgttatattattaaggaaaaacatttgtcacccaagtcttggccaggatactcgacgtacctatcgctttgtgcgattggtaatattcaaataaacattttaaatcatttaaattacttcttccatttgctatagcacctcaatgacccaagcgggctatgtgggcgaagacgtagagtcagtgctgcaaaaattgctgcaaaatgcgcaagggaacgtggaaaaggcgcaacgtggcatcgtatttttggacgaaattgacaaaattgctgccactcgtgaggcgatcagtcacgcgtacagagacgtgagcggagagggcgtccaacacgctttgctaaaaatggtcgaaggtcagcaaaacattaaaaatccaaaatatcagtaacaaaattttcaaattaaataattataaaggtatagaattttactgctttattcgcttctttgttacaatactaaatttctaggcactgtcgtaaatgtgaagacaggacggaaaggacagcaggtaattcgagtgccactttcttgttaatggaaaatgtttcattcggaggaatctgtgccgatggacaccactgacattctcttcatcgcaagcggagcattcaatggacttgagcgggtggtcagccgacggttggacaaacggacagttggatttggttggaacatcttcttaatctttgtgtagaaaacgaaggattaaaggtgctgcattgctggaaaatagcataacggacgacgacaaagaacagcaggtgatcaaccagaagcgggacaaattattcctccaagcagaccaaggcgatatgatcaaatttggcatgatcccagaattggtaacctttttgaagaatccaaatttaacggaactgcatctctttaggtcggccgtttccctgtactcgttcctttccacagctttgacaagcaaatgctcatccgtgtgctgactgagcccaaaaactcattacttgcccaaaatgaaatttcaattctcaatgngataacgt

SEQ ID NO: 66130 - DNA, 1455 bp, Heterodera glycines
  Genomic contig location: Contig_ID=SeqID_7838; Location=445..1899; Strand=-
  SCN-specific regions: Sequence locations=1-179,201-288,331-626,652 -688,710-1074,1096-1427
  Gene Ontology: Biological process=locomotory behavior
atgcgtcagattaccaaatgcatgggtggtctgcaaaacttgcaggatttgcccaccaaagtcgcactgccgaagagacttcacatcaaaacgatgacacagtacaacgcagaggtattgtttactgttgcgcaaggacgaaagccccaaaaccttacaaaactttaattgtattacccttaattttagtttccattccccattctgttccctcccgtgtcccatcaaaatgtgctcgctgaatggctcagtaaactgaaagtgtctcaattccattgcgcaggtttcaatttatcatttttaaatttatttttaataaaatgttttttagagtccgaaaagtatgcccatgtgactttctttttcaacggtggacgagaagaggcatttgagggtgaagaacacgtgatggtcccatcgccgagggttgccacttatgacaagaagccggagatgaactgtgaaggcattgcggacaaagtacgaaacgggtcatgtttagggatggtctgggttaattctttgaagaaaaaacagaaaagcgcttaaacaacaccaaatcggggtatccgcccaagcctcgaaaatcctaaatcctctgtgaccatcgctaaggcagttttttcgggagggggggggggggagggggggagacccacgatttttagagagtaaaaaacatgaaattgtttccaaaaaatgtttttggcatttcaattttcctctacttttaggtggtcaaacaaattgaattaggcaagcacccgttcatcatgtgcaattttgcagcacccgacatggttggtcacaccggtaaatttgagccgacggtgaaggcgtgtgaagcgactggtacaaatccacacttttgtttctcatttttagatttaatttcccctaattttctaagatgtggcaattggacgcattttggaggcatgcaaaagtcacggttatgtgctgttggtgaccgcggaccatgggaatgcggagcaaatgatagccaaggatggcggcccacacaccgcccacacgtgcaacaagggtcagttttcattaactgtaaaagcttaattttgaacactcattttttgcatttttcagttccgttcgcctgctcttccacctcacactccttcaaaagtgcgccgcccatcactgcggagggtgtgccccgggcgcgagcattgtgcgacgtggccccgactgtgctttaccttatgggactgactaagccggaggagatggacggtcagaacttattgggaacggcggcgaattaagagagagagagaggcaaatgaaataattattaggacgattttcactttctcctgctgttgttagaattgatgttctgtcatggacttgattggtttattgttaatttcactctgatctcgttttgaaatttattttggcgggtaagaattttttgttgttgttttgaataaa

SEQ ID NO: 66131 - DNA, 1298 bp, Heterodera glycines
  Genomic contig location: Contig_ID=SeqID_7839; Location=95..1392; Strand=-
  SCN-specific regions: Sequence locations=1-436,471-515,538-924,947 -1298
  Gene Ontology: Biological process=locomotory behavior
atgattaataatcacttagtggaaaacaaatgtgtgctgattgttattgacggatggggactgaccgaggaggaacatggcaatgccattgcaaatgcgaacacaccggtgatggaccaactttgttccggcaattggcaacagttggaagcgcatggtgaacatgttggacttgataaggagcgtatgggcaattccaaatgtggccatctgaacatcggagcgggtcgcgtgattgaccaggtttttaagattaaattaagacacattggataacgcatagtcacattttggcaatatacaatttaatttttagtcatcaaaatttttagtgcttgttgaaatgtggggacttcttggttgaaaaaaatcgtgtaaactgcaatagtgatgaaaatcggcaaacttttcccgaggttttcagagtcacatttccgaatccctattcagaaatataaaaatgtttttacgctaggcatcatattaaaataaattgctgtccaattgggtctctattttttcaaaaatttacaaaagtgccacttttcaattaacacacaaatttcaattgaataatcacaacctcattcattcataatttttctgtttaggacattattcgcatcaatttggcagtgcgcaacggacaactgattgagaacagggaagtgatcgacgccgcagaacaagcaatcaacggaaacggacgactccatttgttgggtttggtgagttttataaaaaatcgttttttattccattttctccaatcaaatacaaaaatgttcagatcagtaacgccggtgttcactcacacataggccatttgtttggtctgttgcattccttcaaacaattacaagtgccaaaagtttttgtccatttttttgccgacggccgtgacacatcgccaacgagtggaggtaaaataaaaaattcaatttaacaaatctgcgattatatatgctcccgccatttttagccggctttttgcaacaactgcttgacttcttaagtaaggaaaaatatggcgaattggcaaccattgttgggcgttattatgccatggaccgtgacaatcgatgggagcgaattaaggcactcattttcgaaaaaaatatcattttttggattttcatttttcctaaaggttgcctacgaggcattggttggcggagtgggcgaacagtgcgaaccggcgaatgctgtacaattggtgaacaagcgctacgcaatccaagaagagactgacgaattcctgacgcccatcgtgttttcggacgaagcgcgtgtgaaag

SEQ ID NO: 66132 - DNA, 517 bp, Heterodera glycines
  Genomic contig location: Contig_ID=SeqID_7839; Location=1577..2093; Strand=+
  SCN-specific regions: Sequence locations=1-193,236-316,338-352,375 -424,449-517
atgacattcttttttaccaattccgaatcacgaagccgagttcgaacaaaaagtcgaaaattcaaaacttttttgacttatcatttgctattgacataaatagtgtattttagggaattgcatctcacagagtcaatcaaatgccaccggagaaggataaagcggccaacattgagccgacgggttccgattaccctgacagtgaagatgaaagttatattttgtttatttaatggtcaagatttattctttttttcattgtttagtggcaattttggaatggtttgacaagccgatcagcgaagacattttgaacctttctgtaattttactatttaaaaaaaatttgtgtacattttggtccattcttttttagaaacatccaccgccacaaaacaaaattcacaatctgcaaccggctcgcgaaaatgatgatgatgatttggatatcattgcatatatctgcaaaaacatgaacgagggatgggggctcggctggggtttaatgcattattaa

SEQ ID NO: 66133 - DNA, 1124 bp, Heterodera glycines
  Genomic contig location: Contig_ID=SeqID_7841; Location=260..1383; Strand=+
  SCN-specific regions: Sequence locations=1-292,315-430,462-557,600 -680,702-787,812-1124
atgaaactgaagccgaacccggtgaagcagcgcgagcatcggactcgtcttgaaaaatacatcaactccgaggcgtgcgctgatgacactgcggtttttgacatgttcccccattgtgctgatgattttgctccggtacgcctctttttttaatggtataatcgacaatttggcaattgtccagttcgtgtccacttatttgttatggttttcaacacattgacaccgcgaaatagtgtatatcatagaagttcagtgtcttgacaactcgtacaataggcaaccgtatatatttgctttgggtttattttgtaaagtttactattgcgcgttttgcctttacgagttgccatagactcaaattttcgaattcaaacaatatttaaccaaaaagagtatacacagaaggggtcggtcaaacaaacataagcaacatttcccttaccatttgcttttgtcataaattgtttattttagggaattgcatctcacagagtcaatcaaatgccaccggagaaggataaagcggccaacattgagccgacgggttccgattaccctgacagtgaagatgaaagttatattttgtttatttaatggtcaagatttattctttttttcattgtttagtggcaattttggaatggtttgacaagccgatcagcgaagacattttgaacctttctgtaattttactatttaaaaaaaatttgtgtacatttggtccattcttttttagaacattccaccgccacaaaacaaaatcaccaatctgcaaccggctcgcgaaaatgatgatgatgatttggatatcaatgcatatatctgcaaaaacatgaacgaggtatgtggctccgctgggtttagtgcattattagggcttgaatcgttggtccggttcggacttgacatgcataaaaagtgatctaaacgttttggtgtatctgaggctatttgttggaaaatttgtgtttatccctctaaaatgctaattggcatggaggctttttgttttgtttttttttaatgggggtgctgtatgctgtaccaaaaccacgcgcgacaccgttgctctaaaaaattgtttgtttgccaaatataagacaatacgaacatcgaaagca

SEQ ID NO: 66134 - DNA, 243 bp, Heterodera glycines
  Genomic contig location: Contig_ID=SeqID_36932; Location=285..527; Strand=-
  SCN-specific regions: Sequence locations=1-243
atggacggaaaggacgtggacaaggacgaggtcaacacgatgaagacgatgcagttcaagcgaagtgagcagcaaatgccactgcggaacggaagagacattcaattagctgacttgggaagagcaaacaaagaggacctgctcaaaaaggaagacgcgtcccggacagacgacaatctgacggggagtctgatcagcaaaagtcactttgatctgaaagccaaacaatcaatcggtcgctga

SEQ ID NO: 66135 - DNA, 937 bp, Heterodera glycines
  Genomic contig location: Contig_ID=SeqID_7842; Location=5..941; Strand=-
  SCN-specific regions: Sequence locations=1-101,125-245,309-434,495 -518,542-672,758-937
gtcaatgcgccaatttatcccatcgccatgaaatacgactcgcgcttcggcgacgccttttggaactccagcgagcagagctattttcgctacttgctgcagatgatgaccagctgggcactgatctgccacgtgtggtatttgccaccgatgaccaaagaggtggggtcaaagaaaaatgggtggggggggggggtggggtcgactccggtacatcccaaaacaggcgccgaaacacagccgggaataaatttttaaaaaatttttaaacagaaattttttaagaaaaaaatcttagaaaattttttcttaggaaattcgaagggaaaaaaaatttcaaaaaattttccagtgatttttttgattttttttttgaaaaaacttagttattcaccattaaattttgaaaaaatcgctctggaaaatttttcgagaatttttttttctttgaattttctaaaaaaaaatttttaatacttttttttgaaaaatttctaatttcgttaaattttcagcgattttttggaaaaattttgaaaaatcttagtaattcacaataaaaatttcaataaaagagtggttaaatgaccatgaccttgtggtaactcggtagaataagggggacggacaaaattccgccaccgtaatttcgccgggacaaaatttcgccgcaaaaattaaaaaaaaaattgaacagaaattttttaagaaaaaaatcttagaattttttataagaaaatttcaaaaaaaattttttgaagtcgtcatcacaaaaaaaaaagtcctatgttttttagcccggcgaatcggccatcagtttggccaatcgggtgaagaaggcgatcgctgtccgtggcggacttgtcgacttggactgggatgggcagttgaagcggtacaaagtgccggcacggatggttgacgaacagcgggaaag

SEQ ID NO: 66136 - DNA, 469 bp, Heterodera glycines
  Genomic contig location: Contig_ID=SeqID_7843; Location=1..469; Strand=-
  SCN-specific regions: Sequence locations=1-86,133-469
atgcgcatcggttcacgtgctttctcggcactgatcttcttccatgacagtcacaacaaggcacagagtggcggtaattacatttcaaaaatttttatttcatttaaaaaaaaatttttttttaaattttttccaatcaaaaggcatttgcgtggccaaccacacatcgcccattgacgtggtgatcctcggctcggacaccgcctacgcgctgatcggacaaaaacacggcggcgtcatcgggctcatccaacgggcactcagtcgtgcgtcgtcccacatttggtttgaacgctccgaggccaaggaccgctcgttggtgtgcaaccggtgggtgtttgtcctcaaaaaatgtggcctaaagttcctcaaatttttcattttcactgcaattgtgcaagggatggaatttataaaatatatcttagaaatttattagcgttttctattatgatgatactcatttttt

SEQ ID NO: 66137 - DNA, 879 bp, Heterodera glycines
  Genomic contig location: Contig_ID=SeqID_7844; Location=289..1167; Strand=-
  SCN-specific regions: Sequence locations=1-329,365-396,419-423,452 -524,550-571,615-693,718-843,865-879
atgagccatcgtcaatttttattgcaaaattcgatgccgattttcattcattttttaaaatttatttccgtccattatttatccccatttcccccaaggcattatcatccgcgagacgtccatccagcacttggacgagcaggaccagtaccagcagcaggagttccaattccaaacgttcgtcaattcgcgcggatggcaaggcattcgggactccatgtacttcataaaggtgtgtgtgtggcatggcattaatttttgcggttatttttaaaaatttaatgacaaaattcaattttcccaatttttgttttgttttttgcaatttcataataattttctaaattttatatatttttttaaacctttgaaaatctcaaaatttctttgaatttcaataaatttaaaaattattttacgaggattttttctaaaatttttttaaaattttcgttattcacatttttttaatcatttttttaattgcaaatttttccccaacttttcaaggccggcgttgaggcgatcattgaggacgaagtgaccagccgattcaaggcaaaaagggcccaaaaaatgattatttatttatttttattttttaaaaattttttccattcaggccgagcagttggcctcgtggaatatgctgacacggaccagcgtcagcttctaccaatttctgaggtgctcaaaaataaacaaattaattaatttctctttccatccaaattggcgggcatttttttttttgcgatagtttgacaaattttccaacaatttttcctgcttttggcgaggggcgtcagtttgtcataaaaaaattttctatgaaaattacaagaaaaattttgcaaaaacttagtcattcatattaaa

SEQ ID NO: 66138 - DNA, 168 bp, Heterodera glycines
  Genomic contig location: Contig_ID=SeqID_7845; Location=543..710; Strand=-
  SCN-specific regions: Sequence locations=1-168
atgtcccttttgctgttgtcggccacggctgagcatctgctggtgctgtccgccttcttcttcccgcccgctctgctcattgtgcttttggtcgtcgttttggccacttttggcaaatcgttgggcctccgcgagcgctatgtcagcattttgatccgaatttttgag

SEQ ID NO: 66139 - DNA, 655 bp, Heterodera glycines
  Genomic contig location: Contig_ID=SeqID_36944; Location=219..873; Strand=+
  SCN-specific regions: Sequence locations=1-221,256-348,370-412,444 -459,502-655
atgattttgcaattggcaattgacacagcgaatgaatggcaattaaatgaaattatggacgtaataattcgagaaatttttgatcaaaatttagaggaaatgtttaaaaaagcggaagaaaaggcaaaaaaggacaaaccatcgagagcatatacaataaataatgacaaacataacataattttatattcaaaattcgacgatcaaaatacatgggtatgatttaattaaattaaaataaaaaataaattattacccaattttagtttaatgatgctttgttttgaaaaaaatttacgaaagaaaaagattcgaaattgaatataattcgcaaatatgatggcacacttacgacaattcatttcttactgttttctagtccaaaagttttacctaaaaatgcgcttttttctaaatttagttaaaattataaaaaaaaatttcaaaactacgttttcggaaaaaccattattttggttttttgaattttcaacaatctttttcgttggttttacctcttttttttttactttgtctgaaaattctcttatatatttttttggataaatttagaaattatttgtgggaattaatcattttttcggtattatttttaattagtaccctaatttaaagtagataatgatttagacca

SEQ ID NO: 66140 - DNA, 671 bp, Heterodera glycines
  Genomic contig location: Contig_ID=SeqID_36945; Location=102..772; Strand=+
  SCN-specific regions: Sequence locations=1-52,74-119,141-671
atgattagaagaggtggaacaatgattaaaagaggtacaacagtgattaaaggaggaacaaaagtgattaaaagaggtacaaaaatgattagaagaggtacaacaatgattagaagaggtacagcagtgatcagaagaggtacaacattattagaaggggtacaaatctgattaaaagaggtacaaaagtgatcagaagaggtacaacagtgattggaagaggtacaacagtgattaaaagaggtacaacagtgattaaaagaggtacaaaagtgatcagaagaggtacaacagtgattagaagaggtacaacagtgattaaaagacgtcataagtgattaaaagaggtacaaaagtgaattaaaagaggtacaacattgattagaagaggtacaacagtgattagaagaggtgcaacagtgattagaagaggtacaacagcgattagaagaggtacaacagtgattagaagaggtacaaaagtgattagaagaggtgcaacagagattagaagaggtacaacagggattagaagaggtacaaatttgatgaagaggtacaacagtgattagaagaggtacaacagagattagaagaggtacaacaatgattagaagaggtacaacagagattagaagaggtacaaatttgatgaagaggtacaacagtga

SEQ ID NO: 66141 - DNA, 971 bp, Heterodera glycines
  misc_feature (26)..(26): n is a, c, g, or t
  Genomic contig location: Contig_ID=SeqID_36945; Location=87..1057; Strand=-
  SCN-specific regions: Sequence locations=1-816,838-883,905-971
  Gene Ontology: Mol. function=cell adhesion receptor activity; Cellular component=lysosome; Biological process=receptor mediated endocytosis
tgtgaaccctcttctgatcactgtgnaacctcttctaatccctgttgtacctcttctaatctctgttgtacctcttctaatcactgttgcacctcttctaatcacttttgtacctcttctaatcactgttgtacctcttcatcaaatttgtacctcttctaatctctgttgtacctcttctaatcattgttgtacctcttctaatctctgttgtacctcttctaatcactgttgtacctcttcatcaaatttgtacctcttttaatcacttatgacgtcttttaatcactgttgtacctcttcatcaaatttgtacctcttctaatctctgttgtacctcttctaatcattgttgtacctcttctaatctctgttgtacctcttctaatcactgttgtacctcttcatcaaatttgtacctcttctaatccctgttgtacctcttctaatctctgttgcacctcttctaatcacttttgtacctcttctaatcactgttgtacctcttctaatcgctgttgtacctcttctaatcactgttgcacctcttctaatcactgttgtacctcttctaatcaatgttgtacctcttttaattcacttttgtacctcttttaatcacttatgacgtcttttaatcactgttgtacctcttctaatcactgttgtacctcttctgatcacttttgtacctcttttaatcactgttgtacctcttttaatcactgttgtacctcttccaatcactgttgtacctcttctgatcacttttgtacctcttttaatcagatttgtaccccttctaataatgttgtacctcttctgatcactgctgtacctcttctaatcattgttgtacctcttctaatcatttttgtacctcttttaatcacttttgttcctcctttaatcactgttgtacctcttttaatcattgttccacctcttctaatcattgttgtacctcttct

SEQ ID NO: 66142 - DNA, 639 bp, Heterodera glycines
  Genomic contig location: Contig_ID=SeqID_36946; Location=1..639; Strand=+
  SCN-specific regions: Sequence locations=1-639
atgattaaaggcattattatgctcagttcgccagcggatgagtcattttttgcccaactcgataaatatgatattccggtggtggtgattggcaaagttgaaggtcaatatgcccatgtttattctgtcgataccgataattttggcgacagcattgcgttgaccgatgcattaattgaaagtgggcatcaaaatattgcctgcctgcatgctccgcttgatgtccatgtttcggttgatcgcgttaatggttataagcagagcctggctgcgcataatattgcagtgcgtgatgaatggattgttgatggcggttatacccatgaaactgcattaaaagcagcacggcaattattaagccagtcaccgttgcctgaggcggtgtttgccactgacagcctgaaattaatgagcatttatcgtgcggcagcagagaaaaatattgctattccgcagcagttagcggtggtgggttatagcaatgaaacgctgtcatttattttaacgcctgcaccgggcggcatcgatgttccgacgcaggagttaggtcaacaaagctgcgagttattattccgcttaatttctggaaaaccgtcaccacagaatattaccgttgccacgcatatgacgctgaaataa

SEQ ID NO: 66143 - DNA, 380 bp, Heterodera glycines
  Genomic contig location: Contig_ID=SeqID_36949; Location=560..939; Strand=+
  SCN-specific regions: Sequence locations=1-20,42-272,294-380
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaatagttatttctgggactttttcagaaatcagaattaattctccaatgtggcccaaattttaggcccccagccacagccccttgcttctcccagttttaagtcttggatttgtcaa

SEQ ID NO: 66144 - DNA, 1132 bp, Heterodera glycines
  Genomic contig location: Contig_ID=SeqID_7847; Location=147..1278; Strand=-
  SCN-specific regions: Sequence locations=1-205,228-336,375-1078,1102 -1132
atgatggaactggcttctttggctgttcctttattgaaagatgatggtcaaaacaaacttttattaatgaaattgctacaaaaatgtgtatcacactttttgtgccgtgcaaattttttggatttaaatgaaaaaaacaattttgaacttgaaaaatctaaatggcatgagttaggaaaaatccaaagtgctttttgtaaagaaatggagaagggggaaattttaaaagtaacggaagaaaaaacgaaaaatatggcaattcaatttgccaattattttgaagagatgaaaataaatgaagaaaatattcgaacgaatgttcaaaatgccaatgataaatttgtaaaatattttggaaaggaaagcgacaaaattcttaagaatcttttcgatgcatttaaagtgttcgttgaatcaggtaaatttagacaattttgggtttttatttctctcaatttttctattaaattttcagtcaacaatcaaaaaatgtgccgttttcggcaccaaatttccatcgcaaaacatatgcaatcgttggctacagaacttctccgaagtgcattggcaacagtaattgaaataattaacaataaattagattccctccattctcatgagaaattctttttttcgcacccaattatatggtacaatgttcgtacccattcttttaggttactgtaagtactgctggtctccaacaaacacaacgacgccgtaagcgcatgcacagttttgacggtgttcagcaaccacggcaaagtcaagccggacgaagccaagttggagctgttcagcatcaggagcatcgtccgaactggagatgcaactgcgttttgacgatcgcttttctttcccttggcactttattttacgccttttttttgcttatccaaaaagcaagtgaggcccacgcattgttctttctgttcgccttcataacttttgttttgagtcttggcacatatttcaaattttgctccttaatttgtcaatgattgaaaagaatggaggaaaaaagcattggccggcggagcaacattttttggaattaatcccattgtttgtcacaagcatttataaaaaaaattaaaatttgtcttttttctgttccgcatgaaacaataaa

SEQ ID NO: 66145 - DNA, 1124 bp, Heterodera glycines
  Genomic contig location: Contig_ID=SeqID_7847; Location=3690..4813; Strand=+
  SCN-specific regions: Sequence locations=1-166,188-191,224-341,363 -388,418-603,625-824,858-887,911-1091,1116-1124
atgagacttttaatatcgaaaacggggattttggatgtcacaattacgaggcaccacaaaagttggcacagttttttgtttccgactcttttgaattttgttgaatttaagatttgcaatttcaagaatcaaagagaaatacttggaattgaaggtatgtaagtaatttatatttaaaaaactttttctcataaaactcattccttattttgaggggtagcttgtcttataaattacaaatattttgaaacgcgaagaatggaaatgcgtaaaagttttcaaattgggcatgaactctgtaaaaatgtgacggcattcaaaagagaattgtttgggttggtattcaaaacaaatattttaaatcactgcatacagtgccggaaaaaagtttaaaaatttttaaatttttgtattttacttgggaacaatatagaaaatggtttgttttttccgaagcgcattttgaatggtgcgcatacgtttgatagcaaaaaagtgaagagggaattaaaattcagtaaatggcaatgagcttttgtttaacatagttaattctttattttcgttaaacaaaacattttctatcgttaattgttcccaagtaaaatacaaaaatttaaaaattttagttcgttgcataaactttccggcactgtattttgtttgtaattatacgcacataaattacacgattagttgaaaatgtgtttttctctttgcttcacaattatgtgaaattttcaaaatattcgttagtataagggctctaaagcctataaaatttacaaaattttcaattatgcataaatattataaatctgttcgcattttttgtaaaattcttttaaaaaaccatgccaaaattttacgtgaaattttctagttttgaaattaaatattttggaattttgcagctccttgtaaacttatttcttgaagatttcaaatcatttctgtcattaataccgactaaataatccactcgctcctttgttgcctctttgtaaatttagccctgtttgcacataaccgaaaattggtccaactatccataaaatttatggcatataattacaacctataattattcgtttttaattatattttaaaattttgcaatttaa

SEQ ID NO: 66146 - DNA, 979 bp, Heterodera glycines
  Genomic contig location: Contig_ID=SeqID_7847; Location=4889..5867; Strand=+
  SCN-specific regions: Sequence locations=1-101,123-155,178-214,237 -271,295-337,359-475,498-503,529-688,710-720,765-855,893-937
atgatcaggcgcacaaattttgcgtgcacaacccgaaggggagattttgtctcccggggttgggaatcgaaaaaagattttacagagcaaggaatcaattcggatttgaatatttaaaggttgttctaaatgtcgaattgcatctcaatattattaatttaaatttcagaaaaatttaacaacatttccgtttccgtaattttaatgcgagaagataaacaatttttgagggatttaacatttaatcgaaaggcaattagcattgttgaacatttaaattaatttttattttttgcttttctccaatgtttacgtgccgaaaccaatgtttagaaggaatgatttcgcttttggcgttatggcatgcgattctttgctgattacggcacaagtgtcaacttttgcttttgtattgcttatttgatgccggatgacgcaactattttttacaattcgaatttccccaagtgtcagtcttttttcatctttttcaaaatcaacgagcataaaattaattgtaaaggctgtgaaatattgaaaaatcttttggcttcatttgaatttagacacctgtagccgagaaggttatttgcccgagtgggtaccgttacaaatgattaacggggcaatgactctcgattaaaccgcggacgcaaatggaatatctgcaagaaaacgagataattttcaaattggatttcattatatctattgctgaccatttataaattaagtgattttaaaaaaggttttgtttattgttttaaaaagttagaggaattcgtttagtaatctttttaatttaaaatttctgagttttgagattgtacaaaaaaaattaaagaataatccaacattaaaaaaaaaaaattattttcattattttttattaccaatgatttaaataattgccttggacagcgcccaaaaaaatcgcatttaaaaaaaaaattatataaaattttatttatcattttta

SEQ ID NO: 66147 - DNA, 446 bp, Heterodera glycines
  Genomic contig location: Contig_ID=SeqID_36954; Location=182..627; Strand=+
  SCN-specific regions: Sequence locations=1-446
atgatttgtgctaaattgcatttagttaaatggagcaaaggggtcaatcagtgagtcaatgactcattaaattagtttttacaaaataaaacagcttaggcctagcctgagccattgtacaagctgccttttgtacgagttgtcatgacacccaattagtttgtcgtaaaagagaagcaacgcaattaaacatatcgatttccgttgctaggaaatacacacggtagtcgagtggcattattcccatgaatcattccaaaattttaagaatgaaataaatacacccattttaggaccaacaaatcattacaataaaaagaattgaaagaatgaaaaaattagaaaaatgaaaaaaagatctaaaatgtttgtttattgtgcctcgctttcaaagaactccgacggatgtccttgccttgcgatttgtccgttgctcatttctgtca

SEQ ID NO: 66148 - DNA, 164 bp, Heterodera glycines
  Genomic contig location: Contig_ID=SeqID_36954; Location=673..836; Strand=-
  SCN-specific regions: Sequence locations=1-164
atggacgagaacaatcacaagctgatcaggtgggcaaacaacaagtgatcggagaattaataaatggttgttttattacagtcaattaatcgcgaggatgggctgtacggtgttggccattttacatcggacgaccggactggcggaatttgactggatcatcg

SEQ ID NO: 66149 - DNA, 318 bp, Heterodera glycines
  Genomic contig location: Contig_ID=SeqID_36954; Location=969..1286; Strand=+
  SCN-specific regions: Sequence locations=1-318
atggtccaaccattggccaagtccgatggacgaaatgcaattgagcagcgattggtcgtcgacggagggcgaggaatcattggccaagcgaaggcaaaggttgtcccgaagagtgcccgagaagaggaacggatgctgggagcagaagccgaactgaacagcagcaaaagggacttaatgagtgctaatgagttgcccaaaacaccgaccaatgaccgcgccgagtccaatccgacactgtccaagtcgatcacttcgtcaacaaaaatcttcccactttcaagtggcactgctcggagaagggcctttaggggataa

SEQ ID NO: 66150 - DNA, 479 bp, Heterodera glycines
  misc_feature (413)..(413): n is a, c, g, or t
  misc_feature (431)..(431): n is a, c, g, or t
  misc_feature (434)..(434): n is a, c, g, or t
  misc_feature (437)..(437): n is a, c, g, or t
  misc_feature (443)..(444): n is a, c, g, or t
  misc_feature (447)..(447): n is a, c, g, or t
  misc_feature (455)..(455): n is a, c, g, or t
  misc_feature (457)..(458): n is a, c, g, or t
  misc_feature (466)..(466): n is a, c, g, or t
  misc_feature (471)..(471): n is a, c, g, or t
  misc_feature (475)..(475): n is a, c, g, or t
  Genomic contig location: Contig_ID=SeqID_36956; Location=102..580; Strand=-
  SCN-specific regions: Sequence locations=1-25,47-78,100-102,126 -196,254-337,440-479
aatgctgtgccgaactcgcccatcatcgtggaggagcagcagtctcaggcaccgaactcgcccagcatcatcatcgttgaggaggagcagtctcattgtcagcaagaacaacaaccaaaacaaactgttgatgctgttgctgttccggccaagagtgcaccaccggacagtgttgtcgtcgttgtcgctgctgttgaacatcaacaacaacagcagcagccgccgccgccgccgccgctgtcgtcgtcgtcgcactgtcctcctccgccttctgttccttgtacgagtgcctccccttccatcgctacgtcttccattgttcttacgtcaacttcttcagcagctccaccagcagcagttgaacaacagcaacaacaaccaccgccaccagcgcagcagaataataacagtancaatcagcccgggcagcngcngcngccggnntcngccgctgngnngcttgtcncttcnttcntgcg

SEQ ID NO: 66151 - DNA, 81 bp, Heterodera glycines
  Genomic contig location: Contig_ID=SeqID_36958; Location=287..367; Strand=-
  SCN-specific regions: Sequence locations=1-58
ttacagcttaactaggccctattaagcttatttccagaaaatctcgcatgaattctcatttttaaattttttatagatttt

SEQ ID NO: 66152 - DNA, 129 bp, Heterodera glycines
  Genomic contig location: Contig_ID=SeqID_36960; Location=330..458; Strand=+
  SCN-specific regions: Sequence locations=1-129
aaattgtacaaaacttactagttttttgaaaaaaaaagttaaaaaaatttacgacttttcatcaaaaatttcggaagtcggaattccgaccccaaaaatgtcgaaaattggaagtctttccgtgccata

SEQ ID NO: 66153 - DNA, 255 bp, Heterodera glycines
  Genomic contig location: Contig_ID=SeqID_7848; Location=215..469; Strand=+
  SCN-specific regions: Sequence locations=1-255
atggccgcctaccgaatggagcgcatttattcggtgatcggcaccattctgttcatcgtggcattcatttgcatggtctggtaagtaattagaggattaattagggaagctgattcgtgccattttttgattgaatttatttttaaaggtatctgatcgactatgacatcaatcgtggacagttgatcgctgctacggtaaaaataaaaaattaggaaatttaattatttatcactgcttttaattttcggttca

SEQ ID NO: 66154 - DNA, 1210 bp, Heterodera glycines
  Genomic contig location: Contig_ID=SeqID_7848; Location=2374..3583; Strand=+
  SCN-specific regions: Sequence locations=1-69,178-215,249-302,324 -324,346-388,410-415,441-487,509-585,630-911,933-933,987-1210
cttttcgacagtggttgtacctcttctcatcattgttgtacctcttttaccgtggccatcagtgatgccaacccgaacccgaaacccgaaacccgatacccgaaatccgaagtttttctcaacccgaaacccgaactcgaaatttttcgagtgctcgacccgaaacccgaacccgaaatttttctcaacccacggcatcactggtgtgaagggcaggcgacctgtgcccccgcccgccggcggggaaatggacaaaatagaaaaaatcagcggcagagggaggagggattatcggaaaagttaaaaaagtgcgaaaggaaaagcataaatgtgggaaaacattttgactgacaatgagtgcggaataagtgggagagttacttgatgaccccttttacaacgaaaagcatatgcctaattaattttaataatttttaattgttttctctatttttcaaatttaaaaaggcacagttgttgattcaaattatatagaacaatttttgaaacatttcaattagtaatgcgcgccctttcaccaatttttgcgctgcttttttgccaaagtgcattttgcaacagcggtaataaattgtttttttaaatttaaatgatatttcaaaaattatgcacttgcatgcaagcgtggtgtttttacagaggatggcgatcttggcgtcaaaatgcttggtgccgaacaagcaaaaggtgggcctttaaatgcagggaaggaagcataggtgggggattggctttgtatgctcgagaccaaaagattctcgacaatcaccgaataatagattttttgtcttttttactcaaatcccatccctcgtctaagaaattttccgtataatgtgcaaagatttttttcaagaaaaactttcgcgtttgaatttataatttttcgcattgttttaattaggaaaaaacatttattaatttaaattaattttatttataaatctttaaattaactattttttgtcaaaattttccgccagaaaaattgggttaaagaatgtagcaataacaaaaccaattttcaagaactgtccttgcattcagtgacggatttgaaaacgaatattttgttctttgagttagctcaaaaattttaatacatcaaaaattacttataatccagaactgctgaagcagccatgccatcctgggttgaagcaatgttgtgcccttttctgcccatcag

SEQ ID NO: 66155 - DNA, 706 bp, Heterodera glycines
  Genomic contig location: Contig_ID=SeqID_7848; Location=1196..1901; Strand=-
  SCN-specific regions: Sequence locations=1-45,70-279,301-322,352-706
atggtgttggaaggtacatggcaagcagaaagtgaggtcaccgacgaggggatgggttgggtgagggggtcggttgtcaaaaaaaaatggcaatatatgcaaaaaagacgccgggggcggggagcaaaaggagagggtaattgtccccatgatcggctatcagcaaaaattgctaataaaagtaaaaatgccggggtggggggagggggagtaatgattctgcttcatcattgtgtggtctcagcatcctccccgttttttcagttcgataacgaaaccaatattaacaataaaattatatgtacaattgcaaacaattatgtttcatttaaaaatatttattccaaaagaatttgtgtaatgtgtgcgaaaatgctctaaaattaaaggggaagacaaagaaattgttgaaaggggcagactgtataaattccaccgcacaactaccgtatcagttgaaagttatcggaaagtggctttgactagagaaaagcaaaaaattggccgatattttagctattaaagcaaaatttgcacttttcagataaggtcgaaggcatacggtagccgacagtataaaaacaaattcatcaagaggatgagaaggagatatggaatctgtgcacatttaagacgaatacacataaggaattactcaataccaatatcatttttaatgtccaagccaatggccaaattcggctaa

SEQ ID NO: 66156 - DNA, 257 bp, Heterodera glycines
  Genomic contig location: Contig_ID=SeqID_7848; Location=2109..2365; Strand=-
  SCN-specific regions: Sequence locations=1-31,70-71,230-257
atggttaaaaagggtacaataatggttaaaaagggtacaatcatggttttaaaattaaataaaggaaatcgtttattaaaaagtaagattaatattgaatgtaattaataaatttttaaaaataaaataaattattccttttattaattaaaaagaaagtttgaaatgtacaaggattgaatatttatttaaattgaaattaattttacaaattataatttaaaaaatacaggagttctttaataaaagtaaataaa

SEQ ID NO: 66157 - DNA, 581 bp, Heterodera glycines
  Genomic contig location: Contig_ID=SeqID_36962; Location=96..676; Strand=-
  SCN-specific regions: Sequence locations=1-18,41-181,203-284,306 -309,341-455,485-522,544-581
atggctttgtgtgacttaacatgggtatgtcatggaatggtatggcatttactggtatgggaaggtaagtagttactaccccctatttggcccctaaagttcgagtccccttggctgcgaattattttttagaattaaatctcatcgcttcgacccaaaggtgtgaaccatatttttttacaatttttaaaaaatccaaaggtgtggaccgtttttttgcaattttttaaaaaaatccaaaggtgtggaccattttttttgtaatttttaaataaaagtgtataccgtttttaaaatcaaaagtgtgtgattaatttttttaaaaagtaaatatattttagcacttattcgaggggaggaggggtggtggtaaataacccaaagccttttgttggcctgttaacatatacccttaggttattttcccctattttgtaaaacctgtgtctatacacaaaaaaattttttataattaagaaaaattgttaagaattcctaaaacataccattagatacaattagtttcagaattttcttcaagaaggggtgatctaaagacattatccctttttttttgctaa

SEQ ID NO: 66158 - DNA, 543 bp, Heterodera glycines
  Genomic contig location: Contig_ID=SeqID_36963; Location=335..877; Strand=-
  SCN-specific regions: Sequence locations=1-398,420-543
atggagactggcatattatttttcaacctcctcagaagggggtatataattggaggccggcagattaatggagactggcatataaaaagagtatatacggtaatcatttttatcgtatcaattattaaaataattttaaggcacaacaacaacaaaatgctgctgttgttggtgccaaagtttgtgttgagtgtggccaacggattgtccaccaaacggtgccgcagtctcagctgaatgccaatgccattggcgttgcttctgtcggttgcacttcggtcagtgccgctcgtggccgtgccaagtgccgtcgtttgttttggcgtgccgtcacttttccagtcagtctttttttaaattaatttttgctaccgtataccccctctttcatcctccattacagtattttaagtctacttttttcagatgaatgccatcgccaaattggtcaaaaaagtgcgatcagcaaagtgtgcgaaggctaacaaagccaaaaatgagaaggaataaattacaaataatgggggatttgatgcaattaaa

SEQ ID NO: 66159 - DNA, 276 bp, Heterodera glycines
  Genomic contig location: Contig_ID=SeqID_36965; Location=534..809; Strand=-
  SCN-specific regions: Sequence locations=1-276
atgaaaaaggcctcgctgctgttgtgcatgggccgcgtgttcttcttcgagcaatggcatttgttcgtcaccgccatggaaatgtaccgtatgcaacgcgtggacaccgtagtcgcttatgtgatgagtgtgcacccgacactgtacgaacttatgcgattgtacgagagggacggactgctcagagtgagggcgaacatggaaatgccgacggagacagtgcacggcacggccgacaaattcaatccgaacggcgagacggagtggagcaaccag

SEQ ID NO: 66160 - DNA, 76 bp, Heterodera glycines; identical to SEQ ID NO: 53797
  Genomic contig location: Contig_ID=SeqID_36968; Location=506..581; Strand=+
  SCN-specific regions: Sequence locations=1-76

SEQ ID NO: 66161 - DNA, 1135 bp, Heterodera glycines
  Genomic contig location: Contig_ID=SeqID_7852; Location=570..1704; Strand=+
  SCN-specific regions: Sequence locations=1-443,465-475,507-644,667 -693,744-911,935-1135
atggaactgacctcgggatggtacggcgaccgatacgtgggctttgtgtacccggaagaagggattagcaaagaagcggaacaggtggacaaaggagggcaattagaaattaattagcaaaggaatcaatcgcctcccgcttaaggtattgccggcatttttgatattggcagagcaagtcaaaagtgagagcagcggaaaagaagcagaagaccaaaaaggcataggtggacagtgatcggcggagggagcgattggacagaagctgatcagcggcattgatcaaagggatgtagcatcaagagatcagcaacaaacttaaaaccaattagcttggaaaataatagaatagttaattcacttggcaattatttttatttattgtaattgtaattttccctctcaaattatgcttactcagaaatattgtagcctatttcatgtattcacatttactagaaatgacaactctgataaaattagttttaaattaattttttcttagtcttcgaaaatggtactcatttttcggtgcttaattcaattcttaagttttttattacttgtttagttttcagaatggtttgaaaggctctcgtctgctaaaacaattagtgtttcggtactaaaaataacttaaattcaaaaaatgttttaacaaatttataattatcgattcttagagggtggagcatatttttatttttaatgtatttaaaaattttggaaataatataaaataaggaaggacaaaatggggacccgttgagttttgattttgggattaattccgaaaaaataaaaataactctaaaaactggagaccaataattaagcgtataatttcaaagaataaatagtcaaaaaataccaaaacaaaaattatattccattgccaatttgtccatctgttaaattattataaaatatttttgtccttgttttattttccacttttgcttattctttttcttctcatttatcagcttcttttcagcctgttgaactgctcgctgctgtcgttggggccggtgaatttgttgaattcgaaactggcaatatgccaatttgtgatgaagctttgttcccagcagcagcagaaaccaacacactaaacataatgcaaaaattatga

SEQ ID NO: 66162 - DNA, 786 bp, Heterodera glycines
  Genomic contig location: Contig_ID=SeqID_7853; Location=45..830; Strand=-
  SCN-specific regions: Sequence locations=1-9,31-316,338-763
atgcaagtcaagaatcactttttaaaattcgaatctccaatatttttaatagacggaagttatgccatcgcgtcaagcaacagtgttaatcagtcacttcacgcttgtctaattagtgatgttgtgccttcactaccaagcaatggttccttaatgttcaggtaaaaattggaaataacggaatcaaataaactaatataacattgatcacttttattttactattaaaaggcgcatttttcatcatttgagtttttttaatcccaaattaattgcaacaatacttaaaaaaacgagggcaattaaaatttcattcacaataataataattgtaatttactttaagaaagaatttacaaaataaatatctcgtcttgccaaaatatgagacacaagaaaagcaatatgccctggtaaaaggctgatttgcaaaaatggatgaattactttttttcattttatttaacaacttttggtattaaaaacgatctctattaattaaaatagttattttaattcagttactggacaagtccatttgtggttttgaatgtatgccagaaaattgaccaaattccactcaatttgacgacaatgtgccaacaaactccgctcgtccaaggcccgggcccagcaaatgtcacaatcggagcatcgacgggtccatttcaagtagcaaaatccgtgctttatcattatttctttgtgtgtttcattgacaaaaaatccaacaatttatgaaacaactgacaattagcaccgctaaattattttatttttaataaa

SEQ ID NO: 66163 - DNA, 313 bp, Heterodera glycines
  Genomic contig location: Contig_ID=SeqID_7853; Location=949..1261; Strand=-
  SCN-specific regions: Sequence locations=1-77,99-313
atgccaaatttgaactgcgtggagttcgacgacacttgcgcatggcacaattgccaaacgcccgctgcccagctgatgtggtttcgcacttcggcaaacataagcagtgatcagatgatgaccacgacgggcactggagtgatgccaagttgggatttcgctatctcaaaaatcagaatttttttttcatttttttattggtgtccaacgaaaacaaaaagtttcgacgaattttccatgaaaatatattaaaccttctttttaaacgaccatttgctatgaaaatcacggaaaaagcattaatttaaataaa

SEQ ID NO: 66164 - DNA, 480 bp, Heterodera glycines
  Genomic contig location: Contig_ID=SeqID_36978; Location=159..638; Strand=-
  SCN-specific regions: Sequence locations=1-80,104-393,433-480
atgtcagagccaatccgaactgctttggcaacaatggttgaaaaattaataaacagaatggaaatcgttcatccgattatagaagcccaagagagaacagaggagggatttgataaattaagacaagaaagagtgctccttactgggctattagaaagaatcgaagtcaaaaataaggaatgggatgcttatatcagagatataggggcagaagcccaaaatgaggaaaatgagaggtatcgattactctctcacagaggaaggcacttttacgattgggtagaggaaggaagagaaacagtaagcaaaataaatattattttagtaaatgaagacggaaaagtttagctgaaagtgtcaaatctttaaaaatatcagatcaagaaccaaaaagagaggaaaatgagaatgaaattgggaaatcaattaatgaaattggaattaatttttctagaagaaataatcgggaccaaagagtag

SEQ ID NO: 66165 - DNA, 622 bp, Heterodera glycines
  misc_feature (48)..(49): n is a, c, g, or t
  misc_feature (63)..(63): n is a, c, g, or t
  Genomic contig location: Contig_ID=SeqID_36980; Location=1..622; Strand=+
  SCN-specific regions: Sequence locations=1-168,190-421,448-622
  Gene Ontology: Cellular component=mitochondrion
cggaagttcatttagggcacatctacaaatgagcagattttgattacnngaattaactttccnactcactttcctccatccagactggcttcaaccattgttcaaagacacctcgtgaattgggcaaaattcgatggcgttatatgcgccgcatcacgggccaaaaacgtttcacagacttttagaaaagcggctggatcgtgtcgggataaattgaatgccagtacgatagtgccacgtttgaaaaccgaagaacagtttttgggaaggggcggtgggggcaactgaaagggatagccaacatatggtaagcatcaaccagccgaacagttgtttttcaactaataatagcgcctgaaacacacctcgaccatttctgccccgtcgattcgtcgcggtaagcggccgcgccgacagattccaaaagtatgaaaaacatttcccaatgttcgctcgcgtgtaaattggcagcatttgcgcggaggagctgatggagaccgaaagcaatttgacgggagaacagaaacaattcgggtggtcgaagtgccaacagttcacagcccatgaaatggagcacttcgtcggcacaattgctggcgcggtcctggacagtctgctgatt

SEQ ID NO: 66166 - DNA, 1486 bp, Heterodera glycines
  misc_feature (1424)..(1424): n is a, c, g, or t
  misc_feature (1438)..(1439): n is a, c, g, or t
  Genomic contig location: Contig_ID=SeqID_36980; Location=1..1486; Strand=-
  SCN-specific regions: Sequence locations=1-593,615-1039,1066 -1297,1319-1486
  Gene Ontology: Cellular component=mitochondrion
ttctcgaccatttcttggatgtcggaaacaggtacggcatgcgcttggtccgacacaattaagttggcccgactcggaatagcaccggggctgctaatgggacgaggtgttttcaaatctcaatgcaaaaatcaccactttccgtcgtccatattagacttgcatattcaccagagcattgtggcagccaaacaaaagagcaaagttgggtcttgtcgggggtccaaatcagactaatttgtacgcattgacattcgcctaatttataaaagcaattagagcactctccgattggtgtattcaatccatccattccatcacgtgtaaaaacaattgtcttatacacataatagttatcgatttcttcagttctccaaagcgacgtttgatggccatttactgctcccaatttatagggaattatttgttgccattagcgtttcgtcattaacgtataagtatcattctggagagtcattatcaagtgccattttcctgcaatattgccgtaggcactcacgaacaacaggcgatggagtgttcctttgtgtccacttgtcagaatttccaatcggaatctcttccgtttaggacaacatttcacaccaactccaattgaaaaggggaaacaaacttcggaagcggtgatagcaccgaatttggcaagacaaaagcaatcgcagcaaatcattgccggacaaaacaaatgcgtggtgattgtggtggacccaatggacgacgacaaacagcacaagcaacaacggggcgacgtgacgaacaaaggcagggcatcgataataaacaaattgaaacgttaattttttgtttataaattggatttttagttcagattcactggcttccaatcagcagactgtccaggaccgcgccagcaattgtgccgacgaagtgctccatttcatgggctgtgaactgttggcacttcgaccacccgaattgtttctgttctcccgtcaaattgctttcggtctccatcagctcctccgcgcaaatgctgccaatttacacgcgagcgaacattgggaaatgtttttcatacttttggaatctgtcggcgcggccgcttaccgcgacgaatcgacggggcagaaatggtcgaggtgtgtttcaggcgctattattagttgaaaaacaactgttcggctggttgatgcttaccatatgttggctatccctttcagttgcccccaccgccccttcccaaaaactgttcttcggttttcaaacgtggcactatcgtactggcattcaatttatcccgacacgatccagccgcttttctaaaagtctgtgaaacgtttttggcccgtgatgcggcgcatataacgccatcgaattttgcccaattcacgaggtgtctttgaacaatggttgaagccagtctggatggaggaaagtgagtnggaaagttaattcnngtaatcaaaatctgctcatttgtagatgtgccctaaatgaacttccg

SEQ ID NO: 66167 - DNA, 306 bp, Heterodera glycines
  Genomic contig location: Contig_ID=SeqID_36981; Location=97..402; Strand=+
  SCN-specific regions: Sequence locations=1-136,158-306
gctttgactacagcacaatgcgggaaaagacacccgaactgtacgaacatttggcacagtccgccctcgtcattttcaagggggacatgaactatcggaagttggtcggcgacagggcgtggccccaccaaacgcctttttcggttgctctttcttccatgtactcaaaatcatttcccccttctttgctccctttcaggaagctctttgcggcttttgcccaaccactcttttggcacttcgaacattaaaagcggaaaccgtcgccggtgttccgctcgaatcgctgcgcaaaaaaaaagaaaa

SEQ ID NO: 66168 - DNA, 318 bp, Heterodera glycines
  Genomic contig location: Contig_ID=SeqID_7855; Location=1879..2196; Strand=-
  SCN-specific regions: Sequence locations=1-50,72-318
atgtctgtcaaattttgtgaactcggaaaaagcactgactcgggcaaagaagaacacgaaatgctcttcacgcctgaattggacggacaaatgtacggccttcagaatgtgagcaaacagatcgaacgccaactgcaactgaacgtacggcgcttttcgctgttgtttttaattgttttgcgccgttacatttttcagttgcatttccaagcggtggaacagcccgaaattgagcagggatattcgacgagtcaactgcacagtgagctggagcacgacgtgaagattctgcaggcaaattctatgggaaaaagctaa

SEQ ID NO: 66169 - DNA, 817 bp, Heterodera glycines
  Genomic contig location: Contig_ID=SeqID_7855; Location=653..1469; Strand=-
  SCN-specific regions: Sequence locations=1-146,174-817
atgggaaaagtttcgctgggcacattgcgaaaacccgagaaaaagcacaacaaagtgatcagcccttacgggtacgaaatacgaatgatcatttgtccgcttcgtctccatcttttgttttattacactttttttcagtttgccacgcaaggaagagacaaagaaaatgatcagttccttcgtccgtttgtccgttttggtatttatcgttgtcattgtgatggtggtcgaccacttttactttcgcctcctccaaattgtggtcacccatgggaagattctccgcggtcagaagggcggcaacagtctgaacattgtcagtggttttgtcttgggatttgcatttttgctctaattccatcctccgcaggttgtaaatggctctggcgcagttgctgaactccttcgcaacgtgttgcagttcaactattccaaggacctcgacacagacttggacaatttgcactgtctgacccaaccgaacgcacccaattggacattcaacgcgtggtatctgatgggcccactggttctgatgtttctgctacaggtcagtcggagaatggcattttgatcagtcgcggagaatggcactttctctccccatttgcaggtgttcctcggtttcgttgtgcagcgatttgtgctgttttttgtgcttggcttaatgtttccgcgcagagcaaaggcccgcatcattcacctctacaacaaaatgttatttggccgagtgaatttggacaaattgtcggcagctaagaaaaatgtgaatgaacggcaaatgtcgtcgaatgcgaatgatggctctgatgattag

SEQ ID NO: 66170 - DNA, 306 bp, Heterodera glycines
  Genomic contig location: Contig_ID=SeqID_36982; Location=819..1124; Strand=-
  SCN-specific regions: Sequence locations=1-12,38-306
atgagaaatgaatataaacaaaaaggaagaaaatattcgacaaaagaatggaagagaaattatgccgtaattgggaagaaaattggagttggccaaggagtaattggacaatggaagaaacaatttggattgagtggaaaaagaatatcggagaaagaaaaaatggaaaaaatgaaaatgtattggcaaatgaaaggagaaaatccaaaaatgagtgacgagaaaatttcaaaaatattgaaaattaatcaacggaccattttcaaatggaagaaacaatttgaagaagaattaaatgaggattaa

SEQ ID NO: 66171 - DNA, 336 bp, Heterodera glycines
  Genomic contig location: Contig_ID=SeqID_36983; Location=384..719; Strand=+
  SCN-specific regions: Sequence locations=1-22,46-107,129-208,230-336
atgaaaacatttaaacatttccaattaaaacaaaggcatcgcgaaagacgtgaccagcagctggacgagttcaaaagggagctgaaggaggaagaggcattggcacttggggaggtggaggaggaagacgaacaaacgcgggaggagcggcaccaacgggcgatgttaaggcacagacggacggagcgggaggaagcgccgttggaacaggaggacttggaggaggaggctgacgaggcgagtcaattgaaatgtcatttcgatccaccgatatactcgttccgatttcagaaactttattctttcaaaccatttacatttactgatttaggatga

SEQ ID NO: 66172 - DNA, 281 bp, Heterodera glycines
  Genomic contig location: Contig_ID=SeqID_36984; Location=229..509; Strand=+
  SCN-specific regions: Sequence locations=1-86,108-185,207-281
atgcttatagatgagatcaacgcgttacatgagatgatgatggcactggaagctgactttgaagaagcggaacgtgaagccaaaacccatccggacatcaatgggggcgatctggtgcacaacatcatctttcctgagccggacggcatggcatttgacgagtgtcaaaatggcactgccgctgatcagactgagaaggcggcggaaaacggagttgatcaggaagatgaagccgacgaagctgatcagttgaagaacaagctgaaacagaatttggagct

SEQ ID NO: 66173 - DNA, 408 bp, Heterodera glycines
  Genomic contig location: Contig_ID=SeqID_36985; Location=98..505; Strand=-
  SCN-specific regions: Sequence locations=1-58,86-188,231-408
gcggtgatgcaaattgtggcactgctgccggcggcggcgatggcaccaattctgctggtcagtcctcctcttcctcctccgcgtcgtcaccaaccgtcggccagcggacaccgcgcaagcggtcggacgccggcatgggcagtgctgagccggccggcccgctgcccagcattccggaggaggacgcgaacagcaggaacagttgcagcggcacgagggaacgacgccgggcaacggcatcgtcgacgacaatgacgtcatccgctgcaccgtcaacagcgtcgtcggaagtggcgatggtggacactgtgggaacgacaacagaagcagcgtcggcagttgaagaccaggcacatcaactacgagcagtacaagcaacacaatcaccaccaccacttgctggagaag

SEQ ID NO: 66174 - DNA, 382 bp, Heterodera glycines
  Genomic contig location: Contig_ID=SeqID_36986; Location=97..478; Strand=+
  SCN-specific regions: Sequence locations=1-382
atgagacaaattaatgctttccgtcgaaagagggtggcacaattggagagcaaaacgaggaaatgcatttttcggttcagagaaacgtcgaacggactacaaccggcacggaatgtgccggccagcagaggcggcgttcgcctcggcacaccgacggcggacagcgccggccgattcccactacgcccaccaccagtcccaccctttccatgctcatttccgttcccctttcggtcggtcactttccccgtccgttcatccgcttcttctctctccccgcttttctcagatattttccgtgaatttttcggcgaccctttgtcatcgtccgactttcatcgttcgccgtttttcgcttttcccgccaacggcggaatgaaac

SEQ ID NO: 66175 - DNA, 384 bp, Heterodera glycines
  Genomic contig location: Contig_ID=SeqID_36989; Location=242..625; Strand=+
  SCN-specific regions: Sequence locations=1-20,51-384
atgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaagaaggacagcaaaccccagtctggaggctagcagcccaacgtacagcaacaaacgggtga

SEQ ID NO: 66176 - DNA, 835 bp, Heterodera glycines
  Genomic contig location: Contig_ID=SeqID_7856; Location=406..1240; Strand=-
  SCN-specific regions: Sequence locations=1-1,23-33,55-399,423-761,783- 835
atgctttttaatgctgaatattttttcattctctattttgcctttttgttctgctccgccgatgccttgggcgataacccctcaaatggacccgtcattttaaacccatccaaatttgtccataatcatcgggaaaatgaaatgtcggagcggaaccccttaaaagaccaaaattttggcaacaaatcggcaaaaccgattgctgctgataaatactcccaacttgttgggccgtcaacgaatgtggcaaaagagtggttggagcggaacaacccaaaaaaggtaaaatcaccgagcagaaaagacactattgggaagattgggaagtcgagattgcaaaagtcatcgacgaatgatgagaaaatggagaaagaaccacaattggcaaaaggtgtttggaaaagtttaattgaaaaagcaaaaagggttttatttagctggcacttttgctagccatcgattggcatcatcttctccatcatcggcatctgctcacgacatgaccaaagcaaacagatacggcaaaagtgccgtttacagctcacgcgtgggccaaccggtcggcctaacacggaacgcgacagggattggacgaactgtaaacttggacaaaaaagtgccgagccacggatttgcaactggagggttctcaagccgactaatggaaggcatggcaaacattaatgccagaatgaatatgaaaaagaacgcgttgcgaccattttaaatgggaaaaggaagcctttttagaaggacaaagcgtttctgaaattgttgtgattgtcgttaaaaactgttaaacattttatgctatgcataattttattttattaaa

SEQ ID NO: 66177 - DNA, 1344 bp, Heterodera glycines
  Genomic contig location: Contig_ID=SeqID_7856; Location=4629..5972; Strand=+
  SCN-specific regions: Sequence locations=1-504,527-675,698-1095,1169 -1344
  Gene Ontology: Mol. function=endothelin-converting enzyme activity; Cellular component=cytoplasmic vesicle membrane; Biological process =cell-cell signaling
ggttaaacgacgccattgaggaggaggccaaaacggtgctggacaatgtgaagatggcatttgccgaagtgttggatcaaacggaatggttgagaaatgagacggacaaagcgaaggccaaggagaaattggccaaaatgagcaatttcatcggaaaggcgccggccatcggaaatcccaaagacccggaggacccggatttggcacggatcgacgaacgctacgcgccgtactatcagtttgatgtagcagtgaatttattaattgcattgtaaaccaacaaaattggcaggattcgattccctacgtggaaattgtgcgttctctgatgcgccagtggcgaatcgtcgacttggccaacccggcccaattctatgggatgggcgtccacgaagtgaacggctacaacatttaccattggaactcaatgcaagtcaccgggggaatgctgcgtcctccgttcatcgcgtccaatcagtcgttagcacaaaattttggtgctcacaaatatatacttttattttaattaacaactaattgccaaaggttctgttggattcatcattggccatgagctgggccacagtttcgactcgtacggctatgaatacaatgcggacggagtgaaggacgaaaagtggtggagcaaagcgtcgaagaattcatttgtgaagcgaaagaaatgttttgtggaccaatactcggcatataaggtgagtaaattggtggcaattgattattaaggctttatctttttggttaattattgttaattgtcctcctctcccccaatttccaattccattcatcctcccctcctccgtttttgccgtagatgacttttgagggcaatggcctttctgtgaacggcacgcacacagtgttcgaaaatatcgcggacaatgttggcatccgtgcctctttcgccgctttgaaggcacggctggccaaactgagcacaaacaaacggaggcgggaggagaaaaaggcgcaagagcaaatgcaaattgaggaagagaaactgagcaatgaacaactgttcttcctcagttacgcttatgtgagttacaaaagcaattcttttaaatacttaaattttatttgaattttgcttttattttaattgacttttaatttttagttttgttttaaattacattttaaatttagtcctggtgcggacgaacaacgcgcgaacgaatggccaaatatgtgaagcgcgacccgcacgcgccgcgcgaagtgcgcgtcaatttggcactcgccaactttcccgaattcgccagtgcatttggctgcgcctccggcactccgatgaatccggaaaagcggtgcactctttgg

SEQ ID NO: 66178 - DNA, 639 bp, Heterodera glycines
  Genomic contig location: Contig_ID=SeqID_7856; Location=3060..3698; Strand=+
  SCN-specific regions: Sequence locations=1-116,139-366,402-639
atgccattgcgacaacacttcaaaagttacgcgggccgagcggacaatgcgatcagtgtttatgacgtggcaaaccgacacattgacaacgaactgttcagtaagtaaatctaatcaaaaaaaaataaaaaataaaatggatttaaattttgaaaagtggaaatttaaatttagcatttttggagacgtacgaacacagcaaagggtcggattttcacagaagtcaaatcgcacgcaaaatgctaatgttccacaacaaatgcattgacgaaagaacgcgggcaaaacaggccggactgtccattgaaatgcttatcaaacggctcaaaacaatgcgcagcgatggatttgtaagttgaacaaaacattaataagattaattaaaaattatttttaattttctatttctataaagcattcattaatgattattcaaccgttcagtcgacgaccgacatgatgatcgaaatgtttccacaaattccatttctgttcctccaaaaatggatagacaagcacatcgccgttcaaatcaactttggccttttctacaatgtgtggccattgccaaattgggacgaagatgtcagagcccttctgaaggatttgctcaaggtggcatttgattttgccttttga

SEQ ID NO: 66179 - DNA, 485 bp, Heterodera glycines
  Genomic contig location: Contig_ID=SeqID_7856; Location=6373..6857; Strand=-
  SCN-specific regions: Sequence locations=1-485
cgcaacaacagcaggctcaattcggccaaatgagtgtcagcgacaatggcacggcttctcccccgcccgccggcaacggatcctaccgggccaagcgaagtccttgctgcgattttggctcttaccctttcatggagccaccatcgcgttacggcggtttccgctaccctttcatgggcccaccaccgcgtcgcggcggtttccgtcgcggtggtcggcgacgcggaccgaccggtagcaccgcttctccgtcgtctaccaacagtgcagcattggcggaccagttcatcgtaaacaacgaaacggagacgaccccaacgccaacggaggggacggaaagcagcagaagtacggacggaacaaccgcaacgaatacggacggaacaaccgcagcgaatacggacggaacaaccgcagcgaatacggacggaacaaccgcagcgaatacggacggaacaaccgcgacggacaatggccaatcgtaa

SEQ ID NO: 66180 - DNA, 804 bp, Heterodera glycines
  misc_feature (17)..(17): n is a, c, g, or t
  Genomic contig location: Contig_ID=SeqID_36992; Location=4..807; Strand=+
  SCN-specific regions: Sequence locations=1-246,270-314,337-502,524 -726,749-804
atgaaatttgcaaaganaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaagacgtacggtaaaggggatacttgaaaatagaccacagaaggtagtgattgagaaacatgtaccaggtccaaatgttgcaccatatctgggcctcaataaccaatccaaaccacaggagaccgaagaaccacggaaaataattattcctaggaaaagacttgaagagcaaactcctgatcctgaatcagataatgatacacttgaggagttaactccggagccccaaacaacatccacactcaaaacacacattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtag

SEQ ID NO: 66181 - DNA, 990 bp, Heterodera glycines
  Genomic contig location: Contig_ID=SeqID_36994; Location=181..1170; Strand=+
  SCN-specific regions: Sequence locations=1-192,215-990
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgatttttt

SEQ ID NO: 66182 - DNA, 478 bp, Heterodera glycines
  Genomic contig location: Contig_ID=SeqID_36997; Location=146..623; Strand=-
  SCN-specific regions: Sequence locations=1-189,212-478
  Gene Ontology: Mol. function=calcium ion transporter activity; Cellular component=integral to plasma membrane; Biological process =calcium ion transport
ggttcacgagaaagaattgctgtttctgaatgagcagacaaagtgtgaatgaatcacatttggacaatttaaatgcaaaaggaattattgcagagccgaaattcacatcgaaattattaatgacgacgaatatgaaaagtcggaggaattctttgtggagatgggcacgccggaatggagggatggaaagggccaagtggggcccaaggagggacagcccgacggaagaccgattttgggtcagtgacggacgaatggcaccacaaaaggccattgttcaggggaacattcgcgctgcaaaattttgatcactgaggacaaggagttcaagaatttcatcgacaaaatggtgaccaatgccaatgtcggctttcttgttggcacccacagctggaagcagcaatttgcagaggctctaacggttgaggacatcgacggaggtgggcattcccttgggaaattgaaagatacggactga

SEQ ID NO: 66183 - DNA, 893 bp, Heterodera glycines
  Genomic contig location: Contig_ID=SeqID_36998; Location=118..1010; Strand=+
  SCN-specific regions: Sequence locations=1-835,857-893
  Gene Ontology: Mol. function=transporter activity; Cellular component= secretory vesicle; Biological process=locomotory behavior
gttgcactcgaggcggccaaagtgttggacgacaagaccatttgggtggcgttgggcgaggccgcgctgctgcagggtaaccaccaaatcgtggagatggcctatcagcgaaccaaggactttgagcggctggccttcctctacctgatcacggggaaccgggaaaaattgcagaaaatgttgaaaatcgctcaaatacgcaaggatgtgcacggacagttccaatgcgctttgatgctcggcgacgcgcaagagcgcaccaaaggtactgctcgaacactatgtggttgtatttatgagtataggtgaaatgtagggggatgttggcccgactgcataccaacgaagatcaggagggttcgaaagacctccatttcatcccagtcattacaaagttactccattttcgcccccccccccctcatttttatttcactcctattttggaaaaaatttaccacttggagtgttcagactctacgccacccctccgcccccccgtgaccgtcccaggggtatagttagtcacaaatacaaaaaataatttaatctcgctgaaaatttttctttacggaagtctgtaattgactgtaaaaaatttgcagtgctcaaagaacttggccaacttccgctcgcctatttgtcctccgtgactcattcgcttgacgaggatgcggaacagttgcgtgccgagttggaacagcgtcaaattgcggtgccggaaacgaacacaagcgcaactccactgctgccgatgacacctctcaatccgctggtggacaattggccccagctgaccgtctccaccgggccctttgatgcacagcaactgttggccgcgacggcggcctccagcggtggcggcactctgtccaccgcaattggaaaatcga

SEQ ID NO: 66184 - DNA, 347 bp, Heterodera glycines
  misc_feature (280)..(280): n is a, c, g, or t
  Genomic contig location: Contig_ID=SeqID_37000; Location=442..788; Strand=+
  SCN-specific regions: Sequence locations=1-347
atggccgaggaaatcggcaccacagaaattgccattgagcccctagtgacaacaactccaaaaacaacactaacaatgggtgcaaaactgaaaaaaccgttgctgaacaaactcaacaaaatggtaaaaaaaaattggttttacgaaaaaattaaaatggggttaaaatcaaaaaattggcatttttgaaattaccccaaaattcgaaggtattttaaaaaaaatttaaggatcctggcgaactgcgccatctcgtggccgacatgcagtcaaggcttgnccaggtggaggacacgaatgttgaccccccatgtaaggctcagcacaatgccgtagaggagcgtgat

SEQ ID NO: 66185 - DNA, 1639 bp, Heterodera glycines
  Genomic contig location: Contig_ID=SeqID_7857; Location=1364..3002; Strand=+
  SCN-specific regions: Sequence locations=1-706,733-807,829-1194,1216 -1234,1256-1610,1632-1639
  Gene Ontology: Mol. function=DNA dependent ATPase activity
atgtcatttcaaactaaatcctactcagcaacaatacaactgacagatgaacaaagggagcgggttaagcaaaacagggaaagggcgctgagaatacaggcggaaaaggccgagcagagaattaaacagggtccaactgcagcagcaagtcaacttcttccccacatggatggaatggccatttccaacaacaaaccaccaccgctaattggagaagttggcactttcctatttttactgaattttattatgtctctttaaagagacttgtgtgccctcgtcccattcaaattcaaccccctattacaacaaaaaattccaattcgccccgaccttcgacgagttctgtgcagaaagtacttgttcaaatggacttttctctaattaacgcgaatcgctttaaggtgatttcactattcctgtccacaaaataccattttaataatttaggtgcaatttactccttttaatagagatgtggtggacaaactcaagtcaattccttcacggcctttcaatgcagacgacaaaacatggtctttccttatcgatgattatgaatcgaccaaaaaggcattgaacggactgaatcgcacagtaaatttgaaactcgccgaaattccatttgacgtgagaagggtcagtcaagtctatgtgttttgtacttttaaaaccgtaattaaaaacattttagttgtttttgactaaaagtaatgccaaacccaaagtgaatttggccaaaattggacaacatctgctagattcgctattttcttttcagcgctgtggagtaaggtccttttccacattatctattttgataattttcaatttctgcaaattttaagcgttggcattgaaagagatggacggattttgatagcggacgaaatgggccttggcaaatccatacaggctttggccatcgccaattactaccgtaacgagtggcctctgcttattgtctgtccctcctccgtgaagtacgcctggatggggcagttcaaacgatttatgcccaatgcaaatgtttacatcatcgaaaaacaaagcgaccctttgcctatctcacgcaacacttccgtcgcaattgtaaattttacgaaattttactagtttttccacttttcttcaggtacttagctatgacctcatggtttccaaggccaaacaattgaaaagcaattccatttatgttgttgtttttgtgagtttagctaagttattatttaattggaaaggaaacaaaattaggatgaatgtcatttgctgaaggagcagacaacgcagcggacaaaagtcgcatttgaactttcggtaattaccaattccttataaatttagtcattaatttacagaaaattgccaatcgcgtcattcttctcagcggcacacccgcgctgtcaagacccagtgaattgttcacgcaagtccgaatgattgacccgaaaatatttcctagttgggtgaaatatgccgtgcgttactgcggaggaaaaaagggacgttttgggtttgaggcgaaaggaaggtgtgcactttgtatgtcatattttgcatttggaagaaataatttcgaaattaaaggtctaaccccgacgaattaaaaactgtgatggataaaattatgataaggtaa

SEQ ID NO: 66186 - DNA, 600 bp, Heterodera glycines
  Genomic contig location: Contig_ID=SeqID_7857; Location=3872..4471; Strand=-
  SCN-specific regions: Sequence locations=1-83,109-146,177-600
atggctccgacgtattacgacctcaattcattcccggatggcagtgacgcaaaacggaagctgtacgccataatagcgacaagcaagaaaacccaccaatgaatctgaccggcaggcacgaacagtttttattttgtcatattgtatttttaaagcaaataaataaagaaaggaattacaattgggaaacaattaaaagttccaagactctttctatacaatggctcacagatgtcctattgcattctttgcactccaaaatccatcggttttatgcgttttgtcaccggttctccattgtcatcgccacaattcatcacgttaaagaaatccgtgataagcgagctcgccccacaatatttctctgagttctcaatgccgcgatagcttaaacatattcagaataaccaaaaaagcgaataaaaacaataacatacgtttcgttagagagattcacttcaccgagcactttcaattttgagccaaccaatgaccaaatatccatgtcagccgtcttacgcgccagcaaatattgaacatgcacagaatccttctgcccgactcgatgagctcggtcttccgcttggatcattaacttaa

SEQ ID NO: 66187 - DNA, 880 bp, Heterodera glycines
  misc_feature (801)..(801): n is a, c, g, or t
  Genomic contig location: Contig_ID=SeqID_7858; Location=1..880; Strand=-
  SCN-specific regions: Sequence locations=1-619,641-880
  Gene Ontology: Mol. function=ATPase activity; Cellular component =spliceosome complex; Biological process=lariat formation, 5'-splice site cleavage
cgcaatccattaactggacggccgtatacgcaacggttttgggacttgttgaagaagaggatggggttgcccgtctgggactacagggagaagttcatggaattgttgaacaagaaccagtgcattacgctcgttggtgagactggcagtggcaaaacaacacaaattccgcagtggtgcatggactttgcgcgggagaaaggcgctttggccaatcggaagtacatggtgtcctgcactcagccgaggcgagtggcggcgatgagtgtagccacgaggtaagaaaaatgatgtcgttgtgacacttagtttaacttccaacatttaagggttgccgaagaactcgatgtttcggttggtcccttttcgtgcattggtgtgcagcagctttaattttcacaattgttttttagttgggccaggaagttggctattcaattcggttcgaagactgtgtcagcgatcggacagttctcaaatactgcactgatggaatgcttttgcgcgaggctatgaacaacccacttctggagcagtacaacgtggtcctcttggatgaagctcacgaacgcactttagccaccgacattttgatggggctgatcaaggttacctagttccaaattttgcgaaaaaatttcccacgtttaggaaataatccgacagcgtcaggatctcaaaattgtcgtgatgagtgccactttagatgcggggaaatttcagaattacttcgacagctgtccgttactttcggtccctggccgtacttttccagttgaaatattcgtaagtgaaatccanaattttttgaaattcatgatctatttagtatacacccgagccggaaagagactattgggaggccgcagttcgaacagtc

SEQ ID NO: 66188 - DNA, 152 bp, Heterodera glycines
  Genomic contig location: Contig_ID=SeqID_37005; Location=67..218; Strand=-
  SCN-specific regions: Sequence locations=1-152
caggtccagcaacaacaggccgtcatctccgaacaagaccatcaactccaacatttcaaacaacataaaatgatggaagaggtcattcaagaccatgagcgtcggcgaagcgtcgtcgtaatgggtctacccgaatcgcagaaacaaaagcc

SEQ ID NO: 66189 - DNA, 278 bp, Heterodera glycines
  Genomic contig location: Contig_ID=SeqID_37006; Location=7..284; Strand=+
  SCN-specific regions: Sequence locations=1-278
atgagtgcaacgaagctacccggtgtgaacacccgacgcgatccggccaacaccgatcacgaagatgcatcctccccctacccacttggatttatcgccacactgcatcgcattggcgcgggcgccgctgccgatgggcagccctggcccgagcgcaatctgagcctcgggcgcagcatgcagatggccgatgcggattgcgcgctgggtggcctgcgcgtggtggcggagctgatgctggcggcggagcgcacgcgacagaacggcaccgacgaaga

SEQ ID NO: 66190 - DNA, 1048 bp, Heterodera glycines
  misc_feature (1004)..(1004): n is a, c, g, or t
  Genomic contig location: Contig_ID=SeqID_37011; Location=43..1090; Strand=-
  SCN-specific regions: Sequence locations=1-809,831-1048
atgattagaagaagtgcaccattgattagaagaggtacaacagtgaattagaaaaggtacaacagtgaatagaagaggtgcaacagtgattagaaaaggtacaacagtgattagaagaggtgaaatagtgattagaagaggtacaacagtgattagaaaatgtacaacagtgattagaagaggtgcaacagtgattagaaaaggtaaagcagtgattagaagaggtgcaacagtgattagaagaggtacaacagtgattagaaaaggtacaacagtgattagaagaggtgcaacagtgattagaagaggtacaacagtgattagaaaaggtacaacagtgattagaagaggtgcaacagtgattagaaaaggtacaacagtgattagaagaggtgcaacagtgattagaaaaggtacgtgattagatgaggtacaactgtgattagaagaggtacaacagtgattagaaaaggtacaacagtgattagaagaggtgcaacagtgattagaaaaggtacaacagtgattagaagaggtacaacagtgattagaaaaggtacaacagtgattagaagaggtacaacagtgattagaaaaggtacaacagtgattagaagaggtgcaacagtgattagaaaaggtacaacagtgattagaagaggtacaacagtgattagaaaaggtacaacagtgattagaagaggtgcaaaagtgattagaagaggtacagcagtgattagaagaggtacaaaagtgattagaagaggtgcaacagttatcagaccactttttcgccagaagaaaaatatgaaactcaaaataaatgttatattcatgatcagtggccaaaaaatagcccagaaaaatcattttcaggctatttttgaagaaaaattttgtccatctgaaaaccaaatgggtctcccctttcgtcaggaaattcgaaacaacttttcgggcgataactttttttgaagaagtgatggataaatagtgcaagtaancttttttgtagagctaaaaattacggattttttggatcattaaa

SEQ ID NO: 66191 - DNA, 846 bp, Heterodera glycines
  Genomic contig location: Contig_ID=SeqID_37011; Location=271..1116; Strand=+
  SCN-specific regions: Sequence locations=1-846
  Gene Ontology: Mol. function=growth factor activity; Cellular component=lysosome; Biological process=cell-cell signaling
ttttgagtttcatatttttcttctggcgaaaaagtggtctgataactgttgcacctcttctaatcacttttgtacctcttctaatcactgctgtacctcttctaatcacttttgcacctcttctaatcactgttgtaccttttctaatcactgttgtacctcttctaatcactgttgtaccttttctaatcactgttgcacctcttctaatcactgttgtaccttttctaatcactgttgtacctcttctaatcactgttgtaccttttctaatcactgttgtacctcttctaatcactgttgtaccttttctaatcactgttgcacctcttctaatcactgttgtaccttttctaatcactgttgtacctcttctaatcacagttgtacctcatctaatcacgtaccttttctaatcactgttgcacctcttctaatcactgttgtaccttttctaatcactgttgcacctcttctaatcactgttgtaccttttctaatcactgttgtacctcttctaatcactgttgcacctcttctaatcactgttgtaccttttctaatcactgttgtacctcttctaatcactgttgcacctcttctaatcactgctttaccttttctaatcactgttgcacctcttctaatcactgttgtacattttctaatcactgttgtacctcttctaatcactatttcacctcttctaatcactgttgtaccttttctaatcactgttgcacctcttctattcactgttgtaccttttctaattcactgttgtacctcttctaatcaatggtgcacttcttctaatcattgttctaccttttctaatcactgttg

SEQ ID NO: 66192 - DNA, 2313 bp, Heterodera glycines
  Genomic contig location: Contig_ID=SeqID_7859; Location=747..3059; Strand=-
  SCN-specific regions: Sequence locations=1-634,658-756,791-798,820 -1214,1237-1323,1345-1397,1419-1564,1586-1650,1702-2070,2109-2313
atgttctgccagcttttgctctttggctttttgcttgcaattagcatagtcaccgtctgcgctgctaaaagggaaataaatttgtccatttatccgcctcccatatccaacgactacaattaccgtataaaaatttgctgtaatcaaaacagtaatagtggagcagctgttgaagtgccattttcacttcaccaacagaagttaattgccgaacatactctgtgtggaacgaaaaattcagagcagaatgtgaacgaagggcaattcctcgaaaatggtaaaaatggaattaatcagtcccgttaccaggaaaacaagggatgccaaatgtcgcaccccctaaataatttttttttgaaaagtaagtaacaggaatatttggctgttattcgccctcccctttccgaagaaataccccatttgaattttaaaatttttgatttaattcagagaaaattgctgaaaatttgaaaaaggcaggccaagttgtttatatactagcgctttccgagcgtctcggtctcgagtccctctagagtttttttttttttgctgtctttctcacggggtttcggactcggtcttcgagagtaaggctttttacactttgatttatagcaaactttataaatcgtttatttaaaatttatatattttcggtaattttttgcttctttgtcgtacaacatatacataagtattcgagttcaaaaagtcgaaagtcggaattccgcgttgcgtaccttaaagttgtccttaaattattatatttttaaattacaaatataaaggcacagataaacaattgaatggaaaacaaacgcaactcggtacagttgctcaaaacaaattcaattttacaatttcaatgcccgcaaaagctgaggaaaatttaacacaatgtgccaacaatgaattgttcatcgaaattgttaaaatttttgccacaggttttttaaatcaaagagaagagaaactggtaagaccccttcttatttcttggcataactttatatttgaaaacgaaagtgttaactatgcatattaaaaccttgaaatgtaggaaaattaaattgtaaatcatttttcaaaaattaaaatccgaaaaattatttttgtgtattttaattcttttaattgccgcgatttttttttataattttccgtgttgagtttttattttgtcagaatgcctctattttcatccaaaatcattaatttgaaaattttcatttttagttaaagctcgagcgaatgaccattgaacagtttaaacgaaccgacaaattagagtacgactttgaggaggaatactgtaaaaagtttgagatcatttcacacatggaaaagcaaccatttgaattcactttacgcatctcaaaggcatccggcgttagcagccaaaactttatcctccagcaagattttgttgtctacaaaaagacgctgaccggtggtactgtaaatattacggtccctataaccaaagagattaaaatcagcgaacgtcgtgacggcatacaaatcaaaatcaattctgtaataaataatatcattgtatcatttaaaatttataatcaaaactgattaaaaaattaagcaaattgacaacactgacaacgaaaatgagacaaaaaattttgtggtaacatattttttaaattaaaatataaaaattattaacaacaataaaaaattttacagaaaatctaccgaattaacgatgaaatgtggaacaattacagttcatttaaaattgactttaacaaaagcgatgtcagcccgctgaatacggtagaatcgacaaacgacaatcataccatacaacaaagagggaattcgaacattcaagtgaacaaaaaacagatttccatggcaaaaagtaccgtaacacaaaacggtaaggcaaaagtgattgtacagggtgaacagcagcggaaaaagcaaggaactcgcaccgtacaataggagtaacaagtcagtcctactgtgtagcagaaagaagactgcatttttcatgtgaacagcagaattcgtcgatattttccatttcttattttaaacaacccttttactttctttctttgctttttattgttgttgttttgcgtgtaaaaatcgtttttagatttttgaaatgagtcacaacggatgtaccgctttttatatctgtatgcgtcgaatttaatcaagaactgtgtcaataaggtcgataatcgggtccgctttggacgtaagcgatgggcagagtccaaagagcatggcacataaatcccaaggactctaattttagtgtttgcttcttgaaataaa

SEQ ID NO: 66193 - DNA, 373 bp, Heterodera glycines
  misc_feature (289)..(289): n is a, c, g, or t
  Genomic contig location: Contig_ID=SeqID_7859; Location=3650..4022; Strand=+
  SCN-specific regions: Sequence locations=1-373
cgccatcgtcgctgacgatacacaacccaaacatcgaccaaataaacaaccgagcagagaatgagcgcggcgaaaattgtgccgatgagcaacggatccgtcgacggcacgacatgccattggagaagcaatgtttcatcactgtccatatgtagaaaattccgatgggaaatatgtgcaagaattgtcacatttgcacaaagcattaatccagcagaaaggagcgcataagttaatgactccttaattgataggaagagatttatggctaaacaaatggaatctttanaacgaaatttgtcattagaccgggaattttgggctaaaccagaaccagaaaagccatgaattttcaaaaaaattttaaattttt

SEQ ID NO: 66194 - DNA, 279 bp, Heterodera glycines
  Genomic contig location: Contig_ID=SeqID_7859; Location=3613..3891; Strand=-
  SCN-specific regions: Sequence locations=1-279
gagtcattaacttatgcgctcctttctgctggattaatgctttgtgcaaatgtgacaattcttgcacatatttcccatcggaattttctacatatggacagtgatgaaacattgcttctccaatggcatgtcgtgccgtcgacggatccgttgctcatcggcacaattttcgccgcgctcattctctgctcggttgtttatttggtcgatgtttgggttgtgtatcgtcagcgacgatggcggacatgggttacggacaaatcgaactataaaatatag

SEQ ID NO: 66195 - DNA, 1003 bp, Heterodera glycines
  Genomic contig location: Contig_ID=SeqID_7860; Location=225..1227; Strand=-
  SCN-specific regions: Sequence locations=1-291,327-672,697-706,799 -907,929-956,978-1003
atgcagaagacaaaaagtgatgatgttcttgaaaccatttcaagcactgttcagtttcattcggaatggtaatttaatgtttttaatttttgtttttcgtttttttttgtaggtatttgggctccgagcgccaatttgtgcacgacttcaacacttccattaggaaaagcataaaatgcaagcagtgtaggacaaatctattctgctgttcagctgcttattatgacgaagaattcttaaaaagtggtcaatggcttgccaaaattgcggaaattgtatgaaattttgttgaattaaattttaatttaaaaatttttttatttttacccagccaacaaagttaaaaatattccacagttattgctgacttaaaaaaggttctaatttaacttgattggtcaaaattagttgggaaattccttcgacctcatcaatttcttaggacgttagctttgattaaccttttttgatttttttttatcgttagagcgcgggttttacgggtttcaaattttttgtacatttagatgggcctaaaaatcaagtaaatagcgtttttgcttggttttatgcttttagaatgtgctttattcttacttattttttgccatattttttgattttctcgtccatccgctatctacttatttgcttaattatatagttcattaaaataatccaaagaaaatttatcctaggcgctatgaaaatatataaaattatttattcatttcattgaaatattttttttcaatttaattacaaatctaactttaaaacaaaataattattttttttgttttgccagtgcatttgcctttttattattttggtttctcttttcaacaatggattttacggcgaagttgggctttcaattgctgttgctgcagcgtctctgacaatttcttgtgcttttgttgtgatcaaactgagaacattgaatcgatgggcaactcaaaaacaatggtttattatggtagttatttattcttcattataa

SEQ ID NO: 66196 - DNA, 65 bp, Heterodera glycines
  Genomic contig location: Contig_ID=SeqID_7860; Location=1..65; Strand=+
  SCN-specific regions: Sequence locations=1-65
gtataaattgaaattgaaattgtcttttgttaacagatttcaccaaaattgtaacttttatgaat

SEQ ID NO: 66197 - DNA, 598 bp, Heterodera glycines
  Genomic contig location: Contig_ID=SeqID_37012; Location=313..910; Strand=+
  SCN-specific regions: Sequence locations=1-598
  Gene Ontology: Cellular component=extracellular space; Biological process=cell proliferation
acgccgaaccgtgtcgaccctcgtttgccactggacgacaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgtcaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgacaacactcagacgccgaaccgtgtcgaccctcgtttgccactggacgtcaacactcagacgccgaaccgtgtcgaccctcgtttgccactggacgtcaacactcagacgccgaaccgtgtcgaccctcgtttgccactggacgacaacactcagacgccgaaccgtgtcgaccctcgtttgccactggacgtcaacactcagacgccgaaccgtgtcgaccctc

SEQ ID NO: 66198 - DNA, 216 bp, Heterodera glycines
  Genomic contig location: Contig_ID=SeqID_37015; Location=199..414; Strand=-
  SCN-specific regions: Sequence locations=1-65,95-216
atttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagcca

SEQ ID NO: 66199 - DNA, 290 bp, Heterodera glycines
  Genomic contig location: Contig_ID=SeqID_37017; Location=966..1255; Strand=+
  SCN-specific regions: Sequence locations=1-120,143-290
atggcttttgtaaattctttatcgtccaacactaaaacaattcactttttgaagaagtctttacttcttgcacacagtatgttctttgcattgttattttcaccaattttgttttttttaattccacaacatttttagattattgcactttttcgcgcgaatggtctgagatggaatatgaaaggcacgctgaggacactttggtggcactcactgagtatttggacacattgccggaccgtgtcgattgtgaatctgtaagcatttaatcagagacattttgatgtaaa

SEQ ID NO: 66200 - DNA, 501 bp, Heterodera glycines
  Genomic contig location: Contig_ID=SeqID_37017; Location=117..617; Strand=-
  SCN-specific regions: Sequence locations=1-501
atgtcctcgcttttcgattccacttgggaaggccatctccaacatatcaaattttggcgcagcgaagttgcccttgatggaattaaacatttaaatcctctaattaaggtgaagcgatcactgggcgagtccatttcgaatgtccaattggtgaagggagcggacggaacaatggcagttgttggccttgcgactgcaccgggcgattcggcacacgtccaaatggtcatgcaagccgaactgcccgacatttctttgggcgacgacttcgagcaggacgagacaaagcaaaggccgactttggaattgcagccgctgttttcgcataaaaccgaagcggagcattcgacggacgcatcgcctcggaaaataccgcccgaattggcgttgcattacgaaagaatgcgtggccaaatggtggacggagtggacgacttcaaattgcacgagaaaagcggcgcggtgctcttcaccaccgccaaagaaattagcatttttaag

SEQ ID NO: 66201 - DNA, 270 bp, Heterodera glycines
  Genomic contig location: Contig_ID=SeqID_37018; Location=74..343; Strand=+
  SCN-specific regions: Sequence locations=1-270
atgaaatcaattcgaacactaattgaacaacagcagctactgaaggcaccaaaacgcacaagaaagtcgtcagatttcgacgacaacagccacaattatctgccaaatccagtgtgcttccacgcagagcaaaaacgcaacaaaattaagaagacagcgatggaaaacccgcgccaaaatccatccaaaatgctggcggaagtccatgcagacaccaaggacgaaatctttgttgctatgggcattgatctcacactggcggcagaatga

SEQ ID NO: 66202 - DNA, 247 bp, Heterodera glycines
  Genomic contig location: Contig_ID=SeqID_37018; Location=466..712; Strand=+
  SCN-specific regions: Sequence locations=1-83,105-247
atggcgaaaacattgttgcacgacagcgaaggcaccaccaaaaagggagaagtaagttccgatggtccgtcccaattcaatggttttttcttcttttaagttttaggaacgtgaaacaaaaagaatcagcagcaattccgcattatttgaaccgctgaaatggagattgcgcgacaagttggctcagtcgcttctcgacggcactgaacaattgaacatgcagagccagaagattgaaattttataa

SEQ ID NO: 66203 - DNA, 187 bp, Heterodera glycines
  Genomic contig location: Contig_ID=SeqID_37020; Location=1..187; Strand=-
  SCN-specific regions: Sequence locations=1-187
caaaatctgtgcgcggtttgctctgtcctgtcagcggacgtgtcgcttcttccgttcggccatcccctgagtcttgcacccgaacataagtctcctctcggcaaatctgtaaacattcgtaaatgcattgttaattacccctctatagtagctatttagcccactctttgctccaatcaatgctttg

SEQ ID NO: 66204 - DNA, 989 bp, Heterodera glycines
  Genomic contig location: Contig_ID=SeqID_37021; Location=105..1093; Strand=+
  SCN-specific regions: Sequence locations=1-302,324-794,818-989
atcaaacgcaaaataagcgagcgaaagggcactaaagggtcaagagcaagctctgcggcgtcaagttgccgttcgctgtcaccagtcagtagcttggccgcaacaacgcctccaaaaccagcagcaaaaacgccacagataacaccagcaacaaaaggcacacaagccaaaaaacatctggcaattgactcaaaaccaggaccatccaaccggttttctggcgaaagcgttgctgtcgttccaccaccagctcccaaagtccagcagaaaaagccaactgcgcaaactgaccagcacgctgaagcaacaacatcagcaacaacagcaagcaaagcgtttttgacacgtgccgaaccaaatggcaactgcttcttcaatgccatttgcttgacattgttcggatcagaaaaccacgcagaccaacttcgcaagcgaatgtgcacatttctccgaacaattcttgctgatcagcggctgtttttgcggcagaatcccaactacaacaccagggaaacatttctgactcgcattgaccgcatgttgcttcatgggactgatgaaggaataacaacattggaggagtatgctggacggagggagaaaaaccgggactgggctcaggtgaacgacagcatgctgttggccatgttgtttcaacgaaccgtcgttatcattacaccaaatctctcgcgacgagaaattgaacgacaaaatccacagtggaactatgctaaccaaaatttatatgtctacttcccggacggcgaaatgcgggtagataaaacgcaaataataccttttaatattaaaaattcatgtagcaatctctgcgcaatgttcctgtggatcagctccaaaagtttaccatggtccaagacgttggaacccatgtggacagacggcctgtcaacaatgcaattgtgctctactacaatggcctcaaccactttgacaccgtcacttttgtaatgcaaaattaattttgaaaa

SEQ ID NO: 66205 - DNA, 1983 bp, Heterodera glycines
  Genomic contig location: Contig_ID=SeqID_1018; Location=618..2600; Strand=+
  SCN-specific regions: Sequence locations=1-218,240-325,349-363,385 -539,561-1292,1316-1374,1396-1433,1455-1983
atgagcgacaaattggaaaacctccttcaaaaactgcttacggcgcaagccgatcagcaaacccaatttactcaagctttaaattccttggtcaacaacaatcccgacaaagaacaggcttcattgttctcgacaattaattcccaaatttcagaattcgtgtatgaaccagagaacgaccagacatttcagacatggttcgaacgattcggcgagtacatcacaaccgatggcaagctcctcacggacgcgatgaaggttcgggtggtagtcggtaaattggggagtcaggagtacagcaaatatgtggagcgcatactcccacaaaaaaccggggatttaaattttaatgacaccattaaaaagcttgaagacatcttttgtggcacaaaaagcctcttcgtgcggcgctacgactgtttcagaatggcaaaggcaccgagtcaagcagttttggattttgcctcgcatgtcagtgccgaatgcgagaagtcaaagatgcaattgaccaaagaagagatgaaggcgttcattttcgtcagcggcctggacgagggagaccgtgacctccgcgaacgatgtttgcgcatgatggaagaggcacgacaacgcaacgcgaccatcacattcgcaagtttgattgaggaatgccgatcaattctttcattacgcagcacagcagctgccttttcccaatcatcatctttaggcgctcaaacaaattcaatttcagtcaggccacagcaaattacagagcgttcgagcagaccagcatcgaagggacagaaccgaacattcaatcatcgttccccttccgttcaatcacacaggtccgatcaacagcgaaaaccgccaccgccattcccgtgcaaatggtgcaaacagatgcattggaacaacgagtgcagaaatcggaacaaatgcacaaaatgcggaaaattcggacacaattcgtcgacatgccgatcgcgcaattattcaaatgatcggaaattcaaccgcggttcgatgacggtaatgtctgtgcatgattcgagcgagccatggatcgacattcattgtaagatcaatgcgtatccggtcaaactcatggccgactcgggatccaaaatggcagtcattcagacttgcctctgggaggaaattgggaaacccccacttaatcattgcacagctaatggcacatcatattcaggcgatgaatttgaaatttcagggtggttcaattgtcaggtcacttatggtgacatcacgctcaccttaaaatgttttgtcacgcccaaaggtgtgatgaatttatttggtttgccgtggattcgtgcgttcgaaacggcactccaacggccaattgcgaccactttgccaatgcccttgccaacagcagcatcacatcaaagcatggcgattccatcatcaacagaattggccgacctactcaaacaaaatttcccagatgtttttagttcagagttgggacattgcaccaaaatgagggctcatttgtatttgaagccaggcgcacagccagtattctgcaggcctaggccagtaccgcatggagcacgagatgctgtcgacgcggagttggaccgtttgttaaaaatcggtgcaatcaaaccggtggatttcagtaaatgggccgcacccattgtggcggtcaaaaagaaaagcggagacattcgggtctgtattgatttctcaacaggtttgaacgacaggctcgagctcaaccgccatccgctgcctcggcccgatgacattttcaatttaatccgtggcgccactgtcttcagtctgatcgacttcaaggacgcctacctacagatcgaattggactacgagtcgaagcagttagtatgtttaaacacacatcgtggtctgtttcaatttcaaagacttccatttggcattaaatctgctccatcaatttttcagaaattgacagatcagctcatcgcaggcctgcccgatgttcatgaataa

SEQ ID NO: 66206 - DNA, 1926 bp, Heterodera glycines
  Genomic contig location: Contig_ID=SeqID_1019; Location=32..1957; Strand=+
  SCN-specific regions: Sequence locations=1-253,275-1223,1245 -1341,1363-1735,1758-1926
atgatttatggccgacagttcacattgctcactgatcataagccattaatttcaatttttggttcaaaaggtggaattcccatttacacgggttccagacttcagcgttgggcactcattctcctgaactacgacttcaaaatcaaatacatttcgactaaagagtttggtaaagttgacatgttgtcgcgactaattgccaaacagcgagaagacgacggagatgaccatgttattgccaacatcaatcagtttcccatttcagaagaggaggagcaactcgatttgtgtgccaacgcagtcgattacattttccaggcaaacattgaacagttaccggtcacagcattggaagtggccgaagcaacgaaacaagacgaagtcctgagcgaagtctcacagttttgccgcaacgaatggccaaggaaagttcaatccccattgattgaaccatattttacgcatcgttcgaaaatctccgaaattcagggatgtttgcatttcggggacagagtcatcattccggcaaaactccgtcagcgcattctcacggcacttcatttttcccacccgggaatcgtccgaatgaaagcgctggcacggcaattcgtctattggccacggattaatttggacattgaacgttggtcaagaaattgtgccgattgttcccttgcagcgaaaatgccagcaaaagtcccacttcaaccatggccgacatcgcatgaagtcttcgaacgacttcacatggactttgcaggaccgtgtgccgatggaaacaaatatttgatcatcatcgacgcgtacagccgttggccggaagtgatcaaaatgcattcaacgacagcacgatttgtcattgatcagtttgtttggttattctcacggtatggatatccaaaacaaatcgtaactgataatggtccaccattaaagtcatcaaaaatttttgatttttgcagaaaacatggcatcgaacaggtttttgcaccgccatatcatcccatgttaaatggacgagcggaacgttttgtcgacaccttcaagcgacaaatggcaaaatgttcaaggacggattcaaattgggtgcaaaactccttattggcataccggagcacaccaagcgacattctcagcggaaaaacaccggctgaacttttcttagggcgtaaaataagaacaattttttccctattaaagccaaaacaggagtcgcaacatcaacaaccgaggaccgatcacaaaacgcagcaaatggaggcacaattcaacaagaagcacaacacacatgagaggatcttcaaagtcggagacaaagtgttgttcatcaattaccgagacaacaagaaattttggttgtttggtaaaatcgtaagagggtcaggggtcatgtggcggattgaggcgccatgtctgagtgccatagtaaccaggcactcgaatcaaatacgacttttcaatcccatcccatacaaggaaaccgatcagattcagcactctccgcagcgtggtcaagcacagaaccctcccgaacaaattcaagtggagcgcgagatcaccccgccgagagcaccgaaaaaggtccgattcgccgatgaacagcctcatcatcatgaacagccagctgaagaagagcaaattcaagagacaccgaatctgaggcgttcgacccgcgtcagaaaagccccggaccgtttagatctttaaaagggggaggtgttgggtatgactaaagtccatttcattcccttccttcttttattgcatttctctatcctttattattgattgtgtctgaccatttcattcgcatataagcgcatgcattttcccccattttggttgttcgctctcattcattcatttcattttatgtttttcatctctctcttctttcgcatttattttatttgtgttttccaaaca

SEQ ID NO: 66207 - DNA, 1351 bp, Heterodera glycines
  Genomic contig location: Contig_ID=SeqID_1019; Location=2593..3943; Strand=+
  SCN-specific regions: Sequence locations=1-188,222-291,313-350,372 -549,571-688,710-793,827-1016,1038-1185,1208-1323,1346-1351
atggattcaccaaaagcgcctgaagtggtgccgttcgaggatgaacagttaagtgcggaggaaaaacaaattttgaatgatattgaagtgctgaaaacgaaactggaagagacaaacaagcgaaaaagtgaactgaaaaagcaaaatgaggaaaaagagaagataaaacaagtggacgaggtcatattagaagatgatgaagaggaggaggaagaggaccaaacgcccaaaatgagtaaaaagccgcggttggacccggttgtggcaaaatgtgttgtggaaaaagtcataaatgaaaagtgggaaggaaacgatttggtggtaatggatccaagaggaaagggatcaatggaagagcaaaatgatgaagaaagccggaggaaggaagatttggtgcgaattggccgaagaaatgatcacaatgaggcctggcgagagtttctgaccacaacgacttccttggacagagaaaaggaagagcgattaaaagcaatgggcaaaattggtttgggggaaaatggccgaagaatggcagagaaaagtatgagagcagcagagaaaacaatttttgaaagtccgtgcttacagccggaggggatgagaaggaatgtgattaatgaattggagagccaagaggagcgagagcgaaggaagcgtttcgccacccggactcctccgagtggccaagcatttgcaaattcggtttgggcggaaaaagattggaaaagggatgatgagggggaaaaggatgaaaaagaagagcctgtcttcaccaaaataataaaaattcaacggaagttaaaagaagcaaatgaagaattaaaaatgctgcaaaagagataatgaatgtgtttgtaaaaatgtgtgaaaaataacttaatgaatgtgaacagatcgccaaaagtgtgttcaaatattatcttctcacatgccccgtccattgaagaattggtccccaattctgatcagtttccccgggctcctctgatgcgacgtccccggcgcatggcggcgatggcagtgcttttcattgctgatctgttgaaattctgaaatggaaaaaaggaaaggagggatggatttgcctttggactcaaaatcaaatgtgccgttgtcagtcatgggaatgccattctgatcaaaacaaattaaaagctgttccagccatggggttcccattctggttaaataacaaatcaaattttaatgaaggcaaaatgtagttttgcagcacagtacaaattaaaagaaaggggaattgatctcaatcgaagatggcatgttttgggatgatcgtcggttggcattaatgttcacacatatttttcacacacatacaaatttaatgaga

SEQ ID NO: 66208 - DNA, 4135 bp, Heterodera glycines
  Genomic contig location: Contig_ID=SeqID_1019; Location=6566..10700; Strand=-
  SCN-specific regions: Sequence locations=1-691,713-1203,1225 -1249,1290-1521,1543-1672,1694-2411,2433-3365,3388-3508,3530 -3944,3967-4021,4043-4135
atggctttgtggatcccggaaagagtgagattgggccgagcagatgccaacgagggagaaatttttggtagacctgcagcacattcgacatcgattaatgaaaattatggccggctaaacatgcaaaatctttcgagtccgcacatttcgtatggtagtgttttgagaaaccgggctgacgaagcacggagagttgaacgcctggaaaatcaacgcggacaagaattaatggataggagggcaaatttgggtgaattttctttgttgcgaggccgcgaagtgcaaagagaaggagaccggaatggacagaggccgcgtcaaattgagcagagaaacgaattagcggatggaaattttttgaggcgtgaaatgtatgaccaaagaggcaatgaacatcgaagggttgaccggttagccgaagaaagagaacggagaaatgatttttaccgaaatcacgaacaacatcccgaaattgaccaaatgagaatgggggaaagaaattttggtgaaaattttgtggggttccctagaatgagtgaaaatttggcccttcaaatgtaccggatgacattggccacacaatacgcaagtattttgagagagattccaacaattgaagggactgagggtcgcgacaaaattcatgattttttcctgacggttgagacgctgacggctgattgggaacccgaaaagcaagtaaatgttttgaaaacaaggttgaggggaaaagcactgaaagcactgaacatcgccctttcaaaatttggtcccaatcccccattcaaaattttaaaagccgagatcgcttcgactttgagggaaacagattgccgcgaagcatcagcttttaccgagctgacccaattcggaaaacgcacaccaaatgaagatttaatgagttttggtgagaaaatttatcgtctggtaaaatgctcatacacagggctcaatgaaacccaattggacgaaattgccaagaaattttttgtgatgaacataaatgatggcgatttggcgagatttttggagtgccaaagcaggccgggacaaacattcgacgaattgttaatgttggccaatcgcatacatttggcagacccagaacgagtccgggcaaaaatcgagtcgaaatcaggacggacgcagcaaaatcaaccgtttcacaatagaaattggaaccggaccgactcgaacactcaattccagaacaggcaacaaaattacggaaatttttgggggaatcgaagaaatttcccaaatcaaaaccaaactcaaaaccaaagccaaaattggagaaataatcagccaattcgcttcaccggtggcaatgcaatgcctttgaacgctaatccccccgaacaagaatcggaaagagcaaacccaagaagtgcaaacacaatttttcttaaaaaaggcgaaacagaaaaagaaagtagttcagttaatgttcgacagctcggtatggcggaacacgtaaaatttttcaatgaactgacattgcacgcaaaccaatttccggcagaaaatcccgcctttcctcaaatttcggagtgtttggttttgaacttatctgtcgttggaaattcggcagacgcactttccgactcaggggctgaaactgccattgtaaacccaatttttttgcatatgttggtgaaagaaaagggaataaatttgctagattggggatttagcccaaacaccgggaaaagcaaattgccttttgctgtttcgtcatttaccgacacaaaaatcgacgtaattggtgtggttaatgttcccattcaaatgaaaacagttgaatgccaaataccgtgtctaataacccgtgattccttttcttatgacctaattttgggcactacggctttgcacaatttgggtttttattttggaaattctttgacaaaagaaatcctcaattttccatcaaagaaaacgagcaatggaaagggagaaatgcgtgaagtcaaagtctttgaaccacattatattccgccattttcatcacaaattgttcgaactttcattaacaatttccattgtttagaaaccaaaaaatttctaattatggatcaaatggacaccgagtccttgctggactacgacgaagaacagcaacagaatgagccggttttaaaaatgagtggaaaagacgaagaggcggcactgaaaaaattgggagtgatcgaagagacggagaaggaaaacacgccggtcaaaagtggtggaacattcgtcgagccatgcattgtcgaagcggaggaaaaaggtttcgtcaaaattttggtacacaataaatcaccaaaaatgctgactttggaaattggtgaaaaaatcgcaaaagcagaaatggtagagacaatttttgagcctggtactgaaatcctcccaaatgaatttgatggaatttgtcagccaaaacatacggttttctgcttaagaaaaaacggaaacgaagaccggttttctgagttgttgtcggtactaaaaatgaatttgggccagctggaaaaagctgaagaaaattcaatggaggaaatttggaaaaaatttgaaaaaatcttgattttggatgagtccgagctaacacaaacaaatttggttgagcataaaattgatacgggcgacgcagctcctataaaatgttcaccacgtcccataccattggaattaggaccaaaatttcggaaatgttggaggaatatctcggtaaaggtgtcataagaccttcaaacagtccatgggcagcaccggtcgtattaatgaataaaaaggatgggagtttgcgaatgtgtgttgattatcggaagttaaatgcaataactcgtaaagacagctacccaatcccaaacatcgaagaaatgctaatgtatcttggagaaagaaaattttctcaagtcttgacctagtaagtgggtattggcaaatcaaagtccatcccgaagacgtccctaaaacagcatttgctgtcccgagtggcctgtttgaatttgtggtgatgccttttggtctgtgcaacgcacccgcaacttttcaaagggttatgaacaaagtgcttgaaggtttggtgaacaaaagtgtgtttgtgtatttggacgatattttggtggcgagttcatcgtttaaagaacacatgcacgatttagaaaaagtctttgaaagattgtcgcagtttggattacaggttaaagcgaaaaaatgcaaatttgcacaaaattcgataccatttttgggacatatcctaacaaaagaaggccttaagaaggatctcgaaaaattccaaccaattttggactttcctagaccgaagactgtaaaagagctgcaaagatttgttggaatgttaaattggcaccgaaaattcatcaaagattttgcgaaaattgctggtcccttaaatcggttgatgaaaaagtctgaagatggcaaaaagttggagtggaatgattctgcggaaaatgcttttctgactttaaagaaattattgttgatgatgttgttttaaaatatccaaattttgaaatggcacaaaaagatgcgaattttcgcttccatgtttatacggatgctagtgcaaatgggcttggagcagtcctttgccaaaaagacatttctggtcagatgcgtccagtttgttatgcgtcccgacgttgcagcgatgcggagagaagatacggcccaactgtcctagaatgccttggaattaaatttgcgacaacaaaatttaagcattacatcgcttggttgccaaccgttgttgtaaccgatcacaaagcacttccagcgatgtttcggacaaaaaattcggttggaaacgcgagagtcgatcgatggattatggaattaggtgcaccgtttcagttggaagtgatttatagtccaggaaaaacgaattacgtcgccgatgctctttcgagggcatttcccaatgatttgcagtttttaaaaaaggaagaagaatcggtgaaaattttgacagtgatcacgcagaaaaaaattaattttcctgaaaatgtttcaaaagatcaatggacagccgaagttgaaaagtcagaattgaatttcatttttaagtttttggatcaaagatgcctcccagcagatccgaaacttcgacaaaaactgctaa

SEQ ID NO: 66209 - DNA, 1332 bp, Heterodera glycines
  Genomic contig location: Contig_ID=SeqID_1019; Location =11041..12372; Strand=+
  SCN-specific regions: Sequence locations=1-175,211-267,289-355,392 -393,417-565,588-605,627-746,801-908,931-1125,1158-1295,1317-1332
atgactggtgcagtccgagtgtcgcgccaggagcgccaagtcagctttctcgggggttcgcagcagggattttgggggaaagtcagagtcaaatacggcgagaaaaacgatcggtgaattcgaagaaatgtcaataaagttaaaaccttcactcagccaccgaatcacaaatttgatgataaatatttattttaaagagagaggaaatttcaatataattataaaatcggagagaaaaaactaataacgtgaagtgaaagataatgaatgtgtgtgtaaaaatgtgtgaaaaataacttaatgaatgtgaacagatcgccaaaagtgtgttcaaatattatcttctcacaattcaagtaatttaaattgttttaaaaatgaacaattttggtgatttttatacaaatttttataaaagtggaaatagaaatatttaaattgcttaagcttaaaaaattctactaactaaaggaaaattgtaattcagaaaaaataactttgtataaaaaacaaaaaatagtcaaaaaatctcacgcggcaaaaactgaagatagacgtgattagcaatattcactttaaaattaattaataggtttgaaatgtaaattaaattaatttttaacagtttcttcatcttcaattaataattctgcaatccacaattgcggacccactaaaagccggcaatttgagcaaaatgaaattatgttcagcccggccaaaaactattctgtacaatcaatttcaaattttattatttaaatttgaaattaaagaaagaattttttgaataataaaatgaagtcaaaaagaaaagttggtcggacaaagatgaaacatttcagtaatctgatcacattgacttaaaagtccttcacttagtttaataaattaacaattcgtttttctcaccccaaaaggtcggataattatcctaacatatttaatttactttttttttgattatttcttattctcaattttttttatacataattaacaataagccagtccgactcggtctttgcgatgtgattcattttccattccaccgatggcccactaattccatcccacttttccatcccaacacattcgtgtttatgaaaataataaaatgcatagaataatataataaataaatgtttaaaaatattcagaaatagttcactggaatgccaaaaatggaataataatcttcgacttgtacggatcaacaacttgatgaatgtatcggaaacctggtatgtatatgccaatagtgtcactgatcaaaaatgcgttgatcaagtattcatggttaatgagtttattagtgacaaatggtgaaca

SEQ ID NO: 66210 - DNA, 376 bp, Heterodera glycines
  Genomic contig location: Contig_ID=SeqID_7861; Location=76..451; Strand=+
  SCN-specific regions: Sequence locations=1-94,223-376
atgccatttgtcgcttttagcggcatcattttgaatttttccgttttcgttatgacatatttttacattgagacggagaaacaccatttacaagttaatatatattatttaaatttatatttattaaaaaaataaaaataaatattttaataattaaattttaaattaatatttaaagactaaatttttattataaataataaaaaaatctaataaaaatatgtagaaatttaaaggaaataatcagaagtttgccaagtgattattttgtgttggtcggtgttgttggacgaattttggacacagccaattatgtgtacacatttaccagtgccctttgttgggtagacgttttgctacggtaaaccattaaaaa

SEQ ID NO: 66211 - DNA, 2275 bp, Heterodera glycines
  Genomic contig location: Contig_ID=SeqID_7861; Location=1000..3274; Strand=-
  SCN-specific regions: Sequence locations=1-137,159-202,225-758,809 -1243,1265-1594,1622-1896,1919-2122,2145-2217,2266-2275
atggttttgaatcgaggagatgcatcgaccaaaggaatgtggagccatttgaagtcgatgcatttagaggaatacaatgaattgcaattgcaggagccggaaaagccaaaaaataaggttataatttaaggctattaagtttatttcacaaattaagacaattgattcctttttgcttaaaaaacatgacgagcaaaaggaagttgaggaaatgttgactaattttatggtccagcaaaactgcgccttttcagtttttgaaaattcaattcttcttaaattaacgcaacgtgcataccctaattttgaggtttgacagtcagccactatttagaatgagatattattcagactcgcagtgaatcgcattttcgaaaaattgtgattccaagaatggctgaaaatcttcaacaaaaaatcaaagacaagattggtactggttattacagcatcacaagcgatggttggcaactacctacaaaatcaccctcattgcagaggttattactaattaaaaactataaaaacctaatcaatgttatattatcattttttagtgtgacaattcattcagtcgatgaaaattttgtgcgaagcgattttgttctcaatgttgcgccaatatatgatgctcacaccggcgaaaatctcgcagatcacattgaaaagtgtttgattaataatgggttttcaatggaaaaattggttatgatggtcagagatgacgcaaaaaacatgatcaaaacatgccgaatattagaaattgaaaggtaaaatataattggtaaaatatttaaaaatattgtttagctttcaatgtgttaaccattttttgcatcttacaatatgtgatgttttgaaagaaccgaaattatctgatctgatcgagaaagtgagagaatgggtgaaagagtgccgtacaacaaaaggagctgcattatttcggaaaaagcaaaatgaacagggtcaaaaaacaacaaaactgatcatggtaaaaacagtaaaatgaacatggcgtgattttttaaattttagtcagttcccaccaggtggaattctacctatgcaatgctttctcaatttcgccagcaaaaaaaaacaatccttgcgcttgagtttgatcgaatgcattcagaaattcgaacggttaagcgggcaaaagtcgaaaaaatttctaatgatttaccgagaattgatgcagtcgattttgatttattgcgtcatgtctgttcgattttggacatttttgatgcggagactcgaaaagttagaagattttcatctcaaacttagttacaatgttttatcaatcttagttttctactgaaacatccatcgctgcatctgttatcccaactttaaaaaaaatccgtgactttctcgctttgacaccattcaactcatcagttcaatttcttgcgaattcattggcaaatgcaatcgatcgccgtgtttctaatttggcacataacacagcgcttcaaattgcaactattcttgacccacgatttgcgtatgatgaaaacatttggcgtaaaaacttatggccagatattgaggaagaattgaaaaattttgccaaatcaagtccatgaatatttatttttaattttaattttttgaattcagttgagggccaaaaaaatgtgtcggtcgatgatgagcagttggatgatcaaaatgccgccttttctggcttagttcaccatgataacgtcgatttgagtgctttggacgaaggtggaagcagcgatgagagtgttcgatgttcgaaattttagcaatttttttgattttattgaatttaagatgacatttgggttactcctaaatcgccaggtgccgggtcaattccatcaacactttcgggagaaattaatgctgatctcaattccaaaattgaatcacaattggctcattacaaggccattgttcgtccggcaattgacgctgatgttttttgttggtggcgcgacaacgcaccaaaatttccagaattggcaaggctggcacggatttttctcacaacaccggctacttctgtttgtagtgaacgtgtcttctcgaaagcggggctcctttacgcaaattcgcttagaaatcggttttaacattttgtgccttaataaaaaatttaattttaaggctttctggtgaaatggctcaaaacttgttgatcatcaaagcaaacatgaacaaattatttttgggaccatctaatgatattgatgaagatgaaaaagatgatgaaaataatgataacgaggccaaataa

SEQ ID NO: 66212 - DNA, 867 bp, Heterodera glycines
  Genomic contig location: Contig_ID=SeqID_7862; Location=269..1135; Strand=+
  SCN-specific regions: Sequence locations=1-198,275-363,410-585,714-867
atgtttatgatttcatttattattatgaaattatttcaaaacttagttttatttaaatttcagctttttatactcactcgggaaattcctaaagatgggcttgacacggcacgtgctgccgaatcgcgtgccgaccatgtgttgctgctcggatcaaccattattttgacagttgaatgtgtttgtgaggtgtattgcttttttaaatttaattatttatgtaatttaaaaaaattgatttttctaaaataaaaaggaaattatattatttttagttggtcgaaatatcatatttttcaccaaagaagaaaatgcactttgtgaccaaacttctggacattttttacagtttatttacgcaggtaaataaaaaaaaaagaattaaaataaatttatttttaaaatttaagttggcaaattggtttgagatttattgcttgaagaaaattgctgcggtcaatgatgatttggtcaaaagaattcggaacacaatgccatttgtcgcttttagcggcatcattttgaatttttccgttttcgttatgacatatttttacattgagacggagaaacaccatttacaagttaatatatattatttaaatttatatttattaaaaaaataaaaataaaaattttaataattaaattttaaattaatatttaaagactaaatttttattataaataataaaaaaatctaataaaaatatgtagaaatttaaaggaaataatcagaagtttgccaagtgattattttgtgttggtcggtgttgttggacgaattttggacacagccaattatgtgtacacatttaccagtgccctttgttgggtagacgttttgctacggtaaaccattaaaaa

SEQ ID NO: 66213 - DNA, 1211 bp, Heterodera glycines
  Genomic contig location: Contig_ID=SeqID_7863; Location=445..1655; Strand=+
  SCN-specific regions: Sequence locations=1-179,210-396,449-471,502 -617,692-749,771-819,846-859,920-1211
atgacccaacatgtaaatcctgatcagatttataaatgggtttccgagcatggcaattttggtggcaaaaatcctttgctggtgtctgaaatagtatcagtgatcgatctgttccgtacaatgccgcacttcaacatgttagagccaaaggatcaagtaatctttgatattaaaaaacgaattttaaaaaatatttttaatttatttttgttttaggcaattcttttgagttttgttgctattccactaatttatctgaatgcccgtttttactcatcaaaaatcaattcaccgattgtaaaaatcattccgaacagctcatttagcccattatacctttattacaaaaatccattctacgccggtgataaaacgtaaacaattttttgtatcgggaaaatattttattttaaaaatttttaattattttttatatttaagaaattttgtcagtttaattttctatggttctttttattaataaaaaaaacataattattagcatccaaacattgtccgaattaatgtatgtcaaaacgatggatctatttaacaaattgcaacttacggatgaggaatttcttttggttcgtgctttgatatcgtcacattcaggcaataaataaattatttaaaatatctaaataaattaaaaatattattgaaacaaattaaagaatattaattttttggaaataaaaatacaatattctcgatatttaaaatatgcataaaaaagcaaaaaaagagttgaaaagtatcaaaaactgtatgaaaatcaaaattggaatgaaaccttaaaagtctgaaaattttctattttaaagagcaatttcaaaaagatttaatgaatttacagattaaaaatatagttttaataattttaataataattatcaaattcaaaaagtttttatttcaacttttcagcagttaccggtctgtccgctgctggtcgtctcaccctgcagcatttgtccgaacattatgccaatctgttgatgcattatttgcgcaccaactacggcaacattgccggcgcacaccgttatgccgaattggtccatctggccgagtcggtgtttttcaacgcggagcggcaccgtgaattcttcacctatttggccatggtcactgaccagggccgtttccatgccgcaattccgcccatttttacgccgatgattttgcatgggacgttggatgaatga

SEQ ID NO: 66214 - DNA, 710 bp, Heterodera glycines
  Genomic contig location: Contig_ID=SeqID_37025; Location=37..746; Strand=-
  SCN-specific regions: Sequence locations=1-53,83-217,247-548,578-710
atagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttgaaaatgagaattcatgcgagattttctggaaataagcttaatagggcctagttaagctgtaaaaaaaatttggggcgatttgaatgagaatagaaagagccaggttcgatgaattttggtaagccaaaaaaaaatccaaacatttaaaaatctataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatcc

SEQ ID NO: 66215 - DNA, 516 bp, Heterodera glycines
  Genomic contig location: Contig_ID=SeqID_37025; Location=1200..1715; Strand=-
  SCN-specific regions: Sequence locations=1-203,225-356,383-465,508-516
atcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 66216 - DNA, 221 bp, Heterodera glycines
  Genomic contig location: Contig_ID=SeqID_37028; Location=148..368; Strand=+
  SCN-specific regions: Sequence locations=1-221
attaccaaatttgttggcaaaaaatgggcaaaagaccaagaaaaaatatacactgattcggcagaatttgtttctgataccaaaacactcattggaaaagaacaccctgatttggtccttaatacagaccaatcagggttcgaattagaaagtgctcttatatggcgccaaaaagaaacaaacaaataaaaagtgtcaacttaaaaatacaaaatgatgta

SEQ ID NO: 66217 - DNA, 770 bp, Heterodera glycines
  Genomic contig location: Contig_ID=SeqID_37030; Location=19..788; Strand=+
  SCN-specific regions: Sequence locations=1-673,695-707,729-770
atgcaatggaaaccggaagtgcgtacaaaagtgattagaagaggtgcaaaagtgattagaagaggtacaactgtgattaaaggaggtacaaaagtgattaaaggaggtacaaaagtgattagaagaggtacaaaaatgattagaagaggtacaaaagtgattaaaggaggtacaaaagtgattaaaggaggtacaaaagtgattaaaagaggtacaaaaatgattagaagaggtacaaatttgattagaagaggtacaaatttgattagaagaggtataactgtgattaaaagtggtacaaaagtgattcaaagaggtacatcagtgattaaaaaacgtacaaaactgattaaaggaggtacaaaagtgattaaaagaggtacaaaaatgattaaaagaggtacaaaagtgattcaaagaggtacatcagtgattaaaaaacgtacaaaactgattaaaggaggtacaaaagtgattaaaagaggtacaaaaatgattaaaagaggtacaaaaatgattagacgaggtacaaatttgattagaagaggtacaaatttgattagaaaggtacaaatttgattagaagagttataactgtgattaaaagtggtacaaaagtgattcaaagaggtatatcagtgattaaaaaacgtacaaaagtgattagaagaggtgcaaaagtgcttagaagaggtacaaaagtgattcaaaaacgtacaaaagtgattcaaagaggtacatcagtgattaaaaacacgtacaaagagtga

SEQ ID NO: 66218 - DNA, 1708 bp, Heterodera glycines
  Genomic contig location: Contig_ID=SeqID_7864; Location=1181..2888; Strand=+
  SCN-specific regions: Sequence locations=1-730,754-823,845-1051,1091 -1309,1331-1658,1696-1708
atggaagtgtttccatgtgtcaacatttcgctacaggacatctcatacaggccaatgaatgaatgtcgcctctacattcccgtgactgcgcactttcccgaccgagctatcgcagctttcctggatccggaacttcgcatcatctcgctgacagcacaacaggcaagctgtaatagctaccggttccatcatcttcaactgcgaagcaatcccaacatctggttatggattgactctcgaaccggcacagcacgacgaatgccgaaggactacgtccacgaattgtacgaaacaacgatcaaccaaacgaatagcaatttggaacttcatccattgatcttccacgcatggcaactcgacaatgagtctgacgcgacacgcttcccgcacatcaacgaattcatcaactcggagcagttcaaggacaagctggaacagcacattacggcaaggactgaagctttgggcgcgttgaagggcggaatagaaggattcaccatgcgctggctaaaaggccttatcgacgaagcaatcacatggtggattcgagtcgcctgcgtttattcaaccttcctcatgctgcgcggcattgttctcccatgcactctggcgtatttactcaatcccatccgagtgactcttctcagcctcgttggagtacgcccgcactcgacattccgacccaccgtttccaaaccactcgggatcgaagagggaatgccgctgcatgaaatgccacaaacccccaaaccaccagcgcgcagggcagagcaccgatccatgtcaccaatcaaattggacatgatcgccagaacggctcggtaccaacaaccacgaacacagagccatctcgacctcacagaagactcgccctttgggaggcccagacgaaaagaattctgacgggcccatcttttcacgccggaatgtcggaactctgggattccgactgccgatcaattgatcagcagaattgaagaaaggaagtggcgacccttccccctccctttcacatgcgtcacaccccgttccactcctctgccccccatttccctccaaattgttaattgtttttctgctttccttccatgccccgcgcacaattaatgaccaatttgtcaaaaccgcaacttttctgccgccgtccccaattcggcgaatgagactccaaagaacgatgaacccccaaatttcccgttttccgcccattttgttcatctgttcattttgtcccccgttttttcatttcgtgcccaattttcggcccattttcgttctgctcacatttgccactttttatttaactttattgttatttaagcggccaaaaatgtcccccaatttcacaaccaaatttcatttggcaattttgccgtttctctccccgcccccccccatttgcctttaactgtgatggccccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatggcattttatctgtgatcaattttgtgatattttgttcaccatttttaaatttttgtttaattacccaagtttgaggcttttttcccgga

SEQ ID NO: 66219 - DNA, 1023 bp, Heterodera glycines
  Genomic contig location: Contig_ID=SeqID_7864; Location=3514..4536; Strand=+
  SCN-specific regions: Sequence locations=1-257,279-448,471-1023
atgtctgggccaatacaaaaagggatcatcaatgcactcaaagctctggacaatgccaaaagcgccacctcactccttctacaccccgacccggacctgtcaaactgggaaaatgccgtcaacttggaggctcaatttgatcgcgtcgtcaaagaaatccgtacaatagaaatgcagatggacagtctacgagactcatccaacgcttggattgaacttctcgcccgcctgaccggagacgacaaagacaacggcgaaaaagaatacgtcaaattcgacaagaatgaaaaaatcgccgaccgatacgacgcagcaacaaccaaacttcgggatttgcgagatctcgaagcaacacttagtgccgcagccaaactgcacagaggcagagccgacagagaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttgctccgcaatctgctgggcggagaagcgcgagaactcatagcgagcttccggctggaagacgcaaactacgaaacggtccttcagctgttaaaggacacgtatggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcattctcacaaagaaaggagaggatccggcaaactggacgacaaccaaattccgggatgtgctaaccgaagcagtccggaaagaagtccaaatccaagaa

SEQ ID NO: 66220 - DNA, 920 bp, Heterodera glycines
  misc_feature (890)..(890): n is a, c, g, or t
  Genomic contig location: Contig_ID=SeqID_37036; Location=98..1017; Strand=-
  SCN-specific regions: Sequence locations=1-20,42-275,297-552,574 -807,829-920
atgccaaaacaaaacgaaatcgttttaaaatattcctttctggacttgacttggtttcttgatatcgaagctgttttctacgctatttctaaaacggttataccaaacctcagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaatattcaaaaattctcttaaaatttttttaaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcncagttttaagtcttggatttgtcaaataaa

SEQ ID NO: 66221 - DNA, 86 bp, Heterodera glycines
  Genomic contig location: Contig_ID=SeqID_37039; Location=352..437; Strand=-
  SCN-specific regions: Sequence locations=1-86
atggcgcacgcgaagaaggaaaatttgtgtatgagaaaggctgttcctgtcccagtccgcagcttcgtgctatcaaattcaagaag

SEQ ID NO: 66222 - DNA, 292 bp, Heterodera glycines
  Genomic contig location: Contig_ID=SeqID_37040; Location=192..483; Strand=+
  SCN-specific regions: Sequence locations=1-11,33-292
atgacagcgcaaaatgcaataaattttctgtttcactcattggacaatttaatgccctttttgcttttagcattttttatttgtataagtacaaagtgtgtaaaacaaaataaaaatgttttattcaaatattttcagatttattttttaattcgaaaaagttctttttatttggattaatcacatattttatctctcataatatcactggcaaaatcttttgggaaaaaagcgggtggggggggggagggggggggaaggtcaacaaaagtgctgaagaatctacgaaaca

SEQ ID NO: 66223 - DNA, 1389 bp, Heterodera glycines
  Genomic contig location: Contig_ID=SeqID_7866; Location=159..1547; Strand=+
  SCN-specific regions: Sequence locations=1-1389
atgattttcgacgaatttgtggcgttagcggcgagagctgaagcaacccaaaaagcgtcgaagctttcaatgctaaaggcaaacaattctcgaagattcgacagcgaatttcaaatgccgcgatacagcccacggccaatgcaacagcattttcgccaagaaaattttccacaggccaataaccagcaacaaaaccgcccaacttgttataattacggaaaattcggacattttgccaggcaatgttcggagccacaacgaaaccaaggcacacagaataacaacagctcggcaacaaactttgttcgtcaaaattttcttgttgaacaacaggaaaaacctccacaacagaatcaaaatctttttgttggtggcatttcgatgagtcctgctgatgtggaaaaactgtttggaaaggatgggaccgaaaacgagacgaaaaatttgaataaggtttcgatcgggagaataatggccttaaaggtatcggtttgtggtttgacggcaaaagctatgttggacggaggtgcccaaatttcgatggtttcttccaaattctttgcaaaattattaactgagaaaagaatcggtaccgaacagcttcgcccatctcgtcacaacactcgcgtgatcgacataaatggaaatgcagttgagtgtattggaattgtgtctctcccaattgtcaggaaaggcaaatgtgtgtggattcgtttccacgtctcacacgcatcttttggctaggaatttgtttttgggacaaatgcattggctcgactaagttttaaacttttcgacgaggcaaatgacgaattggtcagtttttcggaagttaataatgtggaacgcaattctgtgcacgtcatttatcatgcgaccataccatctcgtaacaaaaatttggttcactcggcccagcaaatgaaatttaagagtaacgctacggcaatttttacaaattcgggcaccaaaagtgaagtggaaagcaaacggacgtcggaattttgtgccaccaaaagcagccatcggccaagttttcgtcaaaagcggaagaaagctgaaaaggcaccaaagaacatcgtgcccaatgtggagaaccgaattatcagaaattgtgatgagaaagggcacaaaaagttcggcccaaaggaacaattgggaaagaaattcgaagtgcaaagtggcgatggtgaaaattcggtaaaaagtggaaggatttttcgaggcaaaaattctgaagttcaattagggacaattgaaattttggaaggtcggaaggagtttgagagaaaaagattgaagttgggcagaaactctcaacgagaaaagattggacgaaatgtctcacttgatggaaatggcccacgacgaattatggcacaaatttga

SEQ ID NO: 66224 - DNA, 718 bp, Heterodera glycines
  Genomic contig location: Contig_ID=SeqID_7866; Location=1601..2318; Strand=+
  SCN-specific regions: Sequence locations=1-468,574-612,658-697
atgagccgtgaaactttgccatttgatcggggttgggtcgagttgaccgcctcgtgtccggattcaacttcgacttctgctgatcgacaaccaatgatgcgcggacttcggtgcaatggcagtgagctgatcccaaacggacctcacctttcgacagccggatgcgggatgtgcagctgatcggcagggacgcctctcgtcagcggccggggatgtgttattatttaaattagtgcgtaattgcttggcgttttgaccatttattgatgtttgttttattcattctcatttttcatgcacttcttctcccctcttagagttttgtcatgtttggctgttctcagtaattttggatttgattgattgtttggttcccacctcgtcttccgactttgttttattttgttttgtgtgttttaataaagtgaaagcctatttggtcatttggttgtgagtgttcttcaacagaaaatatatttatacataaaataatatacataaattaaacataaactaattttaataaatgctctataataataaaaaagcaacaaaaatatatatatatataatcatacacaatcttttaaatacgatattttggtctaaaagtaaaatacattttttaattagaaaattttaaaaactttaaaatatcagttttgaaagggtggaagattactaataaaaatcggactgaataaaaattaattcaaaa

SEQ ID NO: 66225 - DNA, 334 bp, Heterodera glycines
  Genomic contig location: Contig_ID=SeqID_7867; Location=2034..2367; Strand=+
  SCN-specific regions: Sequence locations=1-11,149-190,235-240,262 -276,298-334
atggtaatgggaaaaaataatagaaaataaataaaccaataatgaagataaataatttaataaaaaatatatttaaaataatttaccaacaaagggacaacgaaaatcagcccaaaaaataataaaattaaaaaataaattaataaattacaggcaaagggacaacgaaagtcatcaaaaaaaaagtgggataaataaaataattaaattttaaaaatatattttaatttatatgtaaagataaacaatttatttgcaaatgcatattaacaaagaagattttcaaaacagagggaagtgggtccatggggaaaactacaagagtaaaatagga

SEQ ID NO: 66226 - DNA, 194 bp, Heterodera glycines
  Genomic contig location: Contig_ID=SeqID_37043; Location=781..974; Strand=-
  SCN-specific regions: Sequence locations=1-45,68-194
ttttcaagtttccgtttggggtactcaaacaattatgggagcaaaaatccaacgcagaaataaggtacaggctatagggaagctattccgacaggattcggtctccccataaatctgggcgcatcgggtcggggggactgccccgaaaacaaaaaaatcgattttttcaagtgtccgtttggggtactcaaaca

SEQ ID NO: 66227 - DNA, 314 bp, Heterodera glycines
  Genomic contig location: Contig_ID=SeqID_37044; Location=151..464; Strand=+
  SCN-specific regions: Sequence locations=1-23,46-129,164-214,244-314
atggaccaacttatcagtgggcttctcggaggtggcggcggaggagaagcaaattctggtgataatcagccgcagcagggcggcggaggcagtggcaatcagttggcagatatggccggggtaatgaacaatttttttttaaatttaacatttaatttttattcccccaggaattaatcggaggatttcttggcggtggcgggggaggaagcggcgccttgggaggaggcgcaggcggcggggtaaaataaccgtcgatttctaatttttagttcttagccatttcagctttaagcctaattgaaaatttaaaa

SEQ ID NO: 66228 - DNA, 447 bp, Heterodera glycines
  Genomic contig location: Contig_ID=SeqID_37045; Location=1..447; Strand=-
  SCN-specific regions: Sequence locations=1-8,30-58,80-104,133-374,396- 420
ctgagtgcctaaaataacttaaaaataaaatttggtgagtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagcttataaaaaaaaaagttaagcctaaaatttttcgcatatttaaaaagcaattaaaaatttttagatttttattcatctccctttttgatagtgtaagcatctgagtgcctaaaataacttgcaaataaaatttggtgcgtttcagagcagtttctgaaaaaatatttatgaattaattttgctaaaaaaataaaatagtgaagctttaaaaattaataaaaaattttaaat

SEQ ID NO: 66229 - DNA, 1158 bp, Heterodera glycines
  Genomic contig location: Contig_ID=SeqID_7868; Location=1862..3019; Strand=-
  SCN-specific regions: Sequence locations=1-111,154-282,315-631,653 -831,884-1026,1056-1065,1104-1158
atggccgacccttcgcccgtgacgcaaaaagcgttggcagccgaagaagcagcgatggccgccacactgctcgagtcattactgtcctcctccacaatggtggttatggcgaaaaaaaagatttttgaaatttaaattttaaatttttaattaggtttcgtcgttggagcgttcgttggaactgtccgctgcgcacagtgacggactgtcggacaaagaggccaaactgaaggaggtgaagaccaccttcaagctgacccatcgccggacgtccagtgtgagaattttattactttttaaaataattatttaaagtccattaaaatacgcgaatttttcggctaatggtacggtaaaatggcgctaattaccataccaaacattagaattttcgttagcatttattaaattttattttcaagtttggacaaccctttgaaaaaattttttcgctttttcttaacaattttgtcccttttttcaaaattttcttgaggtacggcaaattttttatgaaaaaaatcattttgtttagcattttcttacttttcgttgggttttcggctaatggtacagtaaaatggttgatcattaccgtaccaaatattgatgagttttcattagcattctcatttattaattttcattttcaagtttgaacaactctttgaaaaaatttttctcttttttttcaacaattttgtccatttttcaaattttttgaagtccgaaaaattttatgaagaattataattttgagtcaaaaattagcattttcacagtaaaatggttggtaattaccgtaccaaatattgacgaattttcattagcatttataaaaaaatttttatttaaaaaaataaatatatatatatatatttaagaatcctatcaattttttgcgctcaatgcctgcccaccaattgtccacctcatcatcctccgcaaatggtgccaaaagtgttgacaatcggcaccaaaatccacttgccgaagatggaacaacaacagaagaaagtgaagaaaaggatgaagaggaggaggaagaggaggagcaaatttgacaactaattaattattaattgattgactaatgaattgatgaccggcattcgtttaaaaaacgctgaaatataatttatttttccgccaaataaa

SEQ ID NO: 66230 - DNA, 263 bp, Heterodera glycines
  Genomic contig location: Contig_ID=SeqID_7869; Location=624..886; Strand=-
  SCN-specific regions: Sequence locations=1-22,46-165,187-209,258-263
atgaatgcgtcgatggcaatgccaacaataacaacaacaacaacatttggcttagtgcagccgacaatggcacaaaaacatgttgtttggcaccgaacacgtgccaatgtgtccaaggcggtggtacaacaacagcaacttcaaaccggagaaattcaagcagtccaacgacgacaacggcaccgggtaccagcaattacaacaaatggccatcaccaacaaaagatcaccaccaccatcaccatcattttcagcataaagag

SEQ ID NO: 66231 - DNA, 2463 bp, Heterodera glycines
  misc_feature (323)..(323): n is a, c, g, or t
  misc_feature (2456)..(2456): n is a, c, g, or t
  Genomic contig location: Contig_ID=SeqID_7870; Location=52..2514; Strand=-
  SCN-specific regions: Sequence locations=1-76,102-321,448-466,718 -738,771-1649,1672-1674,1711-1977,2016-2175,2197-2202,2232-2252,2274 -2463
atgcacgagcttcgacatgcgcaagagattcgccaaatgtacgaggagaagctgcaacgggtgaacaaaatgcacacaaaaatgtgccgcttcacggaactgatgaacgagcgaaagcgcgacaacgaacgcgtggcggatgcaacgcgcgagcggttggcatacgacgcgcattggcacgccacactgcacgagtggcatgccgagtgcgggaatggcatgctgagctgcgccaacaggcggcgacaatggcggcacgacggggcgacgatgccgtggcgcgcacgaacgttccaaaactggtatggaatgcttatattctntaatataatttaatttattaatttaattttactttatttaatttattattatttaaattattttattttatttttttaaatttaatttaaattgatttaatttattttattttaatttaatttatattttaacatatggattctattatatattttaattttatttttaatatgtatagtgtttttttatttagctttaatggattttttaatttgattttaaaaaataataaatattttttcaatttcatattttatttttgttttattaatgacgaattaattcattcaaaattagtcattctataattaattttaaaagatttaaatacattttgaatagttgaaaaaaatggtttttaaaataatttttaatattttataaatattattaccatttttgaacttggcattgtttaattataaaataatttattaattattatacagcaaaacaacagcaaggaggagctccggcatattctgttacgtgccgaaacggccaaaacggcggcaatgcttacccatgggcatgaagaacccgtcgaacaacaaaatcaacaacaatggccaatgagagcaagcagtgcattcaaacttggtggacagcaaaggcccaaatgcataaggcaatttgcaaaaaaaaaaacatatttttcctttttttatatatttttcgggatttccaaaaatcgagaataactaaatccatttgccctcctgactcttacaaattagggtcaactcttggtaaatttccaacgccaaatctccgtctcctactgatccttatggccaaattatcttggagctcttggggtgaaaagaatctcggccttggtctcgaaaatggaaaatcgagatccagtccaagacctaaatcccgaaatttttctcgagtcgtggcccgagaactactaaattaccgaaaattctcggtctcctgattctcatggctgaaaagagttgatctcgcatattatggtcaagcctcggttagtttttgtttcgaaaattttcacactctcaaacttttcctgtcattttatattttgatgtccattaattatcataattagctattcagtcccgttaaattaactctcttaattgtccaatttggcgcttcattcttcagtcaatcgccgccaactgttgggcgagctcaatgccaagcagtacagcaggctcgtccggcaatgcttcgcatgacatactatgactatgacggcactggacgacggcacattggccaaaaagtgatggcccaaccgcagcaacagcaacaacattatgccgataatcttcggggtgggagaggatttggcacaaatttaaatttgacaaatttggaaaaaattaaattacaaaatttgatgaaatatttcattctctatttcttctattttgctgctaaatttatatatggttttacttttagttcgaaaatttcacgtcaacaaatttcgtcgccgatggtcgcaggtaaaaaaataaataaataaacggtatttgtcaaattttttcgaaaattgccctaatttctttgtctctctactcgcttataaatgtttaaattcgtctaatttttcaaaaaaatttccaaattctcacaaaatttttatccacgtggaggagtactaaaatttcttacaaaatttaaaaaaaaaaaaactaaatttatctaattttccttaaattttttgcgagggacaggagaacatcgtctaggtatataatttgaaaattgaaccctggcgatttaaaattttcctggcgattctccacaaatttcttcaccaattctaggctcagcagcctcctgttcgtcttcgtctcgggattgttcatcagctgaagataatgatgatgataatgaacacccccaacaacaacgagaccaacaagtacccgcaacccaaccaccaccagcaggaggagcagaagcagtagatgcccaaaaacgcagaaaaagttgtcgccattgtaaaacaaataaacggaatatgcaaatgatgatgatgaaattgcatcatcaattgccagcgacgacgacggcaatggtgccacaaattacggcacaacagcaacagaaagttgttgttggacaactgcaggaagaggccagaatgngctcatg

SEQ ID NO: 66232 - DNA, 1254 bp, Heterodera glycines
  Genomic contig location: Contig_ID=SeqID_37055; Location=85..1338; Strand=+
  SCN-specific regions: Sequence locations=1-145,167-213,238-279,312 -347,397-592,632-726,752-947,983-1254
tgccaattatttgttcgttgccggccattacccaatttattccattggaaagcatggcttctacaacaattgcttagccgaaatggaccacctgatgcgcaacaacaaagtcacggtaataaacacttttctgtttactgttaagaattttatttctttttaaatttcagaatttctgtaaattaaataaaatttgagtatcttaatacaaacttaaatttgtttttgtgtttggaagatgagccaattcatagaataagcatacatttggaaacgctgttaaaaataaaaatcaaaaataattaatttttggcaattgtttaaatttcttcaatttatgtacaaacttaaaaagaaaaattgatttaaatttaaatttatttgttttaatattttccacaggcttacctgagtggtcatgaccacaacctgcaacatttgcagctgaccaagccggacggcaacacgttcgactacataatttcaggcgctggcgcagcgacggaccgaagccaagaacattgggatgaattcaacaagacagccgccgaaatgaagggcaaagcaaaagtccttctccagtaagaaaagcattaaaaataatttaaaaataaaattttattattaaaaaggaaaataaacaaagataattgcctaatttaaattggtggtaaatttaaattagaaaaaaacaacttcttttctatcaaaagtattcatgaaaacttaaattataaaaaataataaaaatgagcaattattcttcattttgaactttaaaattgtgtctcagttttccgtccgcccattggtggattaaatttgctggcgaagaattgctaagttggacaaccggcggctttatccaagcgcaagtgacgccggacaaaatggtgctgaatttctattctggccaaggtaatttagcatttaatagaagatttgaattttctgtgtcaaagtttttgggaaaaaatattttccaaaaaaattttaactgttaaaaacttttcccaggctctgtttgtcttgatcaaacgccgcttgtcggaagtctgcttggcaaactgccatttgtcaaccacaattgcaagagtttgtacggcaccacaacattgtgtccacgggacaaaccaaagtgccgggaggaagcggctgctcaggacaaaactggatggttcagtgggccatggtggtgtatgaagttgtgctgatcagtctgaccaagacaatttgtgatcgggcaattattaa

SEQ ID NO: 66233 - DNA, 515 bp, Heterodera glycines
  misc_feature (6)..(6): n is a, c, g, or t
  misc_feature (8)..(8): n is a, c, g, or t
  Genomic contig location: Contig_ID=SeqID_37057; Location=358..872; Strand=-
  SCN-specific regions: Sequence locations=1-515
atgaanantggagcggcaaagaaaaaattgcaacaaaaaacatttaaagaaatatttggagaaaaatgggaagaaaaagaaaatgaacagaaaaagagagaaattgttgaaaaattcaacaaaattaaagcgaaaatcaaacaaaaagagagaaaatattcagcaaaagaatggaataaaattgaattgaaaatcggaaaaaaattgggcacaaatcgaaacaaaatttacaaatggatcaaagaattaggattatacaaatgccataacaaatcaaaaacggatgtacaaaaaattgaaattgtgcaaaaatttaatgcaatgaaaaatgaatataagcaaaaaggaagaaaatattcgagaaaagaatggcaccaaaattatgccgaaatttgtaagaaaattggagtaacccaaggagtaattagaaaatggaagaaataattcggaatgaatggaaaaagattaacggagaaagaaaaaatggagaaagtgaaaatatattggcaaataaa

SEQ ID NO: 66234 - DNA, 98 bp, Heterodera glycines; identical to SEQ ID NO: 59716
  Genomic contig location: Contig_ID=SeqID_37058; Location=532..629; Strand=+
  SCN-specific regions: Sequence locations=1-33,60-98

SEQ ID NO: 66235 - DNA, 403 bp, Heterodera glycines
  Genomic contig location: Contig_ID=SeqID_37061; Location=104..506; Strand=+
  SCN-specific regions: Sequence locations=1-403
atggacgagccgaacttcggaaggggccgagcggaacatggccaaagagtcgtggacagagccgaccaatcccatggagggcgaactgggcaaagtgatggctatcatgaagagactgagcaacttcgaacggttcgagcgcgaaatgaacagacggtctggcatgtcaaaactcgacaaatttggcactttcgaacgcgaaacgccaacgaaaaggtaagaaaagcggacgaattggataggcatttgaaaccattgattggcagaatgtcgggccgaggaatccttcgaaatgatcgcttttctcttcaaaatgcatacaactcacgcagaaaagcgttacaaaaacaagacgacgtggacgaagtgttggagttgttggctccctctgccgatgttcccg

SEQ ID NO: 66236 - DNA, 2077 bp, Heterodera glycines
  Genomic contig location: Contig_ID=SeqID_7871; Location=730..2806; Strand=+
  SCN-specific regions: Sequence locations=1-478,500-660,682-684,707 -790,813-1061,1083-1674,1701-2077
  Gene Ontology: Mol. function=signal transducer activity; Cellular component=nucleus; Biological process=embryogenesis and morphogenesis
atgaaatataaaaccaatccgattaaagccgattacaaaattggcaacaatgtgagtttattgtgtgtttgggtggcattttcaacaaattcacaaaaatggcatttagaaataattgacgaatccatcccaaaatctgattgttttgaggttaataaataatggcatccgtatttttaaggttcttggggtcggaatcaacggaaaagtggtggaatgcgaacatcggacggacggaaagaaattcgcattgaaaattctgcgggacattccgaaggcaaagcgcgaggccgaattgcactttgtggccagtgggcacgcgaacattgtgaatgtttacgacatttacgaggtgcggctggttttgccattctcatccatccaattgctgctttcttatttagaacaattacaatggcattccgtgccttttgttggtcatggaatgtatgacgggcggtgaactgttcactcggatacaggcaaaaagaaacaaatatttaacagacactatttttaaatttggaatcggttaattttaatttgatttccgttttaggaacggtctggcggtgctttcactgaacgtgaagcgtccaacataatccattcgatttgctccgcagtttcacatttacatcaaatgggaattgcccacaggtctcccaaataaattttgctcaattaaactattatttacattttacttattggcaaattatgcccaactatttcagggatattaagccagagaatctcctctacagcgaaccgagtcccaccggcactttgaaactcactgactttggcttcgcaaaacgatccgaagatggcgaaaaatcactggtcagtgactgttggattggactttgggcaactgtttccctctaaagttggcaatttcttcaggtcactcccctctacacaccttactacagttcgcccgaagtttgctttttgtgaatgcgtcctaattgtccgtaataacccattaaaggtcttcagctcacaaaaatacgacaaagcgtgtgacgtgtgggcgattggcgtgatctcttacattttgtgataattatttttgcttgattttgctcatttcaacgcccttttcagattgtgcggttacccaccctttttctccacccatggccttccaatttccccgggcatgaaaaggtgggttttcacaagagaaagcaatctttagaatgaatgaatgatgctttcgttttgtttagccgaatccgagctggccaatacaatttttcgggccccgaatgggaccgcgtgtcagaagcaggttccttccgccaatcccttgcctttttgccattttttgttttattctcagcgaaggacttgatcagacgttgtttggtcaccgacccggacgaaagggcgacgatcactcaactaatgcagcacaaatggatcactcactacaacaaaaatccggcgactgcattggccacccaaaaagtgttaaatgaaagagaggtcgactggtccaacttttcggtgattttttttctttttccgcaaacaattgctgacaaaagcacgtcgaatggatcaacttgagaatgtgaattgtgtatattagtacgcattttttgttgattattttaaattttggcgacccgaaagcaggaaaatgtcgattttcttccccctgtgccatttttggagaaatttaaaatctaatcttttgcctcatcgaagaaactaacaaaaattaccagcaatataaattcataaaaataggaagagatggaaaatgcattagcgacgatgcgagtgggcgacgtgcacatcaaacaaatgggagacgcgcgaaacgcacttttggagaagcggagaaaacggacaacggaggaggaagagcaaaaagagacactgccggaggggacaacgacggaagagggggactgaaaatgacgaaacgggaaagaatgccaaacacagcccaacaacgacgactaatcaaattgccagatcaaacaaacagctgatatctccatttttcaatttcatattgctaaatttttatttaatttaagaattactaactttttaa

SEQ ID NO: 66237 - DNA, 838 bp, Heterodera glycines
  Genomic contig location: Contig_ID=SeqID_7872; Location=63..900; Strand=-
  SCN-specific regions: Sequence locations=1-143,186-373,397-838
  Gene Ontology: Mol. function=Pol II transcription elongation factor activity; Cellular component=DNA-directed RNA polymerase II, holoenzyme; Biological process=regulation of transcription from Pol II promoter
tttaatatttgaattgtttaggtaaaagccgtttgcgaatgttttcacatgtccaaggacacgggctacaaagtgtaggagttttcttctcattttttcatttctgttttattttcagtgttattcatatgatgccgaatttgtaaattttaatttttatattaatattaattaatttattatttctctatagaccaaacgttgacattgaacgagacattgaacaggtcattccaacaaaacaatcaatttgataaaatccgttttcattgtcagtttattgaactgtttgaaaaccccgagttccgaccggacggcctcaaaatttacccgacactcgtcattcgggggaccggcctctatgaactttggtcagcaaacaaataccaaagttacccaccacaggttttatcttgcttttcgcaaattaacaatcatttcttcagtacattacatccgatttctgcttcaggtcctcgttgatttggtcgcccaaattctctctttggtgcccccatggacacgcgtttaccgagtgcaacgagacattccgatgccattggtaacgagcggtgtcgaatatggcaatttgcgagaacatgccatggcaaggatgaaacagttgggagtgaaatgtcgcgatgtgcggacacgagaagtgggcattcaggtgaaaagaagggatggggggggaaatcgaaaggacggttcgaaaaaagcgacccattgtcaggaaatccacgagaaagtccgcccctaccaagtcgaactcgttcgtcgcgactattcggcaaatggcggttgggaaacctttctctcctacgaggaccccgaccag

SEQ ID NO: 66238 - DNA, 378 bp, Heterodera glycines
  Genomic contig location: Contig_ID=SeqID_37062; Location=9..386; Strand=-
  SCN-specific regions: Sequence locations=1-378
ctcaatggaagcctgatggtgaaaaaacaaagaaattggaacgattaattgctgaaatgatcgcagttgacatactgccaattagatgcgttgaaaaaactggtttccagagagttttgaaatttttggcacctaattatgaaccaaagtattaaattttcattagtttatccttaatttctcatttctaattcagaggacgtaaattttttacgcaagaaattgcccaaatttacgacgaactttttgaacgtgttaaaaatgacctttctgttcaaaaaagcatttcacttacgacggatatttggacatcatctcaggcaacaatctcaattttgtcactaacggcacattttatcaggtatttagttaattaaa

SEQ ID NO: 66239 - DNA, 91 bp, Heterodera glycines
  misc_feature (54)..(54): n is a, c, g, or t
  Genomic contig location: Contig_ID=SeqID_37064; Location=739..829; Strand=+
  SCN-specific regions: Sequence locations=1-91
atgcacgtttacggcactgctcaattcccagcttcgttcccgttttatccgccnaacatgactttcctcaccgacattcttcatccgaaca

SEQ ID NO: 66240 - DNA, 172 bp, Heterodera glycines
  Genomic contig location: Contig_ID=SeqID_37066; Location=327..498; Strand=-
  SCN-specific regions: Sequence locations=1-172
atgacgcaatctagtgccgatgttgaggcggatgttgttgaaaatatttgtgtgaaaagttacacggacaaaaatgaagaccaaaatggacaacgcatcaaaggaatcaaggacctaattgatgaacaagacaattataagatgatcgaatttttgaaatacgagattgaaa

SEQ ID NO: 66241 - DNA, 1646 bp, Heterodera glycines
  Genomic contig location: Contig_ID=SeqID_37067; Location=1..1646; Strand=-
  SCN-specific regions: Sequence locations=1-292,314-589,622-818,840 -983,1007-1083,1123-1214,1255-1646
attatgctgttgctcttcataacaaattcattaattatgctcatttttctcccactgcaatttgccgttgcccaatacccgcaaaatccgtcgctcggtggcacagccggcggcgattttggcgccggcggaattgggcccggtgccatgcccgccggggtaggtggcgtcccacccgtcgctggcgccgggccaaacattgggcccggcggtggtgccacgcttttcaccggtggcacagacaatttgctttacgggggtttgtccaaaaaaaattgaaatgctcaattcggcattatttacagtaaatttggtgccatttggtcccgaggttggcgaccacaaagtgcaccccggctttttgaccgcagggcaaacaatcggcaagtgattcatgccaatggcatgaaaaaataaagcacatgccattctcagatctgtacatgtatttcccttactacggtggtctttacaattacactacggtattattatcatactttgaaaagccaggggacctgagtttaaaattggagttggtagaagagtttagacttcataaagaatgaattctcgggtttcgaaaggcaaaatattaatttaatattaaaattaattattgcctaatttgccagctttccgtcaacgggtacatggcttttgcgactgtgttggaccaggggccgaccatcaatgtgggccccgaagcgacagattggccacgacagcaggacccggcaatgatcgcgccttacctatgcaaacagcaggtaaatgaatatgtaattagtgctgatcaatattactggtcagaatgatattaaaattattaaacaaagaattaatctatttaaaggaattaattagccaaacaaaaacaaaatttgccttacttagaattgaaatgattagtttgaattgaattcattttcaattgagttcattttttgtttttttgaatttaaaagaaaccgaaggattgcaatatttttataattaattttaaggaaatttctaaaaattgtcaaaattgggtcagaaaaggcaaaaattaataaatattttcgaccatttggagctttgttattttaaaaaaattcattttatcaaatttttttaaatgaccagcaatattttattcctttaaaatagaaattttaattttcaatttaaatctccaattgaaaagcatggctaatcacaaattttggtccccaaaatgccggttaagtttttgcaataaaattctaattgcaagcccattactatacgctgactaaatgccgtagattccgcaaagcagcaacgtggcattgagggctggcatttactaccggctgatcatgcgccagtccatctttggccgtggcacggccacaaacattgggcccgacattggcaccatgcccgagtccagcttcttcggctttcgctttcgcaagtgtccggccgcgtccgacaattacgtgcgctgcgattccaacggcgactatttcctggaccaaatgatgcgatggctgcagggcatgtcaaaatgccaaaaaaaagggaaaataaaaacaaaattgcaaacaaattccagagggcgtggcaggcgcggccgcgaaaggtgccgacgcggcgctggtcgtcacgtggtacaacac

SEQ ID NO: 66242 - DNA, 327 bp, Heterodera glycines
  Genomic contig location: Contig_ID=SeqID_37068; Location=106..432; Strand=+
  SCN-specific regions: Sequence locations=1-140,162-327
gagggcggcactttgttggcgcccgaccgcgccgcgtatttgcgccatttcaatgtgaacgtcgtcggcaccgtggccaccaccgccgcctttttgccattgctgcgaaaagcggcggcaacaaattcggagggccaaacggaggagcagcaggcggcgcccgttgtccgcgtggtgaacattggcggagcgttgggatgcattggcaaagtgttcttaaagccatcggagtgtccgtatcagaacatggcctatggcatgagcaaggcaaaaacaaaggggcaaattgatggaagaagagacaatcttaagaaatggaaaaaataa

SEQ ID NO: 66243 - DNA, 882 bp, Heterodera glycines
  misc_feature (523)..(525): n is a, c, g, or t
  Genomic contig location: Contig_ID=SeqID_7873; Location=126..1007; Strand=+
  SCN-specific regions: Sequence locations=1-882
atgttgttgaaagcgatgccaaccaaaagcattcctaaaaaggcggaaaatgaaaaaataagcggagaaagtgccgaagagaggtggcaaatgggccaaacgaaacaaatggccgacgcaaagtgcggaggcccaaaggacgaaaagggaaaaaagcgatcggacaagctgatcaggcacttgttcatcggtggaaaacaatgtcaaattgggagaagcgatcgacgaattgacgacgatcagaggggaaatgaaaggacgcgcgaaaagagcgaccaaagtgccgtagagagagaggagaacgaacagcgaagtgagcaccaaattgacctggcaaaagcttatacatatcatttctcataattctttttgctattttaaaatgccaagaaacgaatgccaaacccacttgtttattggacacaatccgagacaatttccccaacagaaagagcggcattttacagttggccgacctaaacgcgaaatggacaaatggatgaaaaggcaaaggggggggggnnnagggaggggggagttggcatttgtcaggggacatttggctaaaatgcagacaaaaactgagactctgcgtaaatgctagatattaattaattgcttgtcattactgactgactaattgcggattgtctcagtcgatctttcagcgccctaatggagagacaggcttaaagtttaaactgtctcacgacataaggcgataatctgtgggacgaacaaatggaggaactaaagaaggggaatacgtaactaataattggattatgaaaatgatagttgaaaatgcgtcaggataacaaactccattcttgaaataagatatcagataagtgtaatttgcctcaaatgaaaacaaggaaa

SEQ ID NO: 66244 - DNA, 419 bp, Heterodera glycines
  Genomic contig location: Contig_ID=SeqID_37072; Location=19..437; Strand=-
  SCN-specific regions: Sequence locations=357-419
  Gene Ontology: Mol. function=protein binding; Cellular component =axoneme; Biological process=N-linked glycosylation
agaaagtggaagaggaacagaaggcggaagagaaagtggaagaggaacagaaagcggaagagaaagtggaagaggaacagaaagcggaagagaaagtggaagaggaacagaaagtggaagaggaacagaaagtggaagaggaacagaaagcggaagagaaagcggaagagaaagtggaagaggaacagaaagcggaagagaaagtggaagaggagcagaaagtggaagaggaacagaaagtggaagagaaagtggaagaggaacagaaagcggaagagaaagtggaagaggagcagaaagtggaagaggaacagaaagcggaagagaaagtggaagaggagcagaaagtggaagaggaacagaaagtggaagagaaacagaaagtggaagaggaacagaaagtggaagaggaacagaaa

SEQ ID NO: 66245 - DNA, 171 bp, Heterodera glycines
  Genomic contig location: Contig_ID=SeqID_37076; Location=322..492; Strand=+
  SCN-specific regions: Sequence locations=1-171
atgccacccattccgatcattccaagcgagcggacggcacagccccatcagcaacaacaacatcggattgtgccaccgcctccgcctggtccgccgcctccggcaacgcatggctcacaaagcggcggtggtggtggggctggcggtattcaccatcaaccgagtttggag

SEQ ID NO: 66246 - DNA, 539 bp, Heterodera glycines
  Genomic contig location: Contig_ID=SeqID_37079; Location=1..539; Strand=+
  SCN-specific regions: Sequence locations=1-539
aggaatatatttttaaaagcattgatgacgctgaaagtaaaggagcacctattctacctgaggtcctcaataaacttcaaataaatagtcttcctgatcatgaacttaaactcaaaactaattgtgttacaaaattaataagaaatttaaacgtaaatatgggattatgtaatggaacacgtttacaaattcttgatatcgaaaaaaacgtattaagagttatgatcttaacaggagacagaatcggagaaattgattttatccctagaataagtttaatagaagataaaaaattccgtatgtacttaaacgacatcaatatccattaaaattagctttttgtatgacaattaatagtgcacaagacaaacttttgagaaaattggtgttgatctaacacgagatgttttcgctcatggccaattgtatgtggctttatcaagaacacggagctgggaacgaattaaaatcaaatattccaatgaaaataatgaaaaaaagcaaagaatatcgtatggttggaaactttaatataaatt

SEQ ID NO: 66247 - DNA, 1599 bp, Heterodera glycines; identical to SEQ ID NO: 37080
  misc_feature (1381)..(1381): n is a, c, g, or t
  misc_feature (1462)..(1462): n is a, c, g, or t
  misc_feature (1500)..(1500): n is a, c, g, or t
  Genomic contig location: Contig_ID=SeqID_37080; Location=1..1599; Strand=+
  SCN-specific regions: Sequence locations=1-115,137-1432,1454-1599
  Gene Ontology: Mol. function=structural molecule activity; Cellular component=membrane; Biological process=intracellular protein transport

SEQ ID NO: 66248 - DNA, 1039 bp, Heterodera glycines
  Genomic contig location: Contig_ID=SeqID_37081; Location=9..1047; Strand=+
  SCN-specific regions: Sequence locations=1-38,60-242,265-265,297 -416,449-654,679-874,896-921,943-943,973-1039
atggcatggatgacaccaaattatgtcagaaacaatgccaacaacagaaacaataacaatgtgccacagcaacaaagaccagccggatcagtgtgacaacgatcagtaattactgatttgtgatcaatcacatgaaagatttttgctgattaaaaaaaaattaattctttggcataatgtttcaatctcaaatttcaccaaaaacatttttagattttttccaacatttgcttaactgtcccttatttatgtatttatttccttgtaattttttaaataaaattgttttttattatggaatattttctttctttttttccccaatggcacacaaggacaaattcataccctgatttatttacaaaaaaaaattaaatagctcaagaatgttgtgcattatactggcaccggaaaacaaaaaaaaaaaaaaatttttttttgaaaatttccatgattaaattggtcgggatgaggcaacaaagtctgttggatgaactttcatcatgggacagcagggatgtaccagggctgaaaaattctctgaattgtttgaaaaccgataaaattcttgaaaatctgctaaatttggcatttttttttggattttcaaaaaatttaaacatttttttgtcgtagaaaaatctattttttttcatatatatatatatatatatacattaattgtagtttctgcatcttttgccattttcttggtgcatcgattttctccgtttattctcaacattctacgccgagcggtcgttccgttacatccattaaatttgtcacctcatttttagtaatgatgcattcattttatacacccttaagaatctacctaaaaaaatttcaaaaaatacacccctaagaatcaagctaaaatttttcaaaatatactcctatgcaatgaaaaaaaattttctcaaaaatttactttcttggcaaaaaaatttaattttaaaaatttttttaggtaactattttgggtttttttgtcttaaaaatcccagtcctacgcatttgcaactgcaatcagtga

SEQ ID NO: 66249 - DNA, 1794 bp, Heterodera glycines
  Genomic contig location: Contig_ID=SeqID_7876; Location=1165..2958; Strand=-
  SCN-specific regions: Sequence locations=1-465,518-761,783-784,806 -826,850-853,875-921,943-979,1001-1206,1228-1259,1281-1545,1567-1794
atggaacaattggagagaaagtgtcaagcgaatggcttctccgaaaaaccgaaggagcttaaaacattgggcgaatccttgcacaaagtcgaaacgcgaatttatcgactgagaaacgcattgaatgcgtacaaactcagaattgacaacgcacgacgattcaaagaaataatcggggaggtgggccgtgaattcatttgtatgaatcctcctcaattagaatatttcacagttccacaaggaatgtgacgcactttttctgatgctttatgagaatgacggcgttggaaagaaccgaatatttaaagtgaatggaggccaaatcaaagatcgggtcaagtcagtaaaggagcgccaagctaaccttggtttaattcggtcaaatttctctttttcattttgctattatttagaaaaaaaatttgagttggcgtcagagacttcatcatctttccgttttttattgctccaatgtgaaaatggggaacacaacagcaacaaaagaatggattttaatactgaagaggttctcctgcaaatctctgtagattccgaagcactgacaaagcgtcgacagcgatttgccaaattggtcgaattttgggttcagttattaaactctcagtgttcaatttctctgcataagaacacaaatcacatttcggcaaagatttgtggaggctttctaatcgatgctgtggacagaaagcgcgaaaacgatgaaagaaaactgagcaactgcaactgatacataataagagaaaaagcgaaagaaaaactcaatatctctgatatgctttcaaaaagtttcagtatttactttataccttttttattagaatatttaaatttatgtgcgaatgaaaaatgaatattttttagaatgttccttgtatggcaacttgatttactgttgaataaatacagcaaagaaaatgattgctaaaattcgcgctatttataagcaacttgttatgccttagttaccgattccagccactcattttcaagccctataaaagcagagaattatgtttgcattttcatccccttcatcattcacttttgccagcaccgtcaattgcacacgcgtaatttctgaggcccttttttctgattgtcatttttttttcagttacagaaacagacagttttgctcaagttcatcaacagtaccattctcaacaacacctatcaaaatggcacgacgaaggaaagaagcgggaaagcagtcgtacaaggtacagttcacaacttgcttaaaaaacaaccaaattgggtaattctccccccccccccgcctatttcagctgtacgttcgacggatgctgaagcaaactcacccggacaaggaaatctcaacgcgtgtgttgaacatcatggagtcgtgagtttcggccgtaaaggctcaagcaatgaattttaatttttttcatccaattttttcaaaatttcatgttcctcaacgatttgatggatcgcattgcagcggaagctacgctcattgctctctataaccgccgcaagaccatgaatcttcgtgatatgcagtccgccgtccaactgtgcctccctgtcggaatggccacgcgtgcgaatcgcaaggcatatgatgtggtggcacagtacaatgctgctaggaaacggaagggcatcttggggcaattctgcagttggttgtgattttgagggagcaatgaggacgatatttttgacatttgatgtacagtgaatatattgtaatgcaagtctgtatcacatgttcagttgttatgcataatacttgtcaataaa

SEQ ID NO: 66250 - DNA, 217 bp, Heterodera glycines
  misc_feature (18)..(18): n is a, c, g, or t
  Genomic contig location: Contig_ID=SeqID_37083; Location=688..904; Strand=-
  SCN-specific regions: Sequence locations=1-162,184-217
gtttggccatgatggacnggatggtcgtgattatgttatcctgagcaagcagacaacaaccgaaccttcgcttactgtgccggaaaaatactgtaatgggcacaataacgacaacaatggtacgctaacgccgccaacagctgctgaaacaagcagagaagcaaagaaagggaagaaaggatgtcggaagaaatagtgcatgcggcatagaaataaa

SEQ ID NO: 66251 - DNA, 563 bp, Heterodera glycines
  Genomic contig location: Contig_ID=SeqID_37088; Location=134..696; Strand=-
  SCN-specific regions: Sequence locations=1-194,228-260,282-516,538-563
atggtactcagtatgacagtagtcaatttgttcattttaatggcagttgtcatttatttattgctttttctcgcgataagaaacgtatcaacaggtgattaatttatatgccggtaaaagagttggaatttcgagccatgggaattaattaatcatgctgacgttttataaacccgccaatgtaatcagcatgcattttatataaaatgaattaattaatttttattcaaattgtcggtcaggcggtgccgatatgcccaccggaaattttttgaaaatttaatctacttctgaacagattttgtccaacaaaaatgggtggtcgatcatttcgtcactgatcgtttcgtcactgagaatttttttaaaaaaaagtttggcacatttacataaaattagcatccctattcattatgatcaaagggctctcaactctgctgatttatcagcattttgctgttttcaaggggtataagctgctctttgaccccaattgctgtttattgtcggtaaaatactaatttttaaaatttttagccctgattatgaccacaagtgtgtaa

SEQ ID NO: 66252 - DNA, 359 bp, Heterodera glycines
  Genomic contig location: Contig_ID=SeqID_7877; Location=121..479; Strand=-
  SCN-specific regions: Sequence locations=1-319,342-359
atgaaatcacttttattttttaccatttttttccttttcctattatttgtgattgccacgccaccagcttcgaaggaaccacgaaatgttgaagagatggaacagataaacaacgaaataaaggaggaaggaatgtaagaaaataaattagaaaaaaagaattttgaaaaatatttgcttgagggaggtcagtattttgaaaaaagcctggacttgctggacataaattcaatgttggaactgaaccacaattttatgcataaaaatccaggaaacccaggtccagcaaaaatcctggcttgcccaggcctggacatggatttttaaattgggttttaaaagtaacaaaggataattaa

SEQ ID NO: 66253 - DNA, 1218 bp, Heterodera glycines
  Genomic contig location: Contig_ID=SeqID_7877; Location=1588..2805; Strand=-
  SCN-specific regions: Sequence locations=1-237,316-402,425-459,499 -558,583-594,616-778,800-811,847-985,1008-1011,1033-1066,1112-1218
atgacaaggcaatcaacaaactcaaaatgcggaaagacaaaattaatagtaagaaatttagaagtgaaattccgaggttaatatagaatgataatggctagagaccatctagaaattaacaatatacaggagataaaagtagcaaagactaggcacaaatacaattaattaatatatgtaagtgaccggccgaattataggttggtaatcgagcaaagaattttattttgagtctacatatttaagttaataataattagattatttattttatgaaatattaaaagttagtttttgtaaaaaaataattattatcacggacgaaatcccttactgacgaaatcacatggtacctaacagagcccggttatggatggatatttgggtaaattaaaaaaataagggaaaaagttttcaaaattttcatgttttttttgaaggccgaaaaaattaactagcattaaattttaactaaaatttattttgatatttatttttcatgaattttttcgaagtgcccatttgataaatcacagattagggcgctctactggtgccttattaatttaaaataaaataattgataaatcactgtttatacaataaaaatgctctattagtgccttaattgataaatcactgaatagggctctatctattggtgctttattgaataattaaaaaattgataaatcactgaaaagggctccactggtgccttatttgcatataaaagtagaaattatctgaataaaaagcaagacaaataaagaataattacatttatttctttcatcacgtcaatttccactttattttattttatgaatttttaattgtttttttggccagttaagatgtttaattctgtataatttataattttaaatgataaactttttttgtattttctttgttaagctattttcaaaaaaccattggattaattattagctttcagaggcgagacggaaagtttcaaaactttttaataaaaatataattatgaatttcacatgaaaaatgatgaaaatctctaaaaaaaatctcattaaaactgttacatgaaaaatgattaattaattttcttttttacagttttatgcattttctgttaattttattgtcactttggatagttaaaatctttcaaaatgccatgagttttgagaatcataagactttggcactcaaaaattgtaattaaatgccaataaa

SEQ ID NO: 66254 - DNA, 731 bp, Heterodera glycines
  Genomic contig location: Contig_ID=SeqID_7878; Location=544..1274; Strand=+
  SCN-specific regions: Sequence locations=1-731
atgtttaccttttattgttcggtgcatatcgattcagtgccgacgattcagtgccgacgattcagtgccgacgattcagtgacgacgattcagtgtacgttgaaaaaccgacaattcagtgtcagaaaatttggcaaaaaaattccaaaaaacccaaaaaattgcaaattttattaattggaaaacataaataacgcggtcggccagtgtaattgttgatgagggccggttccgtctcaaatatttttggactcaaattttttaaaatcaataactaatttagaaaaaaaaagtaaaaattcttttacttcgcagcctaccgcagcctaaatatacctggttttttaaaagttgtggttaattaaaagtatattcgaaaataaaattttttgaaatgaatttaacattgcaaatgtccagtaattctgctcgggattctcagtcttggtcctcgtgtcgggaaatttagcagccttaatgtgtccagcactttgtttgcagcgaatccggcacccattttggaccccgaacccggaatataaagattaatttacataaatttcgtctaattttcaaaaatacaccccctgagaaatgaaaaatttcctcaaaaattttgttattttatacgcctaaattgaaactttaacacctattttgaggtttttagaaccgaaaacctaaatattttggcagtttttagttttgaacacccaaaaatattaggcata

SEQ ID NO: 66255 - DNA, 111 bp, Heterodera glycines
  Genomic contig location: Contig_ID=SeqID_37092; Location=607..717; Strand=-
  SCN-specific regions: Sequence locations=1-111
tacaaaaagggccattactttgtgaagcgacccgcgctcgactactttctcgacatggtcggctaccccaactttgagttggtcatatacacatcggaaacgatgatgcag

SEQ ID NO: 66256 - DNA, 547 bp, Heterodera glycines
  misc_feature (331)..(331): n is a, c, g, or t
  misc_feature (364)..(364): n is a, c, g, or t
  Genomic contig location: Contig_ID=SeqID_37093; Location=472..1018; Strand=+
  SCN-specific regions: Sequence locations=1-8,32-205,227-336,359 -390,412-547
atggagtccctaataattaataaaaagtaaatcattattatttccacagacttctcaatggctggaaaatttgtgccgaatggaagcggcggttgaattgacaaactttggcatttttctgattttgccaagccacacttggcaaagtgtcggggccgaacgtcccaacagcggtgaatgacttattcgaaacaattggcaccacagaaattttggaacaaattaacgatccctgcgacacaaattgcattgatcagatggtgaagcaaaagttggagctgatgagtaagccattaagccgaagtttaatactgcgattttaattcattanaagactaaaacataaataaaattttgtttttanaaatagcattttcctttgttttattcgggttcgtttggccatttggatgtcattttcgcgatcatcgccactctaaaaatgccataaaaccttcattttttaaggccattcatattaaatttcagaccatctgaaagacaatccacgatgactgaactaaaaggacattgtcgaaggaaatga

SEQ ID NO: 66257 - DNA, 968 bp, Heterodera glycines
  misc_feature (35)..(35): n is a, c, g, or t
  Genomic contig location: Contig_ID=SeqID_37095; Location=1..968; Strand=-
  SCN-specific regions: Sequence locations=1-126,148-476,498-968
  Gene Ontology: Mol. function=monooxygenase activity; Biological process=leukotriene metabolism
aaattcgagcgcagcagcgaaagcattgacaaaangaaagggctaagaagagcggagactcttttcttgacactttgttggacatggagggcaacgacactttggagccggaagagttgcgggagcaggtggacacgttcatgttcgcaggtccattcggccccctcccggaaaatttgctattttttgaatgtcttggattactggagcgtcctttgtgtcccattatgccccatggtacagtatccaacagtaacgcctttattccggggaaggatacaattcttaggccattctacccgattcggtctcggaaacagagaatgccggcggaaaggaccgatgtgaattaagagtgatcgagagaaagatcccgggcggcgtaattaaagagggaggagatcaaagaaccgcccattaggagagaaacaaatgtttgggacacaaaatagaaaagtgtgaaagatgaatcaaaaaataaaaggtaaagaattggataaaacgattaatattattatcatgttcggcatcaaaagtttagatttttctgctgaccctttccccgattagggtaattaaagtgttcctttccattcggctttttcatttaggccacgacacaacatcccacgctctgatctggacattgtggtgcattgcgtgtcatccccaataccaacggcttatccatgccgaaattgatgccaaatgccaagaaatgaatgccaagggaattgtggaggaaatttcgtttaagccagcggatgtgaacgaactgcgctacatggaccgctgcattcgggaaagtcttagaatgttcccggcagttccagtggtcgagcgacaactgcaaaatgatttggcggtaaatgggaaagtttggccccgcggggcattggccgttgtggctccgattctgatcaccacaatgagcaagtaaagcacagcattcaaaatgaatctacagc

SEQ ID NO: 66258 - DNA, 228 bp, Heterodera glycines
  Genomic contig location: Contig_ID=SeqID_37096; Location=183..410; Strand=+
  SCN-specific regions: Sequence locations=1-155,194-228
gtaaattttgtaaatgagaaggaattcgatgttgaggaattgacgaaatttaacgagaaagcgcaagagctgaagtcgaaaaacggaagaagcaatgacaagccaaaagtgatcggaaatgaaaagactgtgcccaaaacggacaatggcggacagaaaagaggtcaaaatggaaaaagatgggcagaaaaaagttggcactggggcatcaacagtgaagaagactag

SEQ ID NO: 66259 - DNA, 559 bp, Heterodera glycines
  Genomic contig location: Contig_ID=SeqID_37099; Location=52..610; Strand=-
  SCN-specific regions: Sequence locations=1-12,43-82,104-428,450-559
atggctctctctgcccttctcctcctccttcctctgcttctcaatgtgcaaaatatcccaggtaattcccctcaccctttgctttgttccattggctgtcccttaagatgagtccgtccaatcggatgtgaaagccgttgattcggccatttcgtcgctggaacaatggaaggacccgcgcaattcgttggcatcactcgactcacagctgacagagccccaacgagcactggccaaaatgttttgggaattggagaccatcgaaaaggaaaagccgaaggcaccgccacaattcgacttgggacttttcttggaagctttggaagcgatggtcgaaatgaacgaagaagcaaaggaagtgaagctgagaaaggacaaactgaccgaatgggcaggcggagagaaagcaaacgaagggaaagaagggaagacgaaggaggaggagacagtgccggaagtgagagttaatgagaatggaaaggtggaagtgacgaacggcgccggaggggacggaaagatggaagtcaagcgaggaaaggacgagaacggaaacgagcag

SEQ ID NO: 66260 - DNA, 487 bp, Heterodera glycines
  Genomic contig location: Contig_ID=SeqID_37101; Location=233..719; Strand=-
  SCN-specific regions: Sequence locations=1-373,404-487
tcatctaatctgatctgcgatcgttccggtgtacagaaaatttcgtttcagacgggcaaagaattggcacagcggtggggacacaaaacgatacgccacatttaaaaaaaagtttcacagatataccaacatcaaccggcagtacgaaccgatgtacttggcacctccggaaagcgaagtcggaactcgaaacattacaatatattttttcaaatattttccagaaaggcaaaggcgtccatggatgttttccccgtgttgaggacaccttccgcaaaattgtcgccaaatgctacggcgacattttgatcggtgcgttttggggttttggcactttctattccaatcaccaaattttttttataaaacgatgaaatttatcaataaatatttttctttttcagtgtcccatcaaggcccagtggccgccctgcaacggatgttgaccggaagcatggaattcggggggagcgcaacagtgagcaag

SEQ ID NO: 66261 - DNA, 2263 bp, Heterodera glycines
  Genomic contig location: Contig_ID=SeqID_7880; Location=599..2861; Strand=-
  SCN-specific regions: Sequence locations=1-25,68-79,101-258,287 -501,549-876,898-913,935-1060,1084-1438,1482-1785,1808-2263
  Gene Ontology: Mol. function=structural constituent of cuticle; Cellular component=hemidesmosome; Biological process=cuticle biosynthesis (sensu Nematoda)
atgccttcccccatccgccttttcactcttttctctcttttcctgtttctgcttcttctcctcccatttttgtccttcgccgctttgtccccccgagagaagcgccaattcagcttcaccgatggcttctcaagcggcacaattttgcagccgggcggcggcggacttttgggttcgtggggctgatcatttggccgaacatgcgaagaatgagaagagcatgagcgtgattattcaatgttgacgaatttaattgtcaaaaattatcttttatttatttttaattcatcatttataaagaatacggtatctatggtatacctactgtatgtaagagagtgaattgtttgaatttgaattccaaagactgaaaaactttaaaagaacggattaaatacatgttgaattaaacaactgcagaagcagtcgattcgcgcagaggcggagaatctttggaaatattccgagactctcgaaatgttcaatttcaatttgaaaaacaaaattaaaaattcgatattacaattaataattaaaaaatattttttgttttgttttaggcaatattgtttaatgattcattgcgttccagcgaaagaaaggattattcatcatttgaaaatgctttgtaattgtatcgtttcgtttcggtgaatgtgtgggcatttgtcgcccaatcgccgccatttatttgttattttctttttttcgatgtttttatgaataagcatgaacaaatttcaatcattcttgtcgatcacccaaacattgtcattcatttgccattttaaacgctcccaaaaatgatatttttaatgtcaaaaagttaaaagatggcgaaaaacgcatttaaaaggccgttgatcgtttacaaaaacataaaagaaaagttattctcaaaacgaaggatcactaaagagaattcttttttaatcattctcgaaaatgccaccgacttgggccttagtgccgcttttgcttctgttctttgtccatttcattgatgtcggattcgctcgtcgctacaaagcgtcaacaaaatacaatccgccggcggaagaaacgacgacagaaacgacagaattgacaaccccaacgggtttcaattattaattaatccgctttcaattgcttttccttttttctgactgtcaccggttttttcaaaaaaaaaaaaaattggtgttggttgcttttccaatgtgaacattttccgccagaatgccctgcgccggtgtgcccatgcgaatgtcccaccgaagaaacgtctgaaacgcctccttcgacgggcgggggagggggcactgacgacatcggtccgcccgaccgttcaaaattcaaaatattgcttacaattagtgtgcttttaacgccgcatccctttttagtgacctcgccggaaggagaggagacgaccacgcccgtctccggttgtgttccgggcccgccggggcctcccggcccaccgggcccagcggggcaaaaggggccccagggaaaatgcggcgacaatgcgagcaaacgcaaaagggaagcagcagcagtgccgaaggagtttatggtaaaagagcgaaaactgggcaaatgaatgccatcagtagttggaaaatcaaattaatagtaccaaaagatactaattatcttattccgaatcattgttcaaaccttttaatcttaagacgaatttggaaccgaatgtgccagtcaaacgtgcaaaagaaggagaagccgttgcaaagacgcattttgcacgtggccatgtcaaggggggctgtccaccgggtcccccgggggagcctggcactcccgggcctccgggccctcccggagacccggcgccatgcccgaagcacatgaaaagcgaagcgcaaagcgtcgatggcaaacaactggctaacagaaacaaacgtggggagacggtgctgaatgctgcaaaggaggggaccgaagtgaaacgccaaattgtgcgccatgggttcgtttttgggcaaatcgccgtgggcgaaacagtaccgaaagtgcaaaattgagaccattgttttgtatttggcaacactattttcaaactcattgatgagttaattaatcggtcgggttgaggggtacctaacaaaaatattggaatttaagcattggaccgcccggccccgccggaccgccgggagaagcgggcgaagacggagagccgggcccttgcgaatgttacaaagaccaaaaaagtcaatgaacgaacgcaatttatgcgaatagcacacgaaataaa

SEQ ID NO: 66262 - DNA, 1886 bp, Heterodera glycines
  Genomic contig location: Contig_ID=SeqID_7880; Location=1..1886; Strand=+
  SCN-specific regions: Sequence locations=1-174,196-217,241-268,292 -1054,1077-1380,1424-1778,1802-1886
  Gene Ontology: Mol. function=structural constituent of cuticle; Cellular component=extracellular; Biological process=reproduction
cttttattttatatttcaacattagtgtactaaattaagtaatattttggtgattttcccttcccggcacctttcaacacatttttttattaacataaaaaaacattagaaagagcacaaaattttctgcctaaatttgggaagagtgagtttgggtaggggataagagaaacgagagggaaagggtgggagagagagtacacatagagtaggattccagagaaatgagagggaaagagagagctaaagtaccattcgtgtaactctagccttgtctactcccattccaaatagtaataattattttcttcttgccttctccttgctgggcacacacccacccctcatgggtttgggacctctatgaaaaatactttttggaacggggccagtccgtaatggccctttaaataattaattatttcattaatgaagcaatctaaactttggaaatgaaacgatcattttcaatatccggcgggagtccaaataagaaattgattcatttataatgcagtcaaaattcaagttagtcagatttaaagcaataaaaaattttttcaccaaaataaatttaaaaaacattaaatttgctagttttatttcgtgtgctattcgcataaattgcgttcgttcattgacttttttggtctttgtaacattcgcaagggcccggctctccgtcttcgcccgcttctcccggcggtccggcggggccgggcggtccaatgcttaaattccaatatttttgttaggtacccctcaacccgaccgattaattaactcatcaatgagtttgaaaatagtgttgccaaatacaaaacaatggtctcaattttgcactttcggtactgtttcgcccacggcgatttgcccaaaaacgaacccatggcgcacaatttggcgtttcacttcggtcccctcctttgcagcattcagcaccgtctccccacgtttgtttctgttagccagttgtttgccatcgacgctttgcgcttcgcttttcatgtgcttcgggcatggcgccgggtctccgggagggcccggaggcccgggagtgccaggctcccccgggggacccggtggacagccccccttgacatggccacgtgcaaaatgcgtctttgcaacggcttctccttcttttgcacgtttgactggcacattcggttccaaattcgtcttaagattaaaaggtttgaacaatgattcggaataagataattagtatcttttggtactattaatttgattttccaactactgatggcattcatttgcccagttttcgctcttttaccataaactccttcggcactgctgctgcttcccttttgcgtttgctcgcattgtcgccgcattttccctggggccccttttgccccgctgggcccggtgggccgggaggccccggcgggcccggaacacaaccggagacgggcgtggtcgtctcctctccttccggcgaggtcactaaaaagggatgcggcgttaaaagcacactaattgtaagcaatattttgaattttgaacggtcgggcggaccgatgtcgtcagtgccccctcccccgcccgtcgaaggaggcgtttcagacgtttcttcggtgggacattcgcatgggcacaccggcgcagggcattctggcggaaaatgttcacattggaaaagcaaccaacaccaattttttttttttttgaaaaaaccggtgacagtcagaaaaaaggaaaagcaattgaaagcggattaattaataattgaaacccgttggggttgtcaattctgtcgtttctgtcgtcgtttcttccgccggcggattgtattttgttgacgctttgtagcgacgagcgaatccgacatcaatgaaatggacaaagaacagaagcaa

SEQ ID NO: 66263 - DNA, 382 bp, Heterodera glycines
  Genomic contig location: Contig_ID=SeqID_37102; Location=674..1055; Strand=+
  SCN-specific regions: Sequence locations=1-202,224-232,259-382
atgccaacaaacgatggaaggagggaaccgagtgaaaagtgagaagcaacgaagccgcgcataaccaaatcctaatattgtcttaataagcagtaatggcggaatgcgcgaacgaacagatgacactgcacgtccaattcaacgaggacactttgcaaaacggacggttcaccgattggataatcgtacgaagggaatgccaaaatgggaatggaattatattttgaaaataattcaaaataaaaattgaaattgaaaccccaaaaggtgggaatgacaacgcgacccgaatgtcgcctgaagggaaacggcgaactccgctacatcgtgcaaattgccgttctgaaggacccatgggccaccaaattaatggcccctggca

SEQ ID NO: 66264 - DNA, 293 bp, Heterodera glycines
  Genomic contig location: Contig_ID=SeqID_37103; Location=461..753; Strand=+
  SCN-specific regions: Sequence locations=1-51,105-293
atgggtcatcataattcagcgacgttcctttttggcttacttttaggtaagaaatttaaaattatttataaaattataaattcaaatattatttttcttttaaaggttattttttgcccgaattggcggcacagcttagcaaagatgagcaggattattgcgtcaaattcagcaacaatcttcgcagcaatgtggccactgggaatcagcagaacaaaggcggcggcaaattgccatcggccacgaatatgttggagttggcatataacgagacaattggccaaactgcgcaa

SEQ ID NO: 66265 - DNA, 222 bp, Heterodera glycines
  Genomic contig location: Contig_ID=SeqID_37107; Location=183..404; Strand=-
  SCN-specific regions: Sequence locations=1-222
atggcaaaaaaagtgccaaaaaatgttaggcttttgctcacctgtcggtcagtgaaaggagtcgcgcatgcaattgttggatgtattcacggacagagtcaagctgtcgcaacatctgttcaccatcgtccagcgaaaaatcagtacgagaatattcacgatcaagatggtcctggaatggagtcaattgcgataatttaggggcccaatcatttaaataaa

SEQ ID NO: 66266 - DNA, 56 bp, Heterodera glycines; identical to SEQ ID NO: 57643
  Genomic contig location: Contig_ID=SeqID_37109; Location=573..628; Strand=+
  SCN-specific regions: Sequence locations=1-56

SEQ ID NO: 66267 - DNA, 218 bp, Heterodera glycines
  Genomic contig location: Contig_ID=SeqID_37110; Location=460..677; Strand=+
  SCN-specific regions: Sequence locations=1-218
atgagtaatagtgatattaaaaagacaattgacatttggattggagaagcagaaaagtcagacctccagcaaagggaaatttgggtttttataggagttgaagaaaaatttgtaattgagggaaattttggtaagaaaagtttgaaatagtagaattatatattgttttttttgaagaaattgttggcggtctggcagaactcagaactatttattga

SEQ ID NO: 66268 - DNA, 144 bp, Heterodera glycines
  Genomic contig location: Contig_ID=SeqID_7881; Location=1033..1176; Strand=-
  SCN-specific regions: Sequence locations=1-116,138-144
aaacatgacatcatcgaaattgcgctattaatctatattccgatcctgatcagtcaaatttggcatcaacgcattttcttcccttttcagcaaccgacggcaccggtcaatgccgtgccacagcagcagcaacaggcggcacag

SEQ ID NO: 66269 - DNA, 1225 bp, Heterodera glycines
  Genomic contig location: Contig_ID=SeqID_7882; Location=769..1993; Strand=-
  SCN-specific regions: Sequence locations=1-260,282-333,361-739,763 -1060,1082-1225
gtgttgccggcggcgaacgaaggagggaccagcggcggaagtgagcagcagcaggccgaagcagcacagcagaaaccggggcagtcgagcagcgagaacagtgctccgagcgcagcggatggaccacgggtgggttaatacttttttaaattaatcgcttttctggcatttttagggtctcttaccacttagatgtatgtgataagagtcataaaatatgagttccgggaatgcctcgactgttttcgacactttctcgtgccaaaagaaaaactaataatcgttaatctctcgttaaaatctttgagttttttttaaatttcttacggatggatattttttaaacttttaaaaaatgttgtagagaaaggtggggatgacctgctcgcgcccaggcgaagtgccgagcaggatatttagggaaatttttttcaaaaaaatccctcattcattactattaattctatggcaaatttcttgaaaatggcaggtgtcggcggggaacgacgtcggaggcagcagcgcaagtgatgagcagaacagagcaggaccaattgcagcacaaccacaaaaacaggggccgagcaacgcgagcagtgcgccaccggccgaagcgcaggtaaatgtgaaggcgaattaagtggccataacaaatatatatttaaatgcaattttccatgtttttcagtcgttgggccaacaggagcagcagccgcacgtggaaaaagtcgagggtaaaaaatattaattaatagatgggaaaagcgcgatcatcagcaggggatggcggggcggcacttggattggaaatggcacaatccaagaaaaaaatttgaaacattttaaacgattttttggtaaatatttaaattttgttttcaaaatttaatttggtcgaacattttcagcaggtggtacttcgccatggatcattgttggctcgatcttcggaggcattggagccggagcgatcattgtttggatcgtcattagttgtgttaagagatgccgtaaacaccatccatttgacatatttaatgctttaaataacattcgattattttattaagaaagaaacaaatgcacaacggaggaggaggagaagccgaaaagtgccgaagtgccgccggaagcacagcagacgacgacgacgagcagcagcagaagcagatggggcctgagaggcttcagctatacaaacgccgaattcccgaaacgtaataaa

SEQ ID NO: 66270 - DNA, 56 bp, Heterodera glycines; identical to SEQ ID NO: 63336
  Genomic contig location: Contig_ID=SeqID_37113; Location=263..318; Strand=+
  SCN-specific regions: Sequence locations=1-56

SEQ ID NO: 66271 - DNA, 816 bp, Heterodera glycines
  Genomic contig location: Contig_ID=SeqID_37119; Location=1..816; Strand=-
  SCN-specific regions: Sequence locations=1-508,530-661,688-770,813-816
aacaaaaaaatcgattttttcaagtgtccgtttggggtactcaaacaattatggggagcaaaaatccaacgcagaattaaagtacaggctatagggaagctactcccgaaggattcggtctccccataaatatgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaa

SEQ ID NO: 66272 - DNA, 1845 bp, Heterodera glycines
  misc_feature (706)..(706): n is a, c, g, or t
  misc_feature (723)..(724): n is a, c, g, or t
  misc_feature (741)..(741): n is a, c, g, or t
  Genomic contig location: Contig_ID=SeqID_1021; Location=134..1978; Strand=+
  SCN-specific regions: Sequence locations=1-34,56-312,353-486,508 -531,553-751,774-1845
atggcggcacaacaacaaaaggccaacagtgcgttcaagaagaagctgaaggacaatttgcgcaaaaagatggacgagaaaatcaaaagggacttcgagaagggatggttttacaatgtaaagctgagctcggaagtgacggagcgggaaaagctgcgcaattggtgggctaatggggcaacaattattgaagtgattaaccggggaacttaatatgtgttaattattgaggactgataattatgaccagggttgccaactcaaaattttcaaaatcaacatttaaaaaccaacatttggggtcaaaaagtacctttttggaaatttttccaaatgaaaaacaataaaaaatgttttttttttgcggcgtaatttttcaaaaaaaaaaaacaacttatttttgggaacaggggaccggcgatgttgataggctaacactgtttatgatcataattaattgatggagaattgtaattatgctaaacctattaaaaaaatattattattgttttttcattttaggataattgatccaaatatctgacaatgaaaatggaatcgatcgtcgcactttttaatttttgctcctaaaattgtacttttaattttgttaataaacaaaagaattacaagcatttcatcttcaatatgtagacaatttttttgtggaattttacatgacaaaaagaaagcttttatatgtganaatttgcccacattggnnagacaattgataagaanattggcaaaatgttttttgggttttgttttgtcactttgaattcgttgaaaatgggcgacacattgcttaattgggaaagacatatacatttggaaataaaaggggcaaataaaagcgaaaaagcgaaaaaagggggaaatggtcagcagatgccattcccgcccgaatgctgatttttacaattccgatctcgagaaagcaaagactgggcaatgatgagatttttaggcaataaaggcataaattagccaattgtgaaaagaaatatttacttttcttatttctgtgccaatttttgcgtttccgtgcctaaaaatctcatccggacattgcatcgtttgtcggccttttgtccgttcgctgctaatccctacaaatggtcgaatttgaatgaaagcacatctctcagtgggaactcttccaacgcttcttgtctccatctcgtccactgttgctcagttctgccccgcttcttcggtccccgctccatcagaaacatttgtacataagtccctccggggacacgtcgaaatgagaggcgttcattggtttggccattgtccaacacgaaattgtcaagggcgaggccatcgaaagcatcgaaattgggttttaagccagggttgccagcggataagctcaacttcaagcacacagagaagctgataagtccaaggaaataatgcgaaatccaaaaaatattcaaaatttgcctccgatccattggaccaatttccaattgtgtgcttttggttggcatccaagaaggaaaagcaaccctgtttaaaaagagagatttgttcgaacacaaccaaaaagttgaccgatgccgtggcattaaaaaacaactgaaaatgagaaaatttgaagtctccgaaaaaggctaccgttttgagttcgtccaccacagcgggaagaagttgacgaactttgatcactttgggctgcccatcggagcgtgccgtgtgcagccatttggacaagggatggagaggcgaagaccaaatgcgatcggacttgacataagcgaaccaatcggcgatataaatgatcagtcggatagtggtcgaccattggcacttaaatttccatttttgatttaa

SEQ ID NO: 66273 - DNA, 163 bp, Heterodera glycines
  Genomic contig location: Contig_ID=SeqID_1021; Location=6531..6693; Strand=-
  SCN-specific regions: Sequence locations=1-95,118-126,149-163
gtcctgattggagtgcaaatcgttggcacctcagaaagctcaatactttcccattctccgtccagccgtttgagcttcactttgtatcttcccgattgtagcttcactttctttccaccgaacacttggattgccagctggtcactcccgactttctcggtgc

SEQ ID NO: 66274 - DNA, 2602 bp, Heterodera glycines
  Genomic contig location: Contig_ID=SeqID_1021; Location=4046..6647; Strand=+
  SCN-specific regions: Sequence locations=1-1326,1348-1594,1618 -1905,1928-2138,2161-2368,2390-2500,2523-2531,2554-2602
atggagcgacacgacgacgaccaattcaacgaaaacgcgaatcagggggatcctcccccctctgatcagcaggacgagaggcgagcgatcggagctcagccagctaagcccaagacaatcttggaagcgcacggacttgggacaagccaaccgggtgttacacccgccgtgacgaagaatttgcgtagcggactaatcgcagtgcgatcggcacgggaccaaatcgaaagagcagcgggcactcttgccgcgcgaatcgtcgacgcgcgggagctgatggacgacgattacacaaggggcgaagcgctcgaacacgctgctcggatgatggcaatggagcgggggttcggagaagtcaagcgaatttttgaagggcattttgagaagggcatagccgaagcgggtgcggcacctgatgaacggcaggacttcttctatgattccattgccgcccctttgccagctgcaacgaaataccttcgactgcgggagcacccaactcccgccgaactccttcaaattgcggccgagcacctcggggatctgcgagcgatgcggcaaacattcgaggacgaagaaagggagagcatctctcgatcgagcagatctgtcgaaaccgagaacaatcaggcggaggaagaactcccacgtgccatgccacgacggagcatgcaagagtgggagacatcgttcagagaagcttatgttcgacagcatgacgaactgttcggccagcagcaaccattggtcaaccaagcggaacgggtggccacacccgtaatgtcaaacatggccgcgcttatccaacgacgctcaaatgctccctcggtggccagtgttcgtgtgaacaatccggtcagggagtggatggcaaggaaccaaggggtcgggaacggacccccggcacaggcccaacaaccaacacaagcgcaacgcccgctacaggccgtacagcaacgcctcgaacaacttacgctcaacgatccaagagccaatttccctcgggcagcacctcatttccatgtccgacgggaggaacctcccactcgggaccgtacccgagctcagggggtatttccttcacggcctcatcgcccagacgaatcagctggcatgttaacaacttttgaagcagtgcgcctacaaccgccgacattttcggggaggccggaggattggaccactttttgggcctacttccaacgggccgtggacgacaagcaaattcccggcttcgagaagcagcttcatctgctgcggtgcttaaaagaaggatcgccggcacggagagcggtggaagtgtacccaccgtcggatggcaattatccggttgtggtgcagctgctgaaggaacgatttggggacacgaacgacttgcaaagagcgatccgagctcagcttctacacttgcagccagcaaaggacaacgtgtcgagcttgacggcagtgatcgacgaattcgagagaggagtgtgccagctcgaacaactgggagcgaacgtggacgacgagtcgttcggcccgttgttggaggccaaactcccggtccacatcctcacagaattgaggatccgggagagtacgatgggagcaaactggacagtgcgagagtttcggaaagcggtgggagtgcaagtcaagtgcatgagggccgccgaatccgcgttggcagcaatgaaaggacccgaacgccgacatgagcagcgatcggagcccgagcgaggcggacggaacgcccgaacaggacaaggattccagcgggcatttatgatcagagatcagcccccggagaaacgaacgtcgaacgaagcaaccaccaggaccgaagtcgcgatgccacccattcgaccaacgaatccgaatcgtgtgccgctcgggagttactcccgaccgatgggagcgcattcccaagcacaggatggacagggaggacaaccccgacaagggtgctcgttgtgtggacaaacgggacaccaaccaagccggtgtggcaaatatgggtcagcacaagccaaaaggaggagactgatcgagcaacgccgttgtctcaaatgcctgggatccgatcacaccgcgcagcagtgtacacgaaaaacagcctgccggacgtgcgaacaaatggatcaccactggctgatatgctggaagggggagagaaggaacgaaccccctagccactcgagaacggaagatgcacaacaaaatcggacgatgatcattcgggaaattgaagcgaagcacttgcgcactccccctcccaccgagtccagcaaggacgggatgggggctaaaggggaggacccacctttgctcgacggagagcagagagcattcaccaccgtgggccagcaactcccggcctatttaatggtgtgcccggtggtggtggcatcggaggatggcatgacagaatgcaataccaatcttcttctcgacccagccagccatggcgattatggggatgcggctctgatcaagcagctgggcaccgagaaagtcgggagtgaccagctggcaatccaagtgttcggtggaaagaaagtgaagctacaatcgggaagatacaaagtgaagctcaaacggctggacggagaatgggaaa

SEQ ID NO: 66275 - DNA, 4783 bp, Heterodera glycines
  Genomic contig location: Contig_ID=SeqID_1022; Location=106..4888; Strand=+
  SCN-specific regions: Sequence locations=1-397,420-1801,1823 -1850,1872-2273,2295-3382,3407-4642,4664-4783
atgccatcggtcaaagcaatcgaccagttttggtcggttgaagcgatcggaattcgcgacgacccaacacaagacgccgacacggaggcgatcatccaattcgaacgatcagtgcggcaacacgacgacggacggtacagcattcggctcccatggcgggaggaacatcccgagctgccctccaattatgcggtggcttatcgacgactgatcgggctactccagcggcttcagaggacgcccggagtcctcgagcagtaccaaggagtgatcgaggagcaattgcgggctggcgtgattgaggaggcgacagtggggacgggaagtaccgagtatttcatccctcatcaggccgtgatcacccccaagaagctgagggtggtgtacgacgccagcgctcatgccaaaggagttccctccctcaacgactgccctttgagaggccccgtgtggctgccagacttggccggaatgctcatccgttttcgggcatgccaagtacccgtactcgccgatgtggagaaagcttttctgatggtcggcattgaagaagctgaccgagaagtgtgcaaatttctgtgggcgcgcgacccacttggaccactgacaacggccaatttggtgccataccggtttcggcgattggcgttcggcctgacacccagcccgttctgtttggctgcggtggtacgtcaccacttgcgcaaatacaactccgaatttgccgagcaactcatccgggatacatacgtcgacaatgtgttaattccggccgacaccattgaggaagcgacggcaaaggcccgagaagccaaacgaatgttcacggacgcaaaaatgaatcttcgggagtttctgacgaatgacagagggctcaatgacagcttttcggaagccgacgcgctgggcaaaacgacagcgaaagttctgggactggagtgggactcagtggacgattcaatccaaatttccttcccgggagttactcccgagggagagtgccgccaaacaaggaggacagtcctcaagaccattgcgcgactgttcgacccgctcggactgctcgcaccggccaccctccccgccaagcagtacttccaaaggctgtgggacactacccataattgggacacgcctctcgaaccggacgatgcgcgagattggaacagagttttggcaagttgggaagggggactcattaccattccccgagccgtccgggctggaggtgtccaacccggacagctgcatgtgttcaccgacgcttcggagacagcatacgcagccgtggcctatctccgatctgagggagccgacgggagatttcactcccgactcctcatggcaaaatcgaggctgaagccgaagaaagcggcagcgacgtataccatcccgagaatggagctgatgggactggtcctgggcacgcgactggcagcattcgtcaaagcgcaactgcaccgcccaatttcggaggagcacacttggagtgattcgatgattgcgctgcagtgggtgaaaaatcgagcaccccaaccacaattcgtggccaatcggttggccgagattcgccgggccacagctacgaccttccatcatgtgccgaccggcttcaacccggccgattcggccactcgggggctttcccccgcgcagcttcaaaattacgatctgtggtggaagggaccgaagtggctaacatcgccatgggcaacttggccaaaggagctggactttcaggtggactcagccgaggacgaggcgatactcccggacgaagcaactacgacggcactcgtaaccaggcgggagcacagtcccgagcaaccgaaggaatggtcggaggagctgctgaacagatgcagcagatgggtgaaagcactgcgcgtgatggcctgggcacgacgatttgccaacaacgcacgaagaaaagccgaggatatgcacggaacaatggggggatctgacccctctcggcgaaaagcggcaattcggggacaaatcgtggctctcccaacccacgacgaagagacggacgcaaaatgggcaattgtccgggcaacacaacggaattgccaaccccgggacggcatgcgaaccgagctggacgaaaacggggtgcaacggctcatcagtcgaatcggctggtgcgaagaagcggaactcagtcggccggtgatactcccgaaaagatcaagagcaggagcgctcattatcgacgacatacatgtgcgactccatcacatgggaacggacggcactctgtcggaattcttgaggagctggtggtgtcccagtgcacgacaacaagttcggcaagtacttggtcaatgcaaacgatgccgacggctcagggggatgccctaccccctcccgacaatgccacaactgccaatggatcgagtgagacgacgattgccgtttgaatcagtcgggctcgactacctcgggccgacagtcactctcgacgataagggacaacgaaggaagacatgggtgctgctaatcacctgtttgacgacgagggccatttatgtcgacgcgactcgagacttatcggccaacagcttcatctcagcactgaggagattcatcgcccggcggggagcaccgagtcgaattctcagtgacaacgcgccaaccttcactgtggttggcaaaacgctcgccgagttcggcatgccgggagacaatccgatcgattttgcggactcccgaggcattaagtggcgattcacgccccagcacacgccgtgggccggaggaattttcgagcgggccgtgcaactcgtcaaacgtgccttgcagaagacattgggaagcactgtactcgactacgacggtttggtcacgctcttggccgaaatcgaggccaccgtcaattctcggccaattacatacgtcaatggcaattcgggagagcctctcccgctccgtcctatcgacctcatccaagaaaatggccgattatgggtggacccgccgcacccatctgcacaacgaggagacgaaccgcgcgatccgacgcacaaacaattggccaaacattggcgagactcgcaacaacgacttgaacatttctggcgacgatggcaccgggaatacctcatgaccttgcgagagagggccggctggcatcatcctcaacgacgagtgaatgcacccggggcaccggaagtcggggacgtcgtgcttgtggaagacaaattccaccctcgcaacttatgggccatggggcgaatcgaggagctcagaggttcagacggtcacacccgcagcgtgctgatcagaatggcaaatggaaggatttgggggagacccgtaagcaaaatttgccccctggagagaagtccagaaatgggggaagcacaggaccaaccagacgaagcagtacaggaagaggaactcggcgcggtggctgggacagaagccgaaggtcagcccggggaggacaacaatgctccccgtggcttgagtggcagtgagggagaaaaaactgtggaggctgaagaagtcgcgcaagacgaagcagaggaagggcccattccaccgagtttcgttcaaaacgaagtcgggagcacctctcccgtgtcgcagacaaatgaccggtctctattggaaaccatgaaccgagagacggaagcggagaaagctgactcaccggagggagcgaacagcatgcgaggaattgaaccaagaaggtcgcttagagtccgacgaattcgagaagtatggtcaccggaccgatacgccccgaaaaggagggggattggaggccccctagtcagcttggccatgctgatcatgttggtttacccgactgtgacattcgggtgtcaaccgactatccgatccgaaattgttgggaaacagtcgctggagttgccaacaacgatgttgccgtgccacatgcggtgtactgaacgcggagtaaaagtactgagcaagcagcgactcgaaaaaatggaaatttgttgcccggatggatgctgggcaattgtgcccacttcgacggagatcagttacgagctaccatccagcgagagcagaatgcgatctgatcagttgctccttctgttgggagcagctggccaacccgacatgcaacccgcggtgggcatcctctttcttcggttttggagccgcaattttgctcggcatcattgcttgcctctgctcaatttttgggcgatttttgtcaggagccaagttgctctcgaaagccgtggcatggggagttcgttaccccatcgggctgatcaattgggcaaccggacgcaattacgacggcggtcaagcggtgcccatcggctgggtcatgccgcggcaacatgtgcaactcaatccggagtgagacggtcattcccgaattggccgagctgaacaaccgcccgggacactcgttttgcatgcgtagcaccagtttctggcagaacgcctgcggacttccaacagcctcttgcctcttctacagatgggcggcggtaccgacaacgacggtttgaggagtttacttgcctcgaatgggacatgcagatcacggcgtgggtggagctggagacgaacagtggacaagtcgacacacatctgctgactctacacccgggagtctcggaacagtggggaaatatgacaattgcggtcgtccccacttccctcccgcccaattatcgtgtgctcttaattaaaagatgtccatagttttgacttaaatgaattatggttttcagacttttaaggacaaattttttctataaacagttcacagatgttgcggtgaata

SEQ ID NO: 66276 - DNA, 250 bp, Heterodera glycines
  Genomic contig location: Contig_ID=SeqID_1022; Location=1..250; Strand=-
  SCN-specific regions: Sequence locations=1-250
gaatgctgtaccgtccgtcgtcgtgttgccgcactgatcgttcgaattggatgatcgcctccgtgtcggcgtcttgtgttgggtcgtcgcgaattccgatcgcttcaaccgaccaaaactggtcgattgctttgaccgatggcatttgatcccgctcgtcctccccacatgggggggatcgcgaataccgacgaatcgggagtaactcccgtcgtggtctgaatctgctccccgcaaatcacagtgccga

SEQ ID NO: 66277 - DNA, 1270 bp, Heterodera glycines
  Genomic contig location: Contig_ID=SeqID_7885; Location=505..1774; Strand=-
  SCN-specific regions: Sequence locations=1-65,87-159,233-461,483 -697,719-808,832-836,859-1027,1050-1064,1172-1270
atggcagcagcagaacaatcgcaacagaacgaaatgggcgaagtgcagcagaaaacggcggaaaatgcagcaggtgagaggaaaagcatggataaatggatgaataaatcggtgcttttgcctttttttgcttcactttttgctttcgcagtgattgaattgctttcgcttattttccttcccttgcctttgatttcggcacattccctttccccttctttctctctctttctactgatcgggcactctttccgatcactctccctgcctgatcactttcttccgttttctctctcctttagtgcctcttttaccccttcccccctcccgccatttcccttttcccattgcttcaattgccgcctttcctttcccataaagtgccgcctgtcgtgcgtcgtttgaccgacgatgcgacgactggccatgccaatgccagtgattgcctgttggacgcggtggtgtcccccgccggcggctgcggtcgcgtggtttcctttgtgcaacgccgccgtcggaccgcctcattcaaaagtcgcgtgtcgcgtccgcccaattggcgccattcgatgcgattgggccgaacagcgacccaagtggaagatgaagcgagcgaagagatgttgctgagcatcacgcactcccagcagatgcagcagcgggcgacggccgcgccgggcgcccaacgccacacgccggcgccgcccgaggcgccgcggtcgcccgtttttatgctgagcattgcccgcaaaggtcgcctgcttctcccattcttcgcttttttcttacaattagttttttgttgacctttttttatttttatttttttttgtgctttctgtgacaaaataaaaaggaaatgtttttgctttcgatggcttttcgtttgttcaaattcctccgtttgaattttctttgatttttcgctgtccatttgctgctgcttcttcctccgcctttgcttctgctgatttgtcccttcgtttgcttaattgtctcccctccgcttctcagctaatgtcggcgccgtcggcggcggtggcgacggccgtctccgcgtcactcagccgcaacagcaaacgcagcagcagcaacagtcgtcgccggagcgatactcgagcagtacaaatgcaacggcaaatgcaatgttccagcagcagcagcagaagcatttgacggaggttgtggcggaagaggacgaggaggaaatgtgcagaagcatgccctggctcaacacactgctccaatttggccgcaaagtcgactttga

SEQ ID NO: 66278 - DNA, 663 bp, Heterodera glycines
  Genomic contig location: Contig_ID=SeqID_37122; Location=4..666; Strand=+
  SCN-specific regions: Sequence locations=1-663
gaaaaaaaaaaatcgattttttcaagtgtccgttttggggtactcaaacatttatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 66279 - DNA, 49 bp, Heterodera glycines; identical to SEQ ID NO: 51181
  Genomic contig location: Contig_ID=SeqID_37128; Location=578..626; Strand=-
  SCN-specific regions: Sequence locations=1-49

SEQ ID NO: 66280 - DNA, 622 bp, Heterodera glycines
  Genomic contig location: Contig_ID=SeqID_37130; Location=185..806; Strand=+
  SCN-specific regions: Sequence locations=1-205,296-501,524-622
atggcaccaccgggcgacgaaaacgatggcaaaagcaatgcccaaaatgataatgctgctttcgatgacaatgatgatgccatgctgcgacgggattgtgagggacaaattgcgaggtatatatgttacaatagggagcagttcgccccctgccccccttcaaaattaggaaaaattcaacgaaattagagatttatcaaaaaacatttttttttaaatttttcatttggaaaatttttttttaaaaaaacttcatataatttgaaaaaaatgctgaaaatttttttaattataagattttgttcttgaaaaatttctaattctgggatggtgatgatccgagagggtggcaaacgaatatgactttttttcagagtgtggcataactgaaaagtaccctgatttttgccgtttccctccgccccaatgtgtgataagaatatgccaccctgaaagaaagaaaaaaacaagcactttttcaaacccatccaattttttatgtctttaaaaatgtgcatttttcagttcactgctgtccaattggcactccgatgcggtgacagaggaccaaatccgaccaattgtggccagaataagtgcaattccgttgtgtgtcttttga

SEQ ID NO: 66281 - DNA, 373 bp, Heterodera glycines
  Genomic contig location: Contig_ID=SeqID_37131; Location=34..406; Strand=-
  SCN-specific regions: Sequence locations=1-172,195-281,354-373
atgctctgtatgcttggatttttggttatgcgttcaatttgctcaaaaagaaactcatttgtaaaatcatatcctgcaaccacgctgccgatgattattggtgtcaacacggcagtcactgccccaattatgagcccaacactgatcaggtctcgttcatttcgagatttggcattttcagtaatgttttcagcagaatttggtgtgcgtttaccctttttttgcattttttgccacaaatgacaaaagatatttatgcaaaaaattagaacaaaaatgacaaatttttatttgttctttttaaatttatcttgaaatataatggtataaaataaatttaattataattaattcagtgacacgttctatataa

SEQ ID NO: 66282 - DNA, 400 bp, Heterodera glycines
  misc_feature (37)..(37): n is a, c, g, or t
  Genomic contig location: Contig_ID=SeqID_7886; Location=401..800; Strand=-
  SCN-specific regions: Sequence locations=1-268,290-400
atgaaaagcattagtcaaatttctcaaatgattatcncaatgtgttttttgcttctgcttttatcaccaccaaacgcaatcggccaaaatttgtgccaatgggacagcggcaaatgcgttgaccgagggtgtccatatggttgtccatatgacacggaaccagaatgtggttgtacttcaccaaaggtttgttgttggatttgattttggcaatatttaaaaaaaaaaagtcataattggggcctccggcacggcatttaaggcagtgaaataaaaaaaaaaattttaagcgttaaaaatccgctaattaccaagcgactgatccttttttaaaataaaccttattttattcagccggattctgtgccaaaaatccggtccaagccttaatcaaaataaa

SEQ ID NO: 66283 - DNA, 243 bp, Heterodera glycines
  Genomic contig location: Contig_ID=SeqID_7886; Location=1..243; Strand=-
  SCN-specific regions: Sequence locations=1-133,155-243
ggaagaagcaaaccaattagcctagaagccgagaacgaaacaaatcaacagaaaaaaggcttgaagcagggacgcaggatgatgtttgccttaattttaacttattacatagagaaaacggcaattttaataaatttcacctctacatttgaaactttttcgcccctatttcgcgaattttttgcccctatttaagtccctaaattggaatttttcgcccctaaaaatccgcaccctaatgat

SEQ ID NO: 66284 - DNA, 981 bp, Heterodera glycines
  Genomic contig location: Contig_ID=SeqID_7887; Location=219..1199; Strand=-
  SCN-specific regions: Sequence locations=1-79,102-287,342-713,785 -829,852-870,916-981
atgccaatcgtcgatggcaacgacgcagttgacatccaactgataagagcaaaacggttcttccagaatgaacggtcctggaacatggagcagattttggaagccatactgtgtgtgttcattccacctgctgctgtactgatacacggaggtactgtagatgtacagtaatgccattacaaaaaaaataaaactttaacttttcgaaaaattttcaagccaaagtcttggttaaatgtttgatcaaatggatcacaatattgcaagtatggacatttcttggcaactaaaaatgtttattatttagattagattaattttttaaaatcattaattaataacacattactaaaaatatgcaattcaaaaaaaaaatttaatacagtagatatttttttttgggatttgggtaaacttcaattttttgaatctataaaattttttaaagaatctgaactaaatttgtatacaattttgtaccttttgtaataccataattaatgctaaaatatgtattactgacatactgacacattttctgggagccctttatatcaattcaatcgcaataaaaaaaatgttcaggacacgacatgttgctgcacatggtcattaacattgttctgtggatatgcggatggattcccggaatgattcatgcattttggtactgcttttaccgggattgaacataattaatggatggaacgaacaattaattaaatcaatgtttttaatgtattttaatttaaatgcatttaatgatgaaaattatatatttttactttgtattttcgcataaattggataaaacttaatgtgtaagattatcttaaaactaaaaaagaaaatttaaatttttttttctccagcagcgcctgagaatttaaagaaaaactttaaaaattgaaaaaaattgtttttttttgagaaaatctaagggattctttaaaaatttacctttcatataaattcaataaa

SEQ ID NO: 66285 - DNA, 433 bp, Heterodera glycines
  Genomic contig location: Contig_ID=SeqID_7887; Location=5834..6266; Strand=-
  SCN-specific regions: Sequence locations=1-182,207-366,388-433
gctttggattctcggctggattcccggcaccatccacgccttctggtactgtttcttccgctagatcgatgaaggatgatgatcaacaccgatcgagacccccatcattgttgaagaaccggcccaagaaatgagaatcctgccgccttatttttccgatcattttatgctttttatacatcaaccacaaaacacaacaacaaatcgccaacatattttccatatttggataacaaaaaaaaagcccgatgatgatttcgatcagccccatcaattttttaattgtttttttctccaatttttaaatttgttcaaacaatttgcttgctttttcgcacctccctcgtcgccccccccccccactcatttatttggtttatatgcttttatagaaatttttttaatctcatttaatgaataaagttctacaccc

SEQ ID NO: 66286 - DNA, 621 bp, Heterodera glycines
  Genomic contig location: Contig_ID=SeqID_7887; Location=2154..2774; Strand=-
  SCN-specific regions: Sequence locations=1-110,422-572,594-595
atgatttacaatttactgttttgttgcatgattacggcatgttttatcaatgttggcacatgcatttacgacattaacattggcgagcgcccaaaggtatggcacaaaacattaaataaaaaataaaatattagaaaaaaatattttagcgggaatgattttaaatttatttatttatttattctctttaaataaattgttttaagaatagttaatagccagtaatagcatttttaattgttttataaaaaaaattaatagtttttttttttatttcaatgaatgatattttataaattgcgtttctgatatttctaaaaaaggtttcaaaaatattaataaatttactttactttagaaaacatttttaaaaaataatattttctttattatataatataataaaaaattaaaatttttatccttcttaattatacaacttataatgttagggttacacggggccgggtgtcagacccggacgcccggactcggtaaactaattaataatccctaacttaagaaagaattttttgcagcaattttaaaatgacttttttttacaattgaaaaagaaaattttcttaagtaaatcaaaaaatttaaaaaaaatttaataaa

SEQ ID NO: 66287 - DNA, 2069 bp, Heterodera glycines
  Genomic contig location: Contig_ID=SeqID_7887; Location=3745..5813; Strand=+
  SCN-specific regions: Sequence locations=1-11,33-36,58-772,829 -911,933-943,965-1094,1116-1141,1165-1185,1207-1283,1305-1739,1761 -1807,1830-1863,1886-2069
atgaatgttcctgtttgttttgtggccaatttgtacaaccaacagcagcagcagtaagggaacaccaaaaaatgttaaggccaccaatcaattttatgttgagtcatcgctgattgttcaattcaattcatatttcacaatgtgatgattatttcatgggaataatacgcaaaaaaaaaacagcaaaacgccaaatcatcgccaaaattggtgcgagaggaacagcaagccaaaaagggtggctgggctaatgatgagtctcgagagtcccaaacagctttctatcttggagttgtacgggatcgcaattcaaaaaataaaacgggctaatccgcgaaatcccggccttccttggattagagcactaatttttttttagatcatgtaaaaaaggattaaaaaggggttttatgcaattctgcgttgtactcgagggaggaacagccaaaaatgatgcctattgatgagtctcgagaattccaaacagcttttttggaaatgtacgggatcgcattacaaaaaaaaaaaatcgggttaatctccgaaatcccgggccttcctcggattaaggcccaattttttttctggtcccataaaaaaaaggattaaaaaagggatttttttttgcaattctgcgttgtactcgggtggttttcggggatgctgaaacgaatatgacatcagatttgtcacttgatttcactaaatgcccttttagtctccgttaagggtttagcttattctataaacattattccgtaattgatgatagtaaaataatagaaaaaataattgattaaaatataaatttataaaaaatcataaatagatgcaagcatatgacaaaatgtaatattcgtaagcactcccgaaaatctccgcgccgagtacaatgcagaattgcaaaaaagcccatttttaattctcttttttatgtggccaataaaaataataattatccaaattaggcatttctggtgaacaagttgtctttttatagtgatttttggcgttaaaacatgatcaatttatgaattttttgacctaattttgtaaaaaattaagggaatggcggtgtcgattggtaccgccaaaattgctaaatctaaaaatttactgtaaaaattatataattttcgcattatttcaacaaacattataaaaatgctgatgggtgtccttgaattctcctccccaaaataactttgtccaaaaaaataaattagcaatttttacattttctgccctcgcttcatttggagcaattaattactacacacagcagaaaagagaattgtttttgaattgtttttgaagaattatttttaaataacatccttgaaattttgacggtattttcaaggacatttaaatacatttttattttttccacgaaaataatgtaagcggcgcaatttgacactttagaacttttcttaaaaacgaccaaattcaactttcttggcatcattctatagccctcacaaatcagtgtcctctattagcctgaattatttcaaaaaacttaaataaatttcaaaaaaaaaaaagttatgaccagaaatgttcgtgcaaccatgcttttttcgaagtttaataaatttttcgaaattttgcagactaataaaggacattgataatgagcgctatcgaattatgccaaatattgaatttggtctttttttagaaaaaaaatacaaaataatgttaaatttagttttttgaagaaaattgagtaaaaaatagaaaattttccattttggattatttgaagtattatttccactttttctaaagtcacattgtttaaaataattttcaagaaaataccaaaaggcaaaaaggccgctttaatagaggatttttggaaaatgccaaagaaatgcgacatatgcatatgaaacttcattttacacgtgttaatctatgctaaaaaaattttcttgtgttttaggcccttcacagttcaggaagaaaatattcgtgagcacttaattggaaaccctaggcaattagagtaattaaaaaacttcgcattaatgagtcattagaaaatccattccaaacaa

SEQ ID NO: 66288 - DNA, 149 bp, Heterodera glycines
  Genomic contig location: Contig_ID=SeqID_37132; Location=1235..1383; Strand=+
  SCN-specific regions: Sequence locations=1-5,30-149
acagacaaaacatacacaatcagtggaacaccaacgaaaccacccatttgggagtaatgactaatcacccaatttgaaagcaaaagagagagattggacgaatgattagtgatggcattagagaggaacgaaagaaagtgtcagaaaaa

SEQ ID NO: 66289 - DNA, 101 bp, Heterodera glycines
  Genomic contig location: Contig_ID=SeqID_37133; Location=643..743; Strand=+
  SCN-specific regions: Sequence locations=1-101
tctaacgaaggtagtcgccaaagtcccggagaagggccaattgctcgttggtgatgataaagtggagccggtacttctcgcgcagggcacacagcttctcg

SEQ ID NO: 66290 - DNA, 736 bp, Heterodera glycines
  Genomic contig location: Contig_ID=SeqID_37135; Location=1..736; Strand=+
  SCN-specific regions: Sequence locations=1-105,127-379,401-736
cgtccgtctctcttctcaccatcgtcgcaattttctgtttgctgtgcaaatgttgcatttcggcaccgcgtaattaatccttccttaactgtaattaaatattaattaattgcttttcaatagatccgtgctgtcccggcagccaaaaagtcgtttcgctgatggccaattacgttggcactttcgcccattccttttccaagtcatcgctttgttcggatgccaaaagtgttgcgggcgcattgaaaggccaactgatcggctgctcgaagggcggcgacgcaactcttttggccgacatcgaagcatctcttgccaaccattcttctggtattgatggactaatggatcaaatccattgccaaattagccaattaactttatttttaattattttaatgtttttcccctttttgatgagtgtgcccacagcctcggcttcgtccgtgccatgttcaccattgccgcctccgcttcttcccatgccagcaacaacagtgaatggcaggcattgagtgccaagtttggtcagcaaatcagtgaaattgactcgaaatgtgccgagtttggcattagcattgccaaagtgtcttttgagggccccaagggtaaaaccaattatggagaatatctcattatttatttgcttacaattcaaggagaccactcccaacgtaatgtgcctggtacgaacaatgtgattgccatgcccggattgaccggctcacacaaacaa

SEQ ID NO: 66291 - DNA, 1383 bp, Heterodera glycines
  Genomic contig location: Contig_ID=SeqID_37137; Location=101..1483; Strand=+
  SCN-specific regions: Sequence locations=1-781,812-878,923-1052,1083 -1095,1117-1166,1202-1205,1231-1266,1288-1298,1345-1358
gtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgatttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagt

SEQ ID NO: 66292 - DNA, 977 bp, Heterodera glycines
  Genomic contig location: Contig_ID=SeqID_37140; Location=7..983; Strand=+
  SCN-specific regions: Sequence locations=1-114,136-403,503-586,635 -943,965-977
atgtcggacgttgacaaattgtcggatcggatgaagcgtttgctgtgcacgggtgttgatgcggatgtgcactttttggttgggcaggacgacaaaaaagaggcgagttcggatactgaaaatgttataaatacataagaatgggatgaatttaggcaaaatgcctattttctcatcagctaactttgtataagagttgccgcgagtcggtaaaaaagtcggatcagattcctgtcgatagtcccgcaatttcaccaaacaattcggaattgcctttttgggtcccgcaaaatccggcccatgacctgcccccgcaccgatttaatctgaaaaactgagtcgggaagtcatgtcaggaatatcttgcctaaaaattcttgtctaaaaaatccacatttagttcaattttttttttgaaaaatcaatttttaaataattttccaattaaacaattttaacccaataaaatatctaatttttgaatttgattaatttaattaaagcttctaccagcgcataaaccgattttgagagtttcgtccgatgttttcgacgcaatgtttcgatttgacgagcaaaaaagtggaaaaaataattttaattatttttcattttttaatataattttttttaacattgtcagaagggaatgaagaccctattgaaatcccggacgtcgacattgaagcgtttaaaactatgttgagctttatttatacggacgatttgaacggagtgaacggagacaatgccatcgaagtactttatgccggtaacaagaaaaaaaatgattagaattttttttaaatttagctaagaaatacaatttgccatcattgatcaaagcatgtgttggcgttcctattgcgaagctggacaatgtgtttattgcttttgccaaagctcgtcttctggccgaaaaagtacaaaataaagaaataagcttaaaactcatttatttttccctcatttcatga

SEQ ID NO: 66293 - DNA, 1332 bp, Heterodera glycines
  Genomic contig location: Contig_ID=SeqID_37141; Location=70..1401; Strand=+
  SCN-specific regions: Sequence locations=1-153,175-1332
  Gene Ontology: Mol. function=peptidyl-dipeptidase A activity; Cellular component=integral to membrane; Biological process =proteolysis and peptidolysis
tgcctacggccggtgacaaagcaacatgtctgctcaaattcgcggaccttccgtccatgttgtactcccagaacacgggcacaaatcaatgcttggaattgtggcaaaaatggcgtttatcggccggctcaaatctcacacaaagttacgccgaactgattgagttcagcaacaaaggtatgaactccgttttggccgttgtatcattcattaattgcgtgttttgaggtgccaaattaaacggttactccgacgccggtgccatgtggcgttccgtctatgagcttccggcacaattcggcttttactcggccagccaaatcgacatcagccgccagatggaccttttgtacagccaattggctccgctgtaccaacaactccactcttatttccgcgcgcgattggcggcagtttacgcgcaaaaagcaaacgaagacagtgaaaagggagggcagcaattgagcaggttaaacgggtgttaattagggtaattagggatcgtaaacaaaaaagcatttttagagatggtccattgccaattcatttgctgaagagtttgagcggcgacagttggacagtgcattacgaacagacaaagccattccccgaagaaatgccggcggaggaacagaaaattgccaatgaaatggtcgactcattccgagcacaaaattacactgttcggacaatgttttccaaggtattctaaggatgttcaaacatcattaatttttcatttttttaggtgtaccgtttcatgaaattcgttggctttgaacggcttccccgcactttttggacaagttcaatttttacgcgtaattggagtaaggacatgatttgtaacccggcaactgcgtataacatggtcaaaaaccacggcatatgttcgaattcccctgacactgttttagatgaacggacagcaggacgattaccgggtgaaagtgtgtgcccaattgagtgagcaggtgcaacaaaacaccaattaattaattaaacgttttttgtccaacaggactttgtcaatgcgcaccgtcttttggccaaactttactatcagtacggttcacgaacacagcccattttgttgcgggacgcacccaacccaaggtaattaatcaaaaaatgcttatttaattatttgaaaattaagcctaagcgcggcactcgccggtgcctttggcatcgttgcgcttcatccggattatctgagagcacagaaattggtgtcggtgaaaaccgagcgcaatgccgaggcagaagtgaatcgattgtacagagaagcgctggaagacattgtgaagctgccatttgccattgtagcag

SEQ ID NO: 66294 - DNA, 961 bp, Heterodera glycines
  Genomic contig location: Contig_ID=SeqID_7889; Location=207..1167; Strand=-
  SCN-specific regions: Sequence locations=1-393,415-825,874-961
atgtacaaaatgatgtcctccccacgcttttcgcgtaacgcggctggaatgaaaaggcaaattggccctggacatcgacgtctcccaacaacttcctcttctcgtgccgcatctattcattcttcaaattgctcactaatgtttcgtcagtgattttgtcactgaaataaaatttcaaaaaatgcttatttctaacaaaattgctcaaattgatcatggaaaaatcaaaaatataatattggaacattttaaacgtgttttgaataaattttgtaaaaatgaggcttttttgcctgccaaataaggctttgaaaatttttatctgggaactgccggtagtgctgctcgagactctcggtctcgactcgagaaaagtctcggtttttttttcggtctcggtctcgggaaattttcggtctcgagcagcactagcaaatccctttcgagtctcgccataatcccccagcccatccggccttaataaatgctaaaatgataataatgccatttcagtttgtccagcaatatttcgtgtccgactacgacccgaccatcgccgattcgtacacaaagtgttgtttcgtggacgacgccctttacaaagtgggaatgggggagcacattcagagcccaaaaaactgctgatgaatgaattttggcaaatttttattttcattttttacaggtcgaaattttggacaccgccggccaagaggaattcgcggcgatgcgcgaccaacaccttcggacggggtaagaaagaagcacaaacaattaaatttaatgtggaaagagcaaatataatgtatggatgagataattaggattaattaattaatttaataatttgaaattaaaattgaaaattattttcaattcggacatttataaatgccattttccagcattagagaacggaatcatgaaagctcttcttgacctggattattccctggactaa

SEQ ID NO: 66295 - DNA, 2207 bp, Heterodera glycines
  Genomic contig location: Contig_ID=SeqID_7889; Location=1945..4151; Strand=+
  SCN-specific regions: Sequence locations=1-102,133-176,198-226,251 -452,480-484,506-779,801-894,916-963,985-1139,1162-1630,1654 -2120,2143-2207
atgattaactctgcttcaacaattttaattgtatttaatattactttccaatttttatttacgtgttcaaatgcaaatccatcggtgagttaattaattgggataattaatttaaattatcaattataattagggtgacgacaaaatactaattgcaattatgaaagggtatccgaaaattaaaattagtgaatattcaaagcataaatacgaagctcacctcggcattctttattttatcaaaacaaattggcaatgcgacaaaattgaagcggaatttgaagaacatgaacggacagaatgccaaaaatatcgcaaatatttggatattttgtacgaatatttgtgccgagaatactttggaactcccacaataaaaccaaaatttgtgtttaaaggccgaattgaaattgaaggaccaataattgatgcggtaaaatgcttagccaaaatttcgctgttttattttaaatctcattggaataaaaaatatgaatataaattaaacaaacttttcactgattattttgaagtaaaactgttgaaagaggagagattaaattatgaatttaagttaaaaaatgaatcaaaattagcaattaatggccatattttacaattggcaattgaaactagggttgcgccccgagccctcggggggcaaaaaatcgggggccggggacctcggggggcgacatgtcgggggtcgggtcgggggggagctcaattgtagggggtcggggaccccgatcgggtagtgatcaacgaaattttttgacgaaaaactcaatttttattttaaatgctcgtaaatcttcctttttttcactttaatcatcggatttcattagcgccagcaagagtgagtccaagctagcctttaaaccaagggttacccttgaaaatttcccgaaataagaacatcgctgcgcaaaaacaagattttagggtcaaaaataaggaaaattggtcatttttggtgaaaatctgtgggcaaaatgaactcaaattttcaaaaaattctaccggcgaagcctatcggcaccgccggccctaaaatttgatagcattttgatcaaataaattgtaaaaatttactgatttgaaaaatgttgctaattgatattatttttgactctaaaatcttatttttggccttgatgttcatgtttttaaaattaccgatcggcaccatggttttagggggctggcggtgccgataggcgccgccggaaatttttttgggtattttaatgaattttattaagaaaattcgtttaaaatttcaaaaattttcaatatttcccgcctttgtggatgaattaacgggcgccggacttttcgacagcggacctttcgacagaaggacttttcgacagcggacttttcgacagtaaaggacttttcgacagaaaaaatttttgtttaaggggaggacttttcgacagtaaatggtagttttaaaaaagacaatgctatttcatttagtaagcaaaataattatttttgtttcgaaattatttccgtttttatggaaaagttaaattgggtccggcattcgataggccacagctcttaaatattggtagggatggcgctgttcacgtgtgttgtaaagcgcgagcaaattttcgtcttgttcaacataaatttctttacttttcatgcctttaccacgaattccattcatgccaaatttgacggcatccaagccaattttttgcaaaatatttggccagttctcaaatgggatttaattttttttaaattcaattgttattattagggattagatttttaggcatactaaatagacacttaaaaaggcataaaaagtccgaaataggcaaaaacaatacggggggcgattgatacagcgccaaaattcgatccctaatttggggtttggacaaaaaattccaagttttgcaccttcttgaagtccgctgtccgcttcaaaggcatattcaaaaccgccgcttctgattaactctcggccacgcttgctttctgctagaaaaaattggacaagaccagctggttcctctgcttcttcaaaggcttagagttcggccccaatttcaccttcttcgggaccactagaaccagaagacatttttcacagcaattcaaaaatattttcagtaatagttatgaatggcatggtcactcttttttgggccggtcgagaaacggaggtcaaacaa

SEQ ID NO: 66296 - DNA, 304 bp, Heterodera glycines
  Genomic contig location: Contig_ID=SeqID_37145; Location=189..492; Strand=-
  SCN-specific regions: Sequence locations=1-304
aaaattccctctaaaataaaatgtctattgcgcaccgccctccctatcatgctcgagagcatttgtatgtgtataaaatttatcaaaaaaaaaaatatccatttttctgggataacctctaaatataaaaatcctctgtgaaataaaatggtgattgtgcacagccctccgactcatacccaaacgcttttgtgaggtataaaatttctcaaaaaaagagatagccatttttctgggatagagtataaatataaaaattccctcaaaaataaaatgtctattgcgcaccgccctccctatcatg

SEQ ID NO: 66297 - DNA, 280 bp, Heterodera glycines
  Genomic contig location: Contig_ID=SeqID_37145; Location=569..848; Strand=-
  SCN-specific regions: Sequence locations=1-280
tattgcgcaccgccctccctatcatgctctttgagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 66298 - DNA, 593 bp, Heterodera glycines
  Genomic contig location: Contig_ID=SeqID_37148; Location=240..832; Strand=+
  SCN-specific regions: Sequence locations=1-126,170-216,238-280,302 -305,343-437,459-593
atgctaaccaagcgcatattggtcacattttctggccaaaaatcacctgtgccaaaatgtcccgtcattagcggcagaaaatttttttcctccgatgcattcaatgtgagttgcattatggatagcttattaactattaataatgttttaataattaataaatttaattcaacgacttttaaaggttgaccgaaattgcacgcgccacggcggcgaattggtggccaatgtgctgaaggtaattgaatgcataaagctcggtcttgtcacaacatttgtgatgaaaataaattcatttatttccgttaaaaaatacttttttaatatttttaaatattttaactttatcctacgaattcatttgtgcccggacgggactaagatcctttgcatgattttctcaggatggctcttgttttcctagtcatgttataacaagatttattcctgttcattctgtcctgctggtccaactcggaaatcatttgtccggatttattcaaaaccgcgctcttcaattcccgaaagttccagttctcttttttttaatctttgtcaagctttttgaaaatttataagtattttgttgaaaa

SEQ ID NO: 66299 - DNA, 364 bp, Heterodera glycines
  Genomic contig location: Contig_ID=SeqID_37149; Location=295..658; Strand=-
  SCN-specific regions: Sequence locations=1-364
atgaggaatgtgccacggaacactcgtggcgagatctgtgaactgcgcttcctgccgctggaggacacacagcggcccgacttgttgatggaggtgctcatccaacatctgctagaccgtgtgctggacggtcacccgccgccatccctggttggtctgcagctgcacccaccaggctttgatcggccgtacgtgatccgacttcgcccgcccgagcagaacaacgcagcggcactggcggcagccattgagcggctcaatgagcaatcggcagccggcattgacctgcttgctgggacaacggtcgccaaagttctggcggtgtggccactcgagcaaattcgtgcggacccacaaagaggag

SEQ ID NO: 66300 - DNA, 274 bp, Heterodera glycines
  Genomic contig location: Contig_ID=SeqID_37150; Location=713..986; Strand=-
  SCN-specific regions: Sequence locations=1-251,273-274
atgacgagtagcgaaagagaacaagaaacggcatttggagaaaacccccaaatagggaccggagaagacagtgctaatgcacttggtaatggtcagaatcggtgagttgcggcaccgttccgctgatatcactttcattgatccaggggtgtgcacgacgtttgtgatgaggaagagggaagagatggagagacgccaccaagggcattccaacccacccatttgaaataaatagcacaattccaggcatattcaatttgtttggaccgggtaa

SEQ ID NO: 66301 - DNA, 1272 bp, Heterodera glycines
  Genomic contig location: Contig_ID=SeqID_7890; Location=483..1754; Strand=-
  SCN-specific regions: Sequence locations=1-198,220-492,514-573,623 -663,685-782,805-961,983-1064,1086-1272
  Gene Ontology: Mol. function=chloride channel activity; Cellular component=integral to membrane; Biological process=transport
atgagaaatttcggtttgtcttctgatcagcgtccattgatttggagccgaacagacagaaggttttcacacaacaggtgattttttctttaatgcgtttttttactttcataaatttggtatctttttagtctcgacccaaatgaagatcccgtcagtggaatagagcgagtttcctccacatcgacccttttttcaagacgaaggagagaagaacggctgcgagaacaagaggaagtgcggagacggcaatttagtggcagtcggaaactttctgatggcgcatcggaacatacactttccgagaaatatgaaagtctcgactatgaattaatcgagaacgaactttatcgtgctgctgaaaaggataaagggcatcaggtgagttccttttttatcttttgagcatcaatcaaagttttaaaacagcgaaaattgttccgacaaacggtcgaccgatggatcgtttgctttttgattggtgttgcaaccgcttcagttgcagcattcattgacgtgctcgtttattacaattcaaagctaaaattccacctcatcatcaacaattgcatgtttaaataataaaaaatatattttaaattttatttttaattgtatttttcctttccagtaattcactcttgtgaggagggcagtgtcggcagttcgggttgtacgtggacaattctttgggtttgggcattatacaattgcgctttggttgccgtggcatcgtttttggttatctttgtctccccagtggccattgggtccggaattccgcaaattaaatgttttttgaacggaatacaaatacctggcgttgtgcgcctgaagacacttcttgccaaagctggtgaaatttttaacgtcttttttacaaaacaacgatcttttcagtcggcgttgcatgttctgtgggtggcggattggctgcaggaaaagtaattagaaataaatatcattaaaagagttttaataatttttgctcacaaatttttctgtaccttttttcttataattaggtcgaaatcctcaaattgtttggcttcttcctctttaaaccttaatatattttccattgttcaggaaggtcccatgattcattctggcgctgttgtcgccgccggtatttcccagggtcgttgcttatcattgcctgtggacttcggattgttcaagtatttccgaaatgaccgggaaaagcgcgattttgtgagtgccggcgcagccgctggtgtttctgcggcttttgcctcgccaattggtggc

SEQ ID NO: 66302 - DNA, 433 bp, Heterodera glycines
  misc_feature (374)..(374): n is a, c, g, or t
  Genomic contig location: Contig_ID=SeqID_7890; Location=4184..4616; Strand=+
  SCN-specific regions: Sequence locations=1-99,121-433
atgcagaattttttgtctcaaaaggggttcgacctgcgaaaacttaagacggttagtgcttttttgaggctatcaattgtcaattcgttaatcactttgtgtttctcaggaggcccccacggcgaaattgcttaaggatattcccttggccgatgcgttgcgtccctccgccagtgacttgctttacaatgaaaaatggcgtcacatttcgcccattcacatgaaagaagtgtccttccattttccctatctcccaatgttttactcttttagattgatgcttctgattcggtgatcaccgacgagggctttgcttattttttggaatgtcgaaacatagaaaaactgcgactgaatttctgcgattattttgnggacgaagcaatcgcacggcttgcgcaggggcggcagtcaaaaacgttgaaaggaattg

SEQ ID NO: 66303 - DNA, 1748 bp, Heterodera glycines
  Genomic contig location: Contig_ID=SeqID_7891; Location=43..1790; Strand=-
  SCN-specific regions: Sequence locations=1-58,80-187,216-395,453 -527,549-556,578-598,624-935,957-1075,1097-1402,1424-1654,1676-1748
cctctgttcatttcactaatgacattgcccccgtcgctctttgcctttgaccaaatgccaactttggacccggcaattccgactcaaaggttggtcaccgacggcggagggttgatcagctgctgactcggtttgatcagcatttctcttcatttgtgatcagtgttcccaatcctccccctcaattcccttctctttccccctttttcttttgtcagtccccacttggctccctcttccgattcgtgtgttggccaatgcgctttgattttcactgatcaaatgcgctcccaattgggctcggaacattcgacgggactgctgaatttgaattacaacgaattcttggctgccttttccaattcgtctttcttcgattccttttgcaagtgcgcaaaaaaaaacaattaaaaaaataattatttatttatttttgtaaattaagtatttatcatcaattcaatttttgctacacaaaatgcccacaaggatttatgcaagaattgttgagcagaagtgccgaaatagtggaccatttttgtgtgtggaattacaaaggtaaattaaatttacaatttcattttgtaatattcattctccattttaaagtaaaattaaaagaattttgttttaattgacaaacttttgcagaaataaagacaaaattcggttgtttggtcgctttggaccgcgaaatgtccaaaaagtgtcttcattcctgcgctgggtgagcaattagaacttaattagtatattacttaggcattgactacagtatttcccccccccccccataaaatcccattatcccgaaaaaagagatttttcttaagataattttatgctctaataaagaatctgacgttaaaaccttcagtctttgattttatttgacttacttcatatttaccaaactatgaatctatataaatgccctgttaatttcctttatggttttattaccgtacacctaatcacttcttttgttaattaccgtaatcctaatcgcttcatttgtttgagtaccgtaatcctaataatcccttttaattaccataatcctaatcctttcccaaatcccttcctttggtcctttctcttggctgctttaattactgatttctctctctccctttaggcatcacaaagctgtaagatgagagcagagaaagaaaacaatggacagtcagacaaaagccaaacgaacaaaaagcaattaaggtcacttctctgatgcaaaacttcaaacatttggcgatgaacagcgacccgacggaggccgaaaaatatttgggagaaagttgcgaatacgtcggctgcactttgcactgcgatgtgccggccattgacagcctttgcggcacggacaccgcagaattagtgggaaaagagaaacaaacactataattagccaattaacaaagtcattaattttgaggtggtcaacttaacaaagaaatcctttgattctttacaacggatggccctggacacgggagcaattggaaaatggccgacactttgtgacgacattcggacatatgttgtgccaaaaaagcatgagaaaccgtcacaaaacgacaaaaacgaatcatcgataaacggggcattattcagacagacggagtggcaaatttgcatttggtcattggcattttcttttttagtattagtttacttgcagaattcggcacaataatattttagttgtcagagttacagtttggttattagttccaatgttaatt

SEQ ID NO: 66304 - DNA, 145 bp, Heterodera glycines
  Genomic contig location: Contig_ID=SeqID_37153; Location=1..145; Strand=-
  SCN-specific regions: Sequence locations=1-33,57-145
cgcatcagccagttcttccacaaggaatcctgcggccagtgcaccccgtgccgtgaaggcaccggctggatgcaccgcgtgctggagcgcatcgtcgccggcaaggccacgatggaagacctgcaccagctgaaggcggtggccg

SEQ ID NO: 66305 - DNA, 213 bp, Heterodera glycines
  Genomic contig location: Contig_ID=SeqID_37160; Location=1..213; Strand=-
  SCN-specific regions: Sequence locations=1-213
catgctgcgcggtgaggccgattgtgccgtgcattcgctgaaggacgtaccgatggagctggacgcgccgtttgcgttgccggcgatgctgacccgccacgatccggccgatggtttcgtctccaacctgtatgcctcgctggaggcgttgccgatcggtgcgcgtgtcggcacgtcctcgctgcgccgccaggcccagttgcgcgcgctgcg

SEQ ID NO: 66306 - DNA, 247 bp, Heterodera glycines
  Genomic contig location: Contig_ID=SeqID_7893; Location=204..450; Strand=+
  SCN-specific regions: Sequence locations=1-88,115-167,189-247
atgttggccttattcgcctcaattttcgaatgcatttttctgctctttagcacatttggcgccctggcttcagtcatgcgaccaaaggtaattaaaaataaatattattttaatggcttaaaattttcagatgaagggctttctgttgctcgcattgcttccgctggtcacatttttaccagaaacaatggcgaaaagtatacaagccgctgaaatgtcggaaatgaacgacgaattgtccgactaa

SEQ ID NO: 66307 - DNA, 717 bp, Heterodera glycines
  Genomic contig location: Contig_ID=SeqID_7893; Location=682..1398; Strand=-
  SCN-specific regions: Sequence locations=1-29,52-717
  Gene Ontology: Mol. function=signal transducer activity; Cellular component=nucleus; Biological process=mRNA splicing
atgttcgcttctgggtccactgacaacatcaaactttggaaatttccaaacggcgatttcgtgcagaatttgagcggacataacacaatgataaattcattggttgtcaacgaaaacggagtgctcatttctggaggtattttccgataaataatacaatccatccttcgaccagatataagtcaacaagaaaacattataaaatactaaaaattttagttttaactgcataaatttccttttcccctccacaaccctccatttacaatttaatcatttaaggcgatgttggcacgatgcacttttgggacttcaagtccggtttctgcttccagaaggaacacccgccaccacagccgggctctatcgactccgagcgcggcatttttgcgcttacttttgacaaatccggcacacgactaatcacgggggaggcagacaaatcgatcaaaatgtggaaagaggactcggaagcggtgagaaatgttcacatttatattttaattacaaaaccagcggcaagaaaatgtgggagggaatgattggctattcatagtttgattctcttccacttttagtcagaagattctcacccgctgctgtggcgtcccgaaatactcaaaaaacagcgtttttaatcctgttgttttaattttgcattatacatgtttttaattataaatgaacaaacccaaaaattacaaacgcacaaataaa

SEQ ID NO: 66308 - DNA, 1382 bp, Heterodera glycines
  misc_feature (586)..(586): n is a, c, g, or t
  Genomic contig location: Contig_ID=SeqID_7894; Location=6..1387; Strand=-
  SCN-specific regions: Sequence locations=1-156,178-310,338-564,596 -685,715-910,939-1162,1184-1306,1328-1382
  Gene Ontology: Mol. function=signal transducer activity; Cellular component=nucleus; Biological process=mRNA splicing
atggctaaccattcatcagaacataatcgggttactgatgaagccgggtccaccgcaacagatcaccagccattaaccgcgaaggataaggcacttcacaattacgtcttccggtctatgaagagagcgcatgacatgttcctgcacgactatgagaaattcccagaaaatgatgaaaaagcgtcagttttatcactaaactaaaagggtgggcaagggctagcaggtattacaccccaattcgataaaagttaggaaaaaagtgcccttaatccaaaaagataatactgggagaattggtgtcccggcgaaaaataaattaaaaaattttttttttctaaaagtcgttaaaagtatttatggaggttttctgggttgctgatcacgaatctgacattaattttgaccaatttcgaaccccggactcgaacaatagtcgaaattctcacacataaaacaagtttgaattttcgactttttgtctgagttcgggtcctggattcggaattggccaaaactaaggtcatattcgtgatcagcgactccaaaaaccacagatacatgtttttttacataaaaatttatntaaaaaaatcaagttcttaccaattctccagtattacctccaaaaattttctcatgccgccgcatttcgctttgtattctcacaatcaagcaatctccgtttaataaatatatcaaaatatttttttagagagcgaatttggcgcaataccaaaatccgaagtgactttcgacacgtaatgaatgcggtcgaagaggcgaagaagcgaaaggcggcggaagtgcttcgattaccgaaaagcaacagagaagcaattgcagcagtcgtaagcaatgaaagtgaggaaagcaaaatatcagaaaaagctgcattattgtccacggcatttttttctttttttattttaaaaaatgtccacataatctccaataatattccttgtcagatgcccctttggctatcacagctggcgatggtgctgattttaccggcaatttaatggtcgccactgttccttcaaagcctcaacaagacaatgcgaatttgcgcgctttacttccttcccgtgccaatttgataaccaagccaaaatggcatgcgccgtggaagctgtacaggtcattcattggctgtcttcccttaaaaagcaaagttctgtatcggtttagagtcatctctgggcacacgggatgggtgcgggcggtggacgtggagccgaacaacgaatggttcgccagcggaggagccgatcgcatcatcaaggcatgttagtcacatgtatatgtaaaacaaaaatattttagatttgggacttggcaagcagacatttgaaattgtcgttgaccggacacattag

SEQ ID NO: 66309 - DNA, 404 bp, Heterodera glycines
  Genomic contig location: Contig_ID=SeqID_7894; Location=1922..2325; Strand=+
  SCN-specific regions: Sequence locations=1-41,64-170,221-404
atggttatttctcaaattgctaaaacactatggtcacacaaaaagaagagcatttttgcagttattgctacggcttacggggcgaacgctttaagggcacgtttaaggtaattgattagaatggttagagttgggaatttcttctaaattaagacgttttaaaatcttagttaattatttaattaataacttttttaaataaatatttttgataattttacagagatgaccgaattcgatacagttttgcagaacgagcccgtaaatatggtctggtaagttttgggcccgcccagcgacttcgccgtgtcactgttttggtcaatcgcgagtcgggcggacgacgggcggccgaccttttcaagcgcaatgcacttcccctgctcaatttggccgggctgcaa

SEQ ID NO: 66310 - DNA, 1017 bp, Heterodera glycines
  misc_feature (474)..(474): n is a, c, g, or t
  misc_feature (539)..(539): n is a, c, g, or t
  misc_feature (601)..(601): n is a, c, g, or t
  misc_feature (621)..(621): n is a, c, g, or t
  misc_feature (628)..(628): n is a, c, g, or t
  misc_feature (685)..(685): n is a, c, g, or t
  Genomic contig location: Contig_ID=SeqID_37162; Location=722..1738; Strand=-
  SCN-specific regions: Sequence locations=1-73,104-160,182-187,209 -506,530-646,668-716,738-919,958-962,984-1017
atgtgcagtggttgctcgacttcaacattcagaaatcaaagacaaaaccgagcaggtaataatttgtttattttgcgtgtggttaaaaacaaaaattttatttggtaaaatgaggcttctctaaaattgtgatcgccacgaggcgccatttagaaacaattcacatttgttctaaaatttttcttgtatcacaaaaataatgaatctaaaatgtaaatgtatccgttcaactctagctaaattttttgggctaggtctgtgcttaggctttattttgaaaattataggcgctattgaacttcaaaattaaaaaaaaattcaaactattccggttaatgattttattcaatattcagtgaattttaattattttattcgaaatccaacaaattttcagaaaaatgtattggccttttaaagcttctgtaaaggtccattttccatattttcgattcggttcaaaatcttgtttanatgcaataatatatgattcgctaaacgctttctaaatattaattaatttttttatctctttagangtgaaaaaaagattattggaaaaaagaaaacgcaagaaggtggcgacgtaatttatatgaangtgaactaagatcgtaagtnaaatttngatgacaaaatggtttaagctttacatttaaaatttttgattatagactccttgaangaattgatttgactgaaaccactgatgaggactcgtccaagaagtccgaggttaaggaattaatcttattccattaattccaagaccctattaacatgaaaaataaccctacggttttaactctgcaaaaatattcaggtcagttaaagcacctttaaaaaattgcgggcaggaaaagggttaagggaaaatggccccggggaaaacgccaaaaaaaaaaaaatggccccggggaaaaattttttaaaaaaaatttttgaaaaaaaaaatttgggtgaaaaaaaaatatttaaaaaaacttttttggggtttccaccccccccccaaataaa

SEQ ID NO: 66311 - DNA, 502 bp, Heterodera glycines
  Genomic contig location: Contig_ID=SeqID_37164; Location=613..1114; Strand=+
  SCN-specific regions: Sequence locations=1-444,471-480
atgccagcagcagacagcccacccacattcaccttttcattcacagagctcgtcccaatggaaagttcgactgcacatcagcgtaaaacacccggagagagcggcagagataacggtggccactctacccgcgggaagcaatttcatgctctttttgcagaagttttttgccgaggtgttttttctaatccgaaatgccaacggatcaatcaaatccatttgatttcaggtgcatatccctgtggaagaggatgaagccaaattggttgctgaactccaagaaaagaattcgaatcgtttgttggccgcaatgaattcactcaatgaggaaacggatggcattggaaacgaagaagaatgtgaggagagtgacgaagagaaagagggaaaatacgaaggaagcgagcgaagagaagcaacggcatcacaatcaccagcagagaatccaaaaggagaggagaaagaacgggtggagggcaatgaagaagagaacgaggaagaa

SEQ ID NO: 66312 - DNA, 420 bp, Heterodera glycines
  Genomic contig location: Contig_ID=SeqID_37165; Location=92..511; Strand=-
  SCN-specific regions: Sequence locations=1-92,114-291,334-420
atgtctttgttaataaaaagtaaaacaaatgcgtcactatttttgtttttgcttgttttgtttgttgtacaaggttagtacctattaaaaacataaaatcctgtttttaattgctttttttcagcatttcgtttcgtcagtgctgatttattatgcagaaattgtgggcattcggtcacaacggcatcggccttaaaaaatgtggtcagcccaaaggcatttgaacattggaacatgactgtgcttggggttgagaccgttgttcaagtgttcaagaatagtgttcgtaagttttatttaaaataaatttaaatgtttaaaaaaaaatttatagccgagaaatttaatctgatcacagtaaatggagccgatctgaaatttgccggcaaatcttacgttgaagacacgtggtatttgtaa

SEQ ID NO: 66313 - DNA, 258 bp, Heterodera glycines
  Genomic contig location: Contig_ID=SeqID_37165; Location=630..887; Strand=+
  SCN-specific regions: Sequence locations=1-7,29-258
atggcactaaatgaatcggaaggaaccgttgtaaatggaaaactaagcgcaaaggaattattcacgcgatgcgtaaatgaaataatcgcccaattaattgttgcacaaaaagagggaagagatgtcaatctgaacaagctaaaatgcgaaattgcatccaaatacggaataaaaacgcagccgaaattagtcgacataattggggcggtgcctcctcagttcaaggcaattatcgaggaattaagagatgccaattaa

SEQ ID NO: 66314 - DNA, 315 bp, Heterodera glycines
  misc_feature (138)..(138): n is a, c, g, or t
  Genomic contig location: Contig_ID=SeqID_37166; Location=1138..1452; Strand=+
  SCN-specific regions: Sequence locations=1-45,67-70,94-315
gcgagtacacgaataaaatcaaaatttttatgtacaatttctccaattttacaaaaggccattttttggaatgaaaatgatcttttttccttcttcttcgtcgtctttaaatatgccgctccttaatcgcagcagggnggtttgaagcagcgtgcatatcaacaaggagatagccatacagtttattagtcgcaatccgataggcagaaagaaataatccagttttcccggaaaaagtgcactccaatgttccgaatcgccagcgcggaattcggagctcgcattaataccaaatattgcgcattctgtctcgca

SEQ ID NO: 66315 - DNA, 105 bp, Heterodera glycines
  Genomic contig location: Contig_ID=SeqID_37168; Location=472..576; Strand=+
  SCN-specific regions: Sequence locations=1-105
tggccgtttgggggactcaaacaattatggggagcaaaaatccaacgcaaaattaaaggacaggctatagggaagctattcccgaaggattcggtctccccataa

SEQ ID NO: 66316 - DNA, 849 bp, Heterodera glycines
  Genomic contig location: Contig_ID=SeqID_37171; Location=59..907; Strand=-
  SCN-specific regions: Sequence locations=1-163,193-238,478-699,721-849
cgtttgtggcggaaggaaaaaatttcgaagcgatcgccgcatcgctcgggggtaaatggtcagcggatgacgttgccaacttttattcgctgaatcagctcgaacttcggcttgattatgtgcgtttttggctttgtttaagggctggcttcaattaaattgatcacattatttgcatttttcatagttttcgtgctttccgagtttcttaaaacttccatcccactcctctcacttgaaaaattcttaaaaatttgaaaaatctttaaagaattaagaaaatactataaaaatgaaaaataaatttttttgaaacttcataaaaaaaattttgaccaataagaatttcatagaaaaaattagaatttgataaagaaaaatttcttttttttaaaaggtttaatttttaaaaatatcgacaaataatttttaatagaaattttttttctctttaaatttttacaaaatttttaaaatcttccctcaatttctttaaatattcaaggattttttcaagtgagtgggcgggtaacagtttttaaaaaaaccctttcattaactttttctatctcataatttgattgaaaataattagttttaatcacttaattaattaattttcagttgatttctctctatgagcgtgccaaggcggacgaacgaaatgtgccggcacttcgtgcgaacactgctcgtaataatggacaacagcagaaaaaagtgcctgctgctaatggcgggaagaagaataataataatggggtgccaccggtggtgaagcagcaaattgttgtgatcagacaagcagagcagcggggagagactgtggcgaaacgagaggacggcggg

SEQ ID NO: 66317 - DNA, 217 bp, Heterodera glycines
  Genomic contig location: Contig_ID=SeqID_7895; Location=237..453; Strand=+
  SCN-specific regions: Sequence locations=1-217
ggtcgcagttaccccccgcctccattcgcccctttggtcgccccccttttacgcccggcaggtgtccgccattcgctcattctttgtcagtcagaaaacggctgaacttttagcggaactgcgtcaaattgaacttcgtcgattcatccaacaaatcgaggctgaggaatcattgaagaccaaacgaaatgaaaggacgtcccatcgtccgtcggtg

SEQ ID NO: 66318 - DNA, 474 bp, Heterodera glycines
  Genomic contig location: Contig_ID=SeqID_37172; Location=276..749; Strand=-
  SCN-specific regions: Sequence locations=1-70,136-169,191-288,336 -429,452-474
atgatcatcagaatctcaaacatgctgtggttttattattttcttttttgttttataacattttatgctgttaatttttcaaaaaaatgatttttttcattatttacaaaatattcttaattttttctattttaaggccattaatatttggagcatttaatttcaaatgatataatgaaaatatttctgttgaattgttcaagaaaccatataactctctgcactttatttttattaattggtattttatttttttctggtcaaatatttgtttctacaaagatacagttattattataaatgtaatgtaattttatttttatatttatatttttgctgaatttgtattatatcataattagcacattctgtttaatgataataagttgaaaaaaattcaagttcctctggttttaggataaaaataaggatgagtgaactttcgttttttacagttattttcataaaaataaa

SEQ ID NO: 66319 - DNA, 509 bp, Heterodera glycines
  Genomic contig location: Contig_ID=SeqID_37173; Location=456..964; Strand=+
  SCN-specific regions: Sequence locations=1-157,179-196,218-313,338 -349,371-395,422-458,480-509
atggccgatgtgttggaggcgttctcgcccccgtgctcgcttggcacctttcttcaggacatgaccatctacgcgggatgtccctctctgcacatgtgtaattaaaacccgataattcgacatgtcgcaaaattattgcttttaaaactcattgcactcaaaaaattgtcaaatttcactgggttttcccactaattttcaaatttccagctttaatggtgtttctgctgcgcaatcagttgctggtccaactgcacaccttcttcttcctgctgccccttccatccaatgacgccaacgacaattgcaaagccaaccagcaacagcagcaacacaaccacagtcaaagggaacgggggaggagggacagcggagcctcaaatgatgatgccaaagaaggcgaggaggggggagaggaggacggtacagaaacagcagcagaacaaccacaacagcaatgggttgggccgccaccgccccccgcggcggagttgggactgtcgccagag

SEQ ID NO: 66320 - DNA, 638 bp, Heterodera glycines
  Genomic contig location: Contig_ID=SeqID_37175; Location=229..866; Strand=+
  SCN-specific regions: Sequence locations=1-100,122-212,234-273,302 -578,600-638
atgcattcggatgtgatcatggaatggaaagtgcgcaaagaatttgtagaagtggtggccaatgcgatgcgaaattacgcggccataagccaagcgatggactcggaagagatttccacgtattttaaagtgagtgctcttaacactcaaagcaattagcaaccgttcgtttatcacccggcaattaaactcaatttgagcatttcttgagaaaattgcacagttttgaataatttttggcattttcgcacaattttagcgtttgttttacacattttttaaatttttaagtatttataaacccgttctgtgtttatttatcacttaatcttttcgcttggtgaattttaagcgcattgaaaattaaaaggaaccttaaaattcaaatcaattaaaaaaacaaatattttttacaattgctttaaattaaaagcagcaaattttgtgtttcagatttggatttttccgtggaagtaaacaattgaacccggaaatttcaaatttgcgttcctatccccctgcgggagtggaactcaacattttttgcgggacgggatcccgcgggattaaccctacaaattcccgctttttccagatggaattgtgtgattttgaaattcgaattttgactttaaata

SEQ ID NO: 66321 - DNA, 56 bp, Heterodera glycines
  Genomic contig location: Contig_ID=SeqID_37176; Location=529..584; Strand=+
  SCN-specific regions: Sequence locations=1-56
gctatagggaagctactcccgaaggattcggtctccccataaatatgggcgcatcg

SEQ ID NO: 66322 - DNA, 526 bp, Heterodera glycines
  Genomic contig location: Contig_ID=SeqID_37180; Location=198..723; Strand=+
  SCN-specific regions: Sequence locations=1-135,158-526
atggtatctacacgtaataaaactggaaaatttatgaagctaagcaattctgggactgaagcaaatcgaaagcgaaaggaatggcgccaggagcgtgctcgaaaaggcggctcgacgccaaaaagtgacgaaaattgaccaaaattaattttatttgaaaacactgcatttttcagcgctaaagcagaccgaagccgaggcaacagcagacggagagggtacatcgacccaagccgcagaaagtggaccatcaacgtcagctttggaccttcgtaagtcaaaaaagtcactattttagaagcaaaaattaaattaaggccctcgttcaagccctaggccattgtcagcaactccgatcaggcgccatgtgggtgtccgtccaaaaactaccgacaaagcaacgaacatggaccttacaactaccgacaatgcaacaaacacggatttgacaacgatggacaaagcaacggacgtgaatttggctgatgatgacgccgcgacacttaccgagcaattggacagacag

SEQ ID NO: 66323 - DNA, 58 bp, Heterodera glycines; identical to SEQ ID NO: 51962
  Genomic contig location: Contig_ID=SeqID_7900; Location=176..233; Strand=-
  SCN-specific regions: Sequence locations=1-58

SEQ ID NO: 66324 - DNA, 628 bp, Heterodera glycines
  Genomic contig location: Contig_ID=SeqID_37182; Location=15..642; Strand=-
  SCN-specific regions: Sequence locations=1-430,452-521,543-628
acatctctgcccttgccggcgttgttccataccccgttacggatgattcttccctgctgctgttggacccggcattggccaccgcctgtccgctgatcaacattatcgattcgccaaaattgttggagggaactgacaatgaaaagaccgaaaatttagaggttagtatcaagaagtactgtcaatttgcacccaattttgggtttccctctccgcttaatcttccattttcgaccatcaaatcaaacaaatattttgtttaggccgaactcattgcgatggaggaaagcttaaaggaattggacaacaatcagctcaaaatggaaacgatgggagaagagaaaaagacggaaaaggcaccggtggaggagggaaaaaacagcccatgaattgatgatatatgttgaaatattttcttgtttatttggagattttaaatttatatcttttatttatcaatgttccgtaaatagatacggaaacagcacaaattggttgggttggcatgaaaacgatggatgaaattgaacattttgaaaaggttgttttataggcaattgtgtagaattgtttagcattgattttgtaggggactttttatcaggtacttgattttttccaaaataaa

SEQ ID NO: 66325 - DNA, 675 bp, Heterodera glycines
  Genomic contig location: Contig_ID=SeqID_37184; Location=99..773; Strand=+
  SCN-specific regions: Sequence locations=1-396,458-641,663-675
atgaattttgtaaatgatagggtggaaggcgacctctacagaaccaataacagtgttgaagcttggcacagaaatctgaacgcgttattccgttcaccatcgccacgtctaagcatttttcttcggaaagttcggcaagaagaaagccattggcgtcagcaagttaaagactttgcaaacaacccagcaaatggaatacgtggcaagggaatgaaacgcaagcaaacttatgtggaccaagacatgaatcttaatgagttatacgtcacgcgaaacaatcgccatcctctgcaatattagcgcaatttcccaccgaatggcagaacctctttaggacaaaaatcaatgatttttcatgtttatagtttttaaaacgtaactaagaacctctttaggaataataattgatttatttttcatttttaaaattaaaaataatttttaaaaatttaattttggtgtcgtattttccgggtgtcgcattttctgtttttttataaaaaaatttacggtgtcgcattttccgccggtgtcggattttccggtgtcgcattttcagggagccattcgtgtgggggtagagcgaacgaacgtcgtaatatttcatccaccacccctccggcaccttttatttattgcatttattttgtttacttaaaaaatttattctaccta

SEQ ID NO: 66326 - DNA, 166 bp, Heterodera glycines
  Genomic contig location: Contig_ID=SeqID_37186; Location=7..172; Strand=+
  SCN-specific regions: Sequence locations=1-166
  Gene Ontology: Mol. function=lysine-tRNA ligase activity; Cellular component=cytoplasm; Biological process=tRNA modification
atgcattacatccccggcggcgcagcggccaagccgttcaccacccaccacaacgcgctggacctggacctgtacctgcgcgtggcgcccgagctgtacctcaagcgcctgaccgtcggtggcctggagcgcgtgtacgagatcaaccgcaacttccgcaacgaag

SEQ ID NO: 66327 - DNA, 81 bp, Heterodera glycines
  Genomic contig location: Contig_ID=SeqID_37191; Location=110..190; Strand=+
  SCN-specific regions: Sequence locations=1-81
attgacctgcgcttcaagaaaacgcgtgccatgcgcagagagttgaacaagcatgagctttcattgaagacacacaaacag

SEQ ID NO: 66328 - DNA, 421 bp, Heterodera glycines
  Genomic contig location: Contig_ID=SeqID_37193; Location=1..421; Strand=-
  SCN-specific regions: Sequence locations=1-211,234-421
cccgttatcgcactggaatggcctgacactcctggctgtagatggcacgttgtggagaacgcccgatacgcccgaaaatgacgcagccttcggacgcaccgccaatgagcacgcgcgttccgactggccgcagcttcgcatggtctgccagatggaggtcaccagtcacttgctgacaggcgtgagcttcggcagcgtctcggaaaccagtgaggttgaccttgctgcacagttggctgaacagacaccggagcactcgttgacgatactggataaaggtttttatgcgctgggactcctccatcactggagcgcctcaggagcggagaaacactggatactcccactgcgcaaagacgcacagtatcgggtacgggtaaaggggggtgcggggcaggagctcgttgagttgaagttaagc

SEQ ID NO: 66329 - DNA, 1030 bp, Heterodera glycines
  Genomic contig location: Contig_ID=SeqID_7903; Location=53..1082; Strand=+
  SCN-specific regions: Sequence locations=1-201,232-535,557-687,711 -871,893-1030
gcaacgtcaaactcataaattcgaacaaatgcgtaaataccgataatttgtttgccgagaaaaggaaccccggcaccggcggtttgaaatgttatgacgagatcaagcaccaatcttatgactgctcctgtcacggtgataagaaatgccttgctgaagaaaaatgggctcacgacgcctttctttgtccaataataaaggtaattaattaatttattattattaattaatgccaaaagacaccgccacagacaaatttcatataatataggcaatttaatttttaagtagagtgaagcgtgaccgggacctggtaacggacaactgaataccaaggttccggttttgacatggacctggactagtcccggttttcccagccaaaaattaacggtttttcaactcgaaaaggtcccggtctggtcttacccaaattcccggttccgcttaactctattttttttttgtatcgaaaaaccggaaataataaaaaaatagggacgataaactggaataaggataaatatggcaaatgataaaaactctattttattaattaatttgaaaattcaggtcaattcaattcaaatcaaaggaagccgacaacgagtgtttactaacccaaaagattttcgatacaattggactcggattgaggttgattgttatgtgagttaggtttttctaatttcaaaaatttgtttaattgattaattttacagaaggccgatgcgggcaccgtaagcttttggggctacagtaacccggagacaaaggaaatcattcgggtggacgaagtacactgtttgacttatgaaactgctagagtgccaaaacggttcaaaagtttgcaagtcgaagaacagccgccgatgaaaaaactgagtccaagtccattcttggccaataatgcttcatcacttatccatgtgttcgtgccatttgttggccatccatgagagaagggcgaaatcagtgatcagtggatctgtctgctgagtgatggtgatcagttggccaaattccatca

SEQ ID NO: 66330 - DNA, 346 bp, Heterodera glycines
  Genomic contig location: Contig_ID=SeqID_7904; Location=3428..3773; Strand=+
  SCN-specific regions: Sequence locations=1-117,139-257,306-346
atgaaaaaaatatacttatatgcaaatttgacgaaaagtagccaaaatattagagatcggtattttgaaaaaagcctggacctggacctggattccatgttggacctggatttcctggacaaaaatccaggaaaatccaggtctaggaaaaatccaggctcctcgagacctggatccaggcctggacctggattttttgaaatttttttaaaaagcaaacaaatgcctgaaaaaatcaattatttgctagaagcatctaaaaatatctaaataataataataatgtgtttttaaatttatttaatctgtttttgaaaacttgaaaaaacatcggtcacttgaaaaa

SEQ ID NO: 66331 - DNA, 763 bp, Heterodera glycines
  Genomic contig location: Contig_ID=SeqID_7904; Location=4061..4823; Strand=+
  SCN-specific regions: Sequence locations=39-40,62-138,161-243,295 -307,358-400,438-464,540-605,663-707
atgattattttttcaatgtttttgaaaaataaattatgccaaattttaattggtaaaatatacaaatccatgtgtttggcattagttttgtaattttgttaagaaataaatttattcttttttttctattcatttgaagtttcatgttccgtgggttgaatgattttatttggttgataagctgttttttaacaacttactatattttataattaaagttattaaatgattggacacattaacaaataattattttgaaatgatttcttaattaattatataatttgaaataaactgtcacctgaaaagcttttttactcattttaattttaaaaatttgcttattttccatattttgtagataatacattcctgaaatcaaaaaaacttcaagtttcggaatttataaatacaaaaaaaaagaaatatttaataaacttttcctggaagctgaaattttctagaaaaaattttaacaatattttttggttttttatttagtaatatatttttccagatttaaaattaattatttttatggcataattcttgcgaatttgacccatctacgatctgaattgttggcaatggatttgtacaatatcaataaatattagatattcaaatgtatttatttaaaatttttattcaatattttaattgtagacttattatttttctgatttacaagttcaattattcttttgataaaatttttttagaaaattaattgatttgttattccttaaaataattaattaaa

SEQ ID NO: 66332 - DNA, 367 bp, Heterodera glycines
  Genomic contig location: Contig_ID=SeqID_37202; Location=772..1138; Strand=-
  SCN-specific regions: Sequence locations=1-367
aagaagtgattgaagttgaagatgcaaaggttgagcagtataagaataagtcattaagtggtgccaaattgagagattttgtgggcttttgggtgctcggcttggacatgatcccatgggatgcgcaacggatgagacttttcgtcatccggcactgcaactgctcattggaagcatgggtaagaaaaaatgccaaaatcaaaaattgaaatgccaaaatcactttttttaaataaagtttttgcgaccatccgattcggagccaactgatcccaaagaggcatcgatgggcacgggacgctttgaggatcggtacggtatttaaattttttgattctcaggccaaatccaattgtgccaaaataaa

SEQ ID NO: 66333 - DNA, 847 bp, Heterodera glycines
  Genomic contig location: Contig_ID=SeqID_37206; Location=146..992; Strand=-
  SCN-specific regions: Sequence locations=1-201,237-257,290-291,337 -338,362-377,408-556,616-847
  Gene Ontology: Mol. function=formaldehyde dehydrogenase (glutathione) activity; Cellular component=cytoplasm; Biological process=alcohol metabolism
tgattgctggtcacgaggcaactgacattgttgagtcggttggcccaggagtgcatggcgttttgccccggcgtccatgtgatcccggcaccgatcccgcaatgccgtagctgtgaacattgctacgcgccggagtcaaatttgtgcaaactttttcaatttggaccagagtaataattatttattatcattaattagcggattattaataatgattatttattttgattaattaacgggttaaattttttcgcatttttaaattgttaaaatttggttttccaataaagcataaataaatattattttatttatatcttttattatatttaaaaacaaaattcttatcacaaacatattaaggaaaaaaggatcggaatttatttttttaaaaaaattaaaaaatagttttccaccagttgtaaaatctcggcacaaacaatgctagatgggaccacacgctttaaatgccgaggccaagatgtgtatcatttcattggaacaagcacattcagcgagtacactgtggtgttggagagttgcatttgcaaggcacttttttaaaataaatattttttattaaaattaaattatttaatcaaaaaacataaaaatgcttttcagatcaatccaaaagcgccattggatattgtggtggcgttgggctgtggcttcaccactgggtacggtaatccgttcaacgtggcaccggtagtgccgggcagtacggtgggcatttggggcattggcgcaattggacttggcgtgatgttgggatgcaaagaacggggagcaaagaatatcattgcggtggatccggaaccgaaaaagctgcaaataggtgaaa

SEQ ID NO: 66334 - DNA, 292 bp, Heterodera glycines
  Genomic contig location: Contig_ID=SeqID_37208; Location=5..296; Strand=+
  SCN-specific regions: Sequence locations=1-292
atgggtgttgaaaagtttattttgaaaaaaactctttacaaaataatacccttgggagaagtgagtggaaaacatgatttcaaaattttcaatgttttctagtctaatctactcaaaacgtttcagaattcaataaaaataacattcacggtgcgaaaaatggggtttgacaagtttattgggggaaaaaagactttacaaaataatacccctgggagaagggagtgggaaacatgatttcaaaattttcaattttttatagtctaatctactcaaaacggttcagaattca

SEQ ID NO: 66335 - DNA, 64 bp, Heterodera glycines
  Genomic contig location: Contig_ID=SeqID_37210; Location=306..369; Strand=-
  SCN-specific regions: Sequence locations=1-23,45-64
atgcctggacctggacctggattccatgttggacctggacctggatttcctggacaaaaatcca

SEQ ID NO: 66336 - DNA, 330 bp, Heterodera glycines
  Genomic contig location: Contig_ID=SeqID_7907; Location=90..419; Strand=-
  SCN-specific regions: Sequence locations=1-62,84-174,206-330
atggaatttgtacttgaatggcaagtacgtacatacttgaaaattggctctcatgtgaaaaaatttgaaaatttgcttttttcagaatcttgaaaatgagcattcaaaaaaaaacttcaaaaagactgatcatttgatcaacatgcagaaatgatcattgatcaattctgaagcatttaattttattaatttaaacattaatattcgtcaaaaaattttaaagaaattacaatttcaaactccgatttgatttgatatgcccacagcaaaactccaaaaaatcgactaaaaaactcatagaaaatcaccaaaagatcgcaaaaaattaaa

SEQ ID NO: 66337 - DNA, 556 bp, Heterodera glycines
  Genomic contig location: Contig_ID=SeqID_7907; Location=599..1154; Strand=+
  SCN-specific regions: Sequence locations=1-79,104-272,304-318,341 -432,454-473,510-556
atgtccattctcccagcagcagtattcttattttccaagcaccaccatcacatcacacacagccgcagcatcgttctgcttcatcattcattcattcatcggttatcgtccgtcacgcgacgcatcatgaggaagttcgcctacttcaaactgtgccaggccgtgctcacttccgtttttctgtggcaaattctctcaacccaccaattctgtggcgaatttgacgagcctacggtgtgctttttcggcattttttgatttctcaacccatctaattaaaatttcccatttttcccaggccttcttcaattccgctgtctcctcctcctctgctggcggccattgcgaccatcagttcacgctcatcggaatggactccaccactggcgaatacggtgccgtgccggacaagcagaagtggcacatgcaactgatggcgagcagcggcggcggacaaggccaaccaattgatgaacaacaacagcaacagaagaatcagatggaggaattttcgtcaaaattgccgactgttggacgtcactgcattccgattgcg

SEQ ID NO: 66338 - DNA, 716 bp, Heterodera glycines
  Genomic contig location: Contig_ID=SeqID_37214; Location=214..929; Strand=+
  SCN-specific regions: Sequence locations=1-28,50-121,144-716
atgcgaatgcgaacggcattagtgaacgaagaagaaaagttgaagctgctgcccctcgaaagccaaacaaatcgcatcgacggagtttggaatttgagcagcgatcaggtggagggaagtgaagcggaaaagagaagaaagaatgaatgatcacaagcacttaagggaaatttgggagtgatggtaattacgaacattcgggtcgtatggtatgccgcactgaacctgcaggtaaacgggaaacaaagcgatggaacaaaaaccgggagaaataaatcgagaaaaatgattggaaacatggcatttggactgagttaatatgaaaggtgagtggtgcctctttcagtacaacgtgtccattccgttcctgcagctgcgaagttgccgcattcgcgactcgcgctttggccatgcgttggttttggagacgtcgctgagggtaatttggagagattgacaagcaaaaggaaaagcatttgaagagcggcgagtacattcttggctttcaaatcaaaccagaagagcgcctggaattcacttgcaaagccgtccaagcccttctcagtgcttttcaatcgtcgcccattttcggagttcagtacagtcgccaggaagcggccttttcacaacagcaggaacagcgacaagcgatggtgccgaacatcacggaggagaaggagccggaggaaaaggcattgcgagtggacgcatttgcg

SEQ ID NO: 66339 - DNA, 50 bp, Heterodera glycines
  Genomic contig location: Contig_ID=SeqID_37215; Location=25..74; Strand=+
  SCN-specific regions: Sequence locations=1-50
atttaaagccatccattgcctgctcggttctcggcacagcaaagcactaa

SEQ ID NO: 66340 - DNA, 254 bp, Heterodera glycines
  Genomic contig location: Contig_ID=SeqID_37216; Location=178..431; Strand=+
  SCN-specific regions: Sequence locations=1-139,191-254
atgagggaaaatgtccatcaaaatgtcgttgcaaatccatctgaaatgtggggaataattatagtgacaaatatatacaagaggtgggtacaccccaaaacgtcgccgccgaaacgtcgccgggacataacgtcgccgcaaaaaaaattaaaaatttttcaaaattttaagaaaatttaaaattattttagcttttctaaaaatctaagtgttaataaaaactaaatttgttgatttctaagaaaaaaatcgaa

SEQ ID NO: 66341 - DNA, 134 bp, Heterodera glycines
  Genomic contig location: Contig_ID=SeqID_37217; Location=86..219; Strand=+
  SCN-specific regions: Sequence locations=1-134
aaacgtctctattttgtgtcgagaccggacagttggacagtagacacctggacagtgggggcgtttggacagtaaagcatatttggacagaagtggacaattttgtgcagtgcacactacgtaagtaaatgcaa

SEQ ID NO: 66342 - DNA, 135 bp, Heterodera glycines
  Genomic contig location: Contig_ID=SeqID_37220; Location=1082..1216; Strand=-
  SCN-specific regions: Sequence locations=1-135
tatgaatcgaattctaagcaaaaatttattcaatcggttctttgtcggttatgaaaatctcccgtcttgtcggcactacccaactctccgttcctctgctaatgcgccaaaaccagatgatttgtatgaaccgag

SEQ ID NO: 66343 - DNA, 831 bp, Heterodera glycines
  Genomic contig location: Contig_ID=SeqID_37221; Location=37..867; Strand=+
  SCN-specific regions: Sequence locations=1-284,306-831
atgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtaccctttcaaagggccagggcattgttatgtcgagtgcaaacaagagtccggcaataaaatcggaattgatgagccggctcaatatgccaagatgaacttccgtggtgcaacggaagcatatgccattgtccattcactgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaagggcatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctcttt

SEQ ID NO: 66344 - DNA, 4248 bp, Heterodera glycines
  Genomic contig location: Contig_ID=SeqID_1024; Location=627..4874; Strand=-
  SCN-specific regions: Sequence locations=1-49,71-173,195-866,888 -900,922-1703,1725-2777,2799-3323,3345-4248
atgaacgccgaacaaattcaacaacttttgaccgctttgctccaaggaaatgccgcttcaagcataagccaagcgaatttggccagctcaatcgacagtagaatttcaaagtttgtttatgaccccgagaatggtcaaacatttgaacagtggcacaaacgcttcggcatattgattgaagaggatggcaaagacttaaccgagcaagccaaagtccgactattgttgggaaagctcggagacgaagagtacacgaagtacagggacacaatcagcccggagttgcccgacaaagcttcgtgggctgaatcaatcaacagattaaaagagttgttcgctgaaacgcgctctcttttcgtccgccgatatgaatgctttcgaatcagacagcatccaaaccaagacatcagttctttggttgctcaaatcaacgcagcgtgtgagcatgccaatttgagccttaccaaggaacagctcaaatgcatgattttggtgatttcactgagggatgaacatcacgatttgaggcagaaatgtcttaaaatgatggaagaagccgagaaaagtggcaccacagtcacactcaaaaagttggaagaggagttaaaagcaatccaaattgttaaagatagcgctttgtcactcctttccacgccagcttcgacaaatgccatccgaactcgccctcaacagtggagagaatcaaaaaccaaggccaaatcagcaaatgccgtgcaacaaaaccacccggcacagcaaaaaccggccacaggaggaaaagcaattcgtggacaaccgacccagccgtgcggctcatgtggtggtactgatcactggagatcagattgtcgcttccgagaagcgacatgccacacctgccaaaaacaaggccacattgctaatgtttgccgaaagggagcattcacgacaaagaaccaacgccgttcatttcacacggtccaagtcaaagcaacatgcctacaaattggcacgactcaaggacggtggtggaaaattttggtcgaaattaacggcacaaaaatcgaaatgaatgtcgacacaggagctcaggcgacagtccttaccattgaaacatggaccaaattaggacaacctaaattgttgccaaccgacattgagactcgtaactgcaacgacgtcacatttaacacaattggcaaatttatatgtcttgtcagcattaagggacaaccagccaaaaagctaacagcttatgtgactgaagagctcaattacgatttgtttggtttgccatggattgaggcaacggaactgattcccaaagaaatcatgtttccggagacgcacacatcggttggaatccgcgcatcatctgccgcacctttccaagaaatcgccgatgttaagtcactcacgacggctcttaaagaaaattttccggatgtttttggtaaagagctaggacagtgcaccaagattaaggcacacttgattcttaaatccgacgctcgaccggttttctgtaaagcccgacccgttcctcatggctcactggaagcagtcaacacggagctggaccgcctcttacagatcggtgccattaatccgatagaatttagccattgggcagcacccattttggccgtcaaaaagaaaaatggcaaaatcagagtgtgcattgatttctcaactggcttaaacaatgcacttgaactcaaccgccacccactccctcggcctgatgacatttatgcagccataagcggcgctgcatttttcacaaatttggacttaaaagacgcatacctacaaatggaattggatgacgaatccaaacagctctgcgttttgaacacgcatcgtggcctttttcagtgccaacgtcttccatttggcgtcaaatcagcaccggcaatttttcaacatttgatggatcaaatatgtgctggaatccccggagcatttgcttatttggatgatggactaatcgcgtccaaaaccctcgaagagcacctttcagccatccatcaattgttcacacgattcaaagcatacggattgtgcattcaacttgaaaaatgcaaattcttgcagaaagaattgctttttcttgggcacattgtgtcggctaatggaattagacctgatccaggccgctcagatgcaatccgaaaattgccagtgccacatgacaaatcgactcttcgctcatttctcggagcccttacttactacagtcggttcatcaaaaagatgcgcgaacttagggcgccattggaccaacttcttcggaaagacgaactttggaattggggtgaagaccagcagaaagcttttgaaaaagcaaaagagatcatgttgtctgatctgcttttaacccacttcgacccctcgcttccaataatcgtcgcagctgatgcttcaaaagatggaattggagcgaccataagtcacattttcccagacaaaacggagaaggtcattgagcacgcgtcaagtgttctttcagaagcacagcggaactacagccaagtcgaaaaagaagctttggctcttattttcgccgtccaaaaatttcacagaatgatttttggaagaaaattcacacttctgaccgaccataaaccgctgatttccatatttgggtccaagaaaggaatcccaatttacgccgcctgtcgactccaaagatgggcgcttatcttgtcaaattacgaatttgacattcgctacatcaataccactgcgtttggtcaagtcgacatgctttcacgacttatcgcgaattatccgcgacctgaagaagatattttgatagcgaaaatttgcaccgaaacagaatgtttcatcggcacaattttgcaggcacgaattaatcatcttcccgtcactgccaccgaaatagcagaaatgactgaaaaagatgaaattctccaaaaagtggccaaattctccaaggaaggatggtcacaaaagtgtaatgaccccgacctcgcaccgttctttccaaaacggaacgaaattttgcaaattgagaattgcctgctttatcaaaaccgggtgatcattccaacaattttgcgagataggacgttgaaagcacttcacatggcacacccaggaattgtgcgcatgaaggctctcgctcgccaacacgtttactggcccggaatggactcagccattgagaaattggtaaaaagctgcgaagaatgccaaatcgcccaaaaagctgctccaaaagcaccactttctccttggaatgccaccaaacggccattcgaacgtgtgcatattgattttgccggcccatgccaagacggtcatgtttatctacttttagtggattctttttcaaaatggcccgaagtttatcagatgaacaccatgacagcgaaagcaacgatcagtgttctcagattaatcatcaatcggcttggaatcccagaagaaattgtctcggacaacggacgacaatttcgatcgtcagaattttccgaattttgtaaagaatttgggattcgacatatgttcacgccgctatttcatccacagtcaaatggccaagtcgaacgctttgtcgacacttttaaaagggcaatgcagaagtgttcgaaaaaggacaaaaattgggctgagaaaatgctcctgtcctatagaacaacaccgaattctgcaattaatggacattcaccggaccaattattctttggtagaaaactccgcactcaattgtctcttacacatccgacaggaaaagtcaatgagacaattgacaagacaatttttcatcagaaacaggaaaaataccgcacgaaaatggcacaaaattttaatgaaaagcatggagttaagtcaaatgagtttcttccgactgacccagtgcttgttttgaattaccagcatggtaagacacattggctccaaggtacagtcatcgaacgactcaacaattcgccaacttatcgggtaaatgtgccaagactcggacgaaacattcatcgacatgccaaccaaatgcgccgtcgatatgtcttcgaagaaagtttaggatttgttggtcccgcccaggtggcaaatgacccaaatcatcattcaccggcacatcaaaaccatccaacaccggcacgccaaaacacgacaccgaaatgccaaaagcggaagcagcccgacgaaatccacccaactactgccaattcaccacccatggcattgagacgctctagtcgcaacaccaaaccgccgatccgcttctcgccaggctga

SEQ ID NO: 66345 - DNA, 4246 bp, Heterodera glycines
  Genomic contig location: Contig_ID=SeqID_7909; Location=127..4372; Strand=+
  SCN-specific regions: Sequence locations=1-1080,1111-1199,1221 -2000,2024-2325,2348-2572,2639-2761,2783-3455,3478-3544,3566 -3637,3661-3760,3784-3862,3884-3939,3971-3978,4028-4216
  Gene Ontology: Mol. function=structural molecule activity; Cellular component=intercellular junction; Biological process=cell adhesion
aagccattaaatacgtaaaattaccgtaatccccgtaatcctaatcgaataccaatatgattaaatgaatcaattaaaacctaccgtaatggctaaaaaacataaaaattcaaaaattcccccttctccttgtagaaattccgcccatggtcaaccaggccaagcaggtggcgatgagcccgcgtgaccagggcaacagcgtgcgctggcgcgacgccaacgaccgcctgctggactcggtgcgctcggtgggcgacgcgatcaccggcatgccgtccgcgcgcggcacacctcagccgccgccggcgcagacgcgttaccaaccaactgtaacgcccgtgccggtggagcagtacaaccacgcggcgtccgcgtatcggccgccaccgtcgcaacaggcggcgtcgccgttcgactccagctacaatgtgcaacagcagcgccaacggtcgccccagttgccgcccagcacccactcggcgagtttctcatcccatggagaggggatcgattagaatacaatcgctagcattgggttacggtagtaatatagtgtagcattagagagttcgactttctggacggtagtgatgctcgtggacacctatatgcactcggtatcgggtagataaatttgtgttcttcgactctcatcagtggattaattctctaatgagagtgctacagtaacgaggagttgtggaatacggtagtaccgtagcataacgaaatggttacggtaccgaccccctttttttgtccgcgggtggtaatcaacaatttgttgatcaacctcatttttttgattaatttgtgatctcgactctcatcattggattaattctctgatgagagtgctacagtaacgaggggttatggattacggtattacgtagcataaagaaatagttacggtagcgacccccttttttgcaccactaattttggatcattaattatcaaaaattcaggtaatggagcagccgatgcgcgccccgggcgagccgctggtgcacaatcggctgattgtgcgcgaggaaatgccggccccgcgccgtccgacgccgcccgtcgaaatttcgcccgccccgcgaccgccgccgccgcccgagctggacgaggaggaggagacgcgcgccttctgggagcgctaccagttgcccaacgcccaataccagcccatcctgagcgcggcacacaacctccaccaggtgggcgggcggggcactaattgtgagacgcgcgggatggggcggaattcggcactcgagcatagtgccactggatgtcgatcggatggcatcccataattgccatgtgccacccatcccatgtcgggaatggtcgcattcgagaatagccatgtgccactcccaatgtttggaaatgcgacactcgagaattgccacataatctctgggatggcatattgtcactcgaggattgccaaaccattttgaccgggtgcttgatctcattcgaaagtcttgtttggtgcctgttagggtggggccgccgtcattcgagagttcggcactctataaaagccatctgccgcccggtctcgagaatggcactcgataattgtcatataatctgggaatgacacaaaattgtcattcaagaatttccaaataatttttttggctaaagtagctataccaatcgattcgtctcgagaagataagcacgaaaaaataggtctcacgcggaaataggtttaactcgatttttgaaccggtttaaaacccgaaaattgagaaaattaatgccatcattggccacaggaattgcgccagtggagctccaacgagaatgacattgtggcagctgccaaacgcatggccattctgatggcacgactgtcccagctggtccggggcgagggcggcaacaaaaaggatctgatcgactgtgccaaggtgggatcagacaagtggacaaaaacttttaaatttggaggacaaatggtcgacaaaaatgccgcgacaaatggacaaaataaatataaaactgtccttttttgtaggggtgggggggggggtgggggaatttcgtaattttttaagggttcgggttttaggactctgatttctgaaaaaaggactcggattttcaatttcagatttagaaaattttgatcgaaattggcaaaaaattgcctattttggacaaaggactaatctttttatggacaaatggtcgacaaatatgtataaatgtgcgacttttcacaggcaattgccgactccagtgaggaggtgacccggttggcggtccaattggcgcgcctgtgcacggacatcaaaatgaggatggtcagcgaattaataaatataaattattagggcttccttttttaggcaaatgcctaaaatttttgtgcacttaatacgcacagataagcacgaaaaacgcgttttccgcttggtttggggtgtctacgatgacttttataatgcatatttttgcctatttaggcgtttttgaagtgcctaattttaggattttcgaaaaaatccttaacaaaaatgcaataaaaacgaaaaacacacccctaagaattgaaaagttaaaaaaaaattaatccaaaaatttaatatatattttttcttaataaatatttttgatttaaatagttctttatttggaaaaaactttaaactatttaacaatttcatttacaactatttcgcaattttttgtccctaaaaaaggaagccctattaatcacgaatatgacacgtcattgatatctacggcttatttttactttaatttatgcgattcaaaaaaatacatttgtacgtgtcatttttaaacatgagttaaagaacaagtcggcagaataaacaatacaacgaccactaataaaattatcgtttatagcccaatttcttctttagaaattttcctcgggttttggggaagaagtgcgcggttccatcttaataataaaagaatattacatgaaagatgtgactgtaaactagcaaaagcgaactgaccatctgtgcaagagggtaaatggcggacaattgactgcacgaaaaggatcgtttacgagtggcgcgcttcatttcgccatctttgcgggaaggcgtcggctgctttcctccgattggattcagtgcgcgaggagcagtacgaccacacgaatttgtggttacgaatacattgcgtcgagaagcggacgaagtcgcgggacgattcggcgttgacggtttcaaaggagtcgaaaactgctgtaattagaggttcaaaaacaatcaatggatgtatggtaacgaagaaccttctgagccttttgcacttctcggtcttggtgataactttgcatcacagattcggcgtatttgtcagctcgcaatccctcgacaataatgtcgtttaattggaaatttttgacgtagtcgttgcataactcacaaagctcgttcagcaatttcgggactttttgttccacgatttttctttgctaaaagtttcatttgctcaaaattatgaatccgattaacaaaagggacatactctcccattagcagaggaaaaacaatttttggttgttttcaaaccgccgaactccatctccgtttcttttatccctatttccccattctacacaaaaaggaccttcagttttgtgttcagactcccagccctgttcttgtagaaagacgcacgacacacacgccgttcggtgtccaatttctgcttccaactggccatccattcgttcagtttgtcaaatacgggcttcgctcgctcgtacatttgctgacggattcgaacttcctcctccaaatttagcagttccttctcgctcagattttctgaaagattacatataagattaatcacgcaaataagcgttttgaaatttacaaggatttcaatgacttttactttgacaattgtcacttactcaaatttggctttgctggaaactccgtagaaggttggaaacattttgcggataactcgtctaatttaacgagcagctcgtcatagcggaagacgacctgttcagcccacaagtcgtgatggtctttcagctaaatttgtaggggcataagcaaacagagatcgttaagcccttcgttcgatcgcccttctttgaactcactctttcattgaatttttccatcttcttcagaaagtcagacgataacacggtggattggttgtacaagtcaacacgcaaaaaatggaggtcgtcttcattgaaactattgatggacgggcg

SEQ ID NO: 66346 - DNA, 618 bp, Heterodera glycines
  Genomic contig location: Contig_ID=SeqID_7909; Location=5648..6265; Strand=+
  SCN-specific regions: Sequence locations=1-23,45-618
  Gene Ontology: Mol. function=ATP dependent RNA helicase activity; Cellular component=nucleolus; Biological process=nucleobase, nucleoside, nucleotide and nucleic acid metabolism
atggacaccgaacacgcagaagttgattttgaagatgaaggcgattacgagcaattaaatgccaatcagaatagaaaacagaaaaaggccggaggatggcaatctatgggtaaaatttcacttttgcctattttggcattggccaatgaccccgcaaattttaaggtctcgaccattccgtcttcaagggcatccttcgcaagggttatcgacagccaacgcccattcagcgcaaagccatccctttgatgtgcgacgggcgtgacctcgtggcgatgtcgcgcaccggctcaggcaaaacggctgcgtttgttgtgccattgctgcaacgactgaaacaacgcgatgcacgcggcattcgtgcgcttctcttttcgcccacgcgcgaattggctctgcaaacattcaaaattgtcaaggaggtgaaaattcaatttaaaagggatctcgcttttctttgtttagccctctattatcgctaattaaccatatgtgattttatattgcagctcggccgtttcactggtctttactgtgcctgtcttatcggtggcgacagtatggacgaacagttcaatgcccttcaccaacacccggacatgtgagcaccacaattaa

SEQ ID NO: 66347 - DNA, 1026 bp, Heterodera glycines
  Genomic contig location: Contig_ID=SeqID_37222; Location=8..1033; Strand=+
  SCN-specific regions: Sequence locations=1-1026
atgaaaccttggctgagctacgtaaagcggttttacgacaaggataattgggttctctcttggaaaagccgacgtattctggacgaacttcatgacttgaagaacgaaggacgttggttcttataccacgcaacaaatggcgctcaactcactatctcaagaacgttcgatggaacacgaccatttgccgaatttcgatatgtggaagaaggacacctcgtggatctgactccaaaccaagtcatcttccgccaaacggttccagatgagcccgaagagagtccagtgagcaataataaaaagttggaagagaaggcagaaaaaccggcacgcaacgacaaacgaacaactctggccactcggaaggtggaggagtattgcacggcagagatgaagcagaacagctactgctatgacatatttaaaccgtgcgacgcaacgcacgaaacgtgtgccaagtcggcaacgtacagcgctcttgccgaaaacagacacaagctcgaagagttcaacaactgccatgccagctgcctctttgaggccctcatcttcagctggctgtcaaggaacacaaatctgcccggcaacgaagtatcaagaatgcatgaagaactgatcaagcccaccacggaattggaagaagtggctaaacttttccacgacgaacaaatcgtgaaaaacaaacgcggactcgggaaggatcaacaagtgatgaaagtcatcgaaatctggagaaattcatgcgatcgcttcggagagcttttcaccaagccagcgatgcagcagatcaaattccggccaatcctgattgaacacaatggccagtataaccaatggatcaaccgccaaaacacgcgaatggcggaattattttccaaaatgcgaacgaaggctcagcatccgacctacttgagctacaactgcacaacggtgatcgtcggcgataacgtagcggaactttttccaccccactatttgatgatgccaaatggttcacgcatttcccagcggacacatgccgattga

SEQ ID NO: 66348 - DNA, 155 bp, Heterodera glycines
  Genomic contig location: Contig_ID=SeqID_37224; Location=291..445; Strand=-
  SCN-specific regions: Sequence locations=1-155
atgcagacattgcacgatgcgtcgctggtgaagtccctcctcaaaaacgcgcaaatatcgtgccgtcgatgcgagaattctcgactcttacagggttacaataccatcaacaacatcaaccctgcttaccaaaatgatcaaaattaccatacaat

SEQ ID NO: 66349 - DNA, 745 bp, Heterodera glycines
  Genomic contig location: Contig_ID=SeqID_37225; Location=293..1037; Strand=+
  SCN-specific regions: Sequence locations=1-367,389-426,448-533,555 -671,699-745
atgccgaaaatgaggtgcctgggcgttctgagtcgcgccctgggagttcaaccggccgccgttctttcatggccaatcatcaccgccgtaatgatgctgggtgcaaccgccacgaccggattccgatccgcgatcgagtttcggcgtctaggcgacgcccggaattcggaaattcgcgttcgaatatcgccgttagcactcaccgccaccgatacctgacgggtcagccgaatcgcagctttatgtgacttttaagcgtcggggcgccgctttctttgaggggcgggatgtgataattaatgttttattattaaattttgacttgattctggcattctgtttatttttgtctttccccaaattttgtttcccatcttcaaaaattttatgaattttggaatctcgctcttctgataatttttaattgtaattgtgcttttatttaaattggtcgtctcataaattgttggatttgatcaaaagtgtgaattggacgtgtttcccaaatttgaagcggttttgaatccaagcaatttcccaaaattgcctttccctccaattacacaccgcaaatttattttgacatggcgctttctgaagctggtgagtgctagcggtttctttggttttacttcgggtaaaagcaagttttgcgtgcaattgggctgcttatatttgggtttggaaaaattttaaaacaggtacagttcaatatctaggcgatattgttctgatttggtggcaa

SEQ ID NO: 66350 - DNA, 69 bp, Heterodera glycines
  Genomic contig location: Contig_ID=SeqID_7910; Location=778..846; Strand=+
  SCN-specific regions: Sequence locations=1-69
atgcgaataatgcgaaaggcgaaatgcgaaaagcgaaacctcggcccatccctgatttgcagttgtaat

SEQ ID NO: 66351 - DNA, 726 bp, Heterodera glycines
  Genomic contig location: Contig_ID=SeqID_7911; Location=3171..3896; Strand=-
  SCN-specific regions: Sequence locations=1-318,340-365,387-633,655 -656,679-726
gtaaaagcactgaattggccaataaatttccagcgattaacccaatatttttgcattatcacttcaatgatcatatgaagttaatttccgtcgtcaaaacactgaatgatatttcgaaatgtttttggcagagcaatatcatttgcaataaattggttttggtaaatgaggttgattttaattatgaaattaaagaggaggaaaattggtttagcaaatttaaacaaaattttatggaaaaaattaacggcacaaaaaacggaccaaaaaatgtgccatcaaacgaatttgaagaaaacattcggcaagaatttgagcaaaaaatgaacaaaatgtatgaaaatacgaaacgaaattccaaggacgaaaaggcaaaattggaaaaagcaattggaaattcggaaaataatgaagaaaaaaaaattctagaaaaagaatatgatgacaaatttggcactttcatttcatcgccattttcatgaaaattccttcgtctccacgaaattcattgacttttcggatatttacctcatagaaattatatttgattggattttaatcaaaaaaaaacaaaaacaaatttctgcacggtcaaacaaaaaactacccaatcatatcatagcctttatcaagaaaaaaaatattttaaattttccaaatattaaggggtgtatttagttaatttcttataaaaaaagattttttatttacttttgtttaaataaa

SEQ ID NO: 66352 - DNA, 319 bp, Heterodera glycines
  misc_feature (84)..(84): n is a, c, g, or t
  Genomic contig location: Contig_ID=SeqID_37232; Location=579..897; Strand=-
  SCN-specific regions: Sequence locations=1-251,273-276,299-319
atgaaggagaaatggtctgataacagagctgcaattgactttttgatcaaaacaaaagttataacaatgtatttttcttatttnttctctataaaaaatttacattcttttcaaatacagtaaacttggtaaaaaaattgcaaataaattggaatgatcacaaactcggtgtaaatttcaagagaaaattctcaatcttcggcattttgaacttgaacattaaatagtatctttttattgcttttttcaattgaaaattattttcattttcagctctaatataattctaaaatttaagtttcattgccatttaaataaa

SEQ ID NO: 66353 - DNA, 856 bp, Heterodera glycines
  Genomic contig location: Contig_ID=SeqID_37234; Location=94..949; Strand=+
  SCN-specific regions: Sequence locations=1-20,89-107,155-172,379 -420,455-489,563-678,702-733,790-790
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggccgcgggtcgccgggccaaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 66354 - DNA, 158 bp, Heterodera glycines
  Genomic contig location: Contig_ID=SeqID_37236; Location=1..158; Strand=+
  SCN-specific regions: Sequence locations=1-158
ttttcgcgtggccattttcgcgtggccgttttcgcgtgagggccgttttcgcgtgagggccgttttcgcgtggccgttttcgcgtgagggccgttttcgcgtggtgacgttttcgcgtggttgcatataaaagagaattcataactcacattatattt

SEQ ID NO: 66355 - DNA, 918 bp, Heterodera glycines
  Genomic contig location: Contig_ID=SeqID_37240; Location=73..990; Strand=+
  SCN-specific regions: Sequence locations=1-3,25-245,270-314,337 -502,524-726,749-818,840-918
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaaggcgtacggtaaaggggatacttgaaaatagaccacagaaggtagtgattgagaatcatgtaccaggtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaagtccggaaccccaaacaacatccacactcaaaacacccgttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagtgaagaaacccttcaaaccactaatatgggcaagactgtagagaaaattttatcgaaaattattttaatttaaaatctccgggcagttttgctggaattcaaaaaatttttaaatgcggccaaaagatttgaccgaaatacgaccgatgacgtta

SEQ ID NO: 66356 - DNA, 1967 bp, Heterodera glycines
  Genomic contig location: Contig_ID=SeqID_7912; Location=2405..4371; Strand=-
  SCN-specific regions: Sequence locations=1-54,80-167,197-241,263 -445,472-571,595-645,671-774,797-864,886-891,913-1101,1135-1310,1336 -1516,1546-1566,1588-1657,1686-1848,1870-1967
gaaaaattggatgaatattgttcaaatgacacggacattttaatgaaagcgcgtataaaattgagaaagatttttattgatataacaaaagataaagagacaccaaatgggatcgatgttatgagattatccacaacaattgcatcttcatgcatgaagtagggaccaaaataaaaataactaaataaataaatttcagcatttttcgtgccaaatttttaaaaaatagtgaaacattgccgattattcctgagagtggatttgagacaaaggacagtcagagtaatatagcgataaaatattttgaatggattatgcatcgggacggcgtgaaagcgagacatgcaggaaatggggggaaatatcgcattttggtgacaaaaaattaaaaattgattacataattggagtccaaaaaaagatcattgaatttcaggtgggaaataaaacaaaattaatgaattaattactaatttatagggatgcgcttttcatggatgtaaaaaatgttataagggttttatgattcaagcgaatggattaacagcggaacagaattatgataggacacaaaataaattggaaaaattaaaagttgcgagcaaacaatgggatatactgtagaggacgtttgggtatgttccctaatatatatttttataaaaaaaaacattttaggaatgtgattgaaacatatgaacgagcggggaagcttttgagtgaaaaactatggggcgggccggctttgaaccggcgtctctggctttccggaccagtgttctaccagctgaactaccgaccctgccctctccagttgagactcaagaaagtggtcttcggggatttgataatggtccgcaaaaatatgtgacaaaaaatgatggagagtccttaatataatttaatccacaattaaaaacataaaactttcttaaagtaaaagtgtcgaacgattccgataggcatcggtggttcaaaattttaaaactcgaaaacgaaactcaaaaagtgacgaaaaaaggggacgacacgaaatttcgcacacccgtgctctctatttattggcacatgtctttttttgaaatggtgtgtgtgtgtacctattttaattttaaaattttttttaaattttttggaattcgcgcattctcaccttttgggcttttctcactttctcgcacattcattttggtctcacaacttccctgctcccccccccccacccattattcttatctatgggatgattgataaggtaaaatggaaatcgcacgagaggagaggacacgcacattgattgatccgtctccattttatttattatttatatattttgtactatttgtttacaattaacgataaatttgtgcgaaatttccttattttaacgaacggacaaaatgcaaaatgtaacaacagaaaatggagcagcggtgggagaggaagaattgaacgtaccggaaaatgtgtttaggtatattcgacggatttttgtgcttggcctcattttaattcaaatcaattaattaattgattaattaattagctgttttcttttacacaccgagtcaacaaattaaacccaaactcatcaatgaacaagaaatgccacattgcaaaaactaaatggtgcaaaaatttaatgatttgataaatcgaaaataatttttgaaatttttaattttccgaagaaacaaataaaatattcatgttgcgcaacagactcgaacttatgccctttgtcaattgactatcttacaaaaaccgcttggccacacatgcaattttgaactgagtgccaaaaattgactcggtgtgtttaagggcgtccttgaagtcaaggacctcatttctgaattttaacttttttcagggattcccagttgaaatggaacggatggggctacaaccattcattctttgcgctgtctgccagcggccaaattatgatgcatagtgacgagtga

SEQ ID NO: 66357 - DNA, 1259 bp, Heterodera glycines
  Genomic contig location: Contig_ID=SeqID_37246; Location=44..1302; Strand=-
  SCN-specific regions: Sequence locations=1-5,209-300,724-825,859 -1029,1053-1158,1205-1259
  Gene Ontology: Mol. function=cytoskeletal protein binding; Cellular component=cell-cell adherens junction; Biological process=N-linked glycosylation
atgatgaggaagaagaggaagcgaaggaggaggagaaagaggaacagagggaaagatagaagaaaggaggaaaagctagacgtagaaagtgaggggacagaggaagacaaagagggaaaagagaaggaggagggggaagaggataaggaagagaaaacggaagtgggaaagatggagaggaagaaaaggcaaaagaaacaaaaaaagagttgttcacccgaaaaattggtgaaagagaaaaaagaaaagttggagggatgcagagaaaaaaaggatgagggagaagaagcatcttccgttaaggaagacgagaaaaagcgcgaaaatgatgatgatgaaaaggagggagaaaaagacacgaataagaaagcggaagaagaggaaaaggaaaaaatgaggaagaaatcaaaaaggaggaaaaggaataggaatggggaagctcaattgaagaagcatttttatgaaatggacggggaggagaaggacaaagaagaagagaaggaagaggaaaaggaagttaatgggaaaaagaaagaaagaaaagagaaaatggaaggggaaaaaaagaagagagaggaggaaaaggaagaaatggaagaggaggaaaagaagagagaggaggaaaaggaagaaagggaagaggaggaaaaggaagaaacggaagaggaggaaaaggaagaaagggaagaagaaggaaataagagagaggaggaaaaggaagaaaggaaagggcacgaaaaacaaaccgaagatgaagaaaaaccaaaaagaatttcaaagaaaaagaagaagtacaaagttgaagcagcgcaagtgaaagaggaaaagacgaaaatttgggaaaggaaatggcaaggactgtccaaggaagaacggttggaatgccgatatcggaagagttgttatgcgacaggaacgaagccaccaattcgaagatgggcgactcaggaagagggggacgaagatgaaaagcgggggcacggttgggaggaatggcacaatttatgggtgacaatggcaataaaaaatgaagtgaaagaagaagaagccatcgaaggatggcacggcatggatgaacggcacaaaaaactgaagtgccaatatcggaagagttgttacgaacgaatggagcagcgaacggaggacgacggaacagcgaacgaaacgcagcgaaaccgaaggaaagaagcgaaacaaagggaaaagccgaagaaagtggaggacatcacgcggaagacgaaggcacgagaaacctccgg

SEQ ID NO: 66358 - DNA, 1555 bp, Heterodera glycines
  Genomic contig location: Contig_ID=SeqID_7913; Location=1001..2555; Strand=-
  SCN-specific regions: Sequence locations=1-5,27-624,698-1039,1062-1555
atggatttgcttctctttttcctattttacgccttgtttttctgtgcatcattcaacagaatgtcggcctccccacggaaagaccgccgtgggcccattttcgacgtttcgcccccgaggggtcgcctttgtgccgcggcgtcggaggatcggcaaaatgatcaaacaccattgatcgatctggccacgtcggaggatcggcccaatgatcagccaccactgatcaatctgccgaaggaaggacagtcgtcatccaaaagacagtcaaagcatcgaaggggcagcagtgccattcccctttttgctgatgcgtactttccttttttggcacaatcatcggatacaaatcggcatgcatcgccgcccactgtgccgcgccaatttatggcaccgatggacggcgacatttctggcaccaataatcagccgtcaccaccaaagcaccgaaggcatagaagtgacattctcatttttgcaagcagtacccaaacgaatgatcattcacacaaacaaaataatgtaaatgtagcgaaaagccgaagaacacgcaggccgagcatttcacaaagcgatgccattgccaagcagctaaatgaattggtcatccaagaacgaatttgtttgtttttttgtataataaaaaaataataattaaatttaaaattggtaattattatcgtaattatttaataattatgccgttaatcgaaccattatcaatgaatgaattcacagacaatcagacgccgacacaatatccaaagatgccaattaacaaatggactaatctccgattgcctgtccattccgaacagcttagagcgggaggaaaatttgatgtcaaagagaagtgtcctgaagcgaccaatgaatttgacaaaattgtcgaattcatggatgacacgggaaaatggattaaaatcgaaatagagcaaggaaaagccggtaagaggagcattaattgggagaggccgagtctcgacccattaaaacctaagggttaatctcggcattttgaatctctttctcgagcggaagaaggaaacaaaaacaaacgtacatttgggcttctgtactaaattttgccaattttgacggtttttgagtaacgaaccggcacctttaaaattcgaaaatttgagacaccatcgcagaaatttacaaaacttagccgttctaaaagcttttttacgcggtttatttaaaaattgaaaagtgaaagttatgctaaagagtttaattattatttcagtggttatttatttgcgtgatttgctcggaaatccgcttcaaattgaagagccgatgaatttgtcctttggcgggaagaagcgatttttaagaacaaatggcacagaaattctgtatccgacagaaataatatacagttggatgaattttcaattgccagtcaacgccgaacacctcgaaatgggaggacaatttgatgtgaaagagaaatgcccagaagagaccagggaatttgacaaaattgccgagtttatggatgacacgggcaaatgggtcaaaatcgaaataatacaaagaaaagccg

SEQ ID NO: 66359 - DNA, 54 bp, Heterodera glycines
  Genomic contig location: Contig_ID=SeqID_7913; Location=2785..2838; Strand=+
  SCN-specific regions: Sequence locations=1-54
atgttatttaatttttttgttattttgtttaaaagaaattacgaaaagcaaaaa

SEQ ID NO: 66360 - DNA, 871 bp, Heterodera glycines
  Genomic contig location: Contig_ID=SeqID_7914; Location=624..1494; Strand=-
  SCN-specific regions: Sequence locations=1-215,238-270,292-524,546 -549,581-871
atgaacaacagtaccaacacaacaatggatcctacgaatactacggtaacagtaatccattttaaaattgcaattagtccttaattacacagctcggctatgtgatcagttcaaattttgttccgctttgttttttgtttggcctaaagatccccattttggtgatggccttctttttgagcactacgccaatttatttgactttcaaatcaaagtgagtcttctcccattggattttcatttgtcgaatggcatttttgaatttttttaatttgaaaaagtaaaaattactaaaatttatctttaggattttgagaggcaattgcaactttctgatcgcactgaacttcttcaacttgtcgcttcagcttcccgccgctttgatcagtgcgactgtcgtccttacgggccaaattcaaattcgtctggccaactgtttcccgctccaaattgggccgtacattggcgccaccgcgcaatggaccatttgcttcgccatcgctttggaccgtctcgtcggattgtttttcccctttttgtaaaaattccaaaatttaaattttaaatttaattttaatttggcactaattattttagctattcaaattattttgggaagaagcgcatcgttgttgtgctggtcgccctcgcgtgttacacttacacattttataaggcgctcatttcgtacaattattcgatggccatccccgagaagtatttgcaattagtcgctttatcaattttaagcaatacatatttcaatttctattaaatccattttcattttgtgtaggctcgtcatttgtgggacgactgacatttatccgagtcaaaattccgtcgtcgtgctccaaaacttggcaataaa

SEQ ID NO: 66361 - DNA, 600 bp, Heterodera glycines
  Genomic contig location: Contig_ID=SeqID_7914; Location=2461..3060; Strand=-
  SCN-specific regions: Sequence locations=1-15,38-87,110-254,283 -348,372-600
atgcttctcctttcttttctgttcgtctttttcctttccgtctccaaaagtgaggagtaagttttgttttccgattcattgccttttcgcatttcttttcggcattttcctaattgatttgtgttatctaattaccgatatttcccttttatatgccgcgtttgttttccgtctccgtttgactttctttgttcagctgttgcgatgtgtgcttcaatgcttacgtcctctgcaattattcgtgccaaacgcttcgcccggcggagggcggcgccgcgggggacggcacgaagttcagacattgcagggcgaactgccgcatggatttggccgagtgcgcgttcagatgcggcccggactgtccccggcccaacgacgtgctaatcggctgacccagcgaatgccgtgccaatggaaaaaaatcctttcattcctttcaaaattcttttttttattttaaacttttgacaactaaattttgcaaaatattgccaagtgaaagttaaatttccctttttttaaaatcgtttacggttaattaatcggaccgataaaacaccgagcaaaaaacaaaaagaaaaaatgttcatgggaaataaa

SEQ ID NO: 66362 - DNA, 641 bp, Heterodera glycines
  Genomic contig location: Contig_ID=SeqID_37252; Location=310..950; Strand=+
  SCN-specific regions: Sequence locations=1-27,49-216,296-362,384 -498,520-641
atggctaaattaaaaatatttttctttgcatttttgattttgtcacaaaatttgacaatttcaaaaccaattcgtcgcaaagaaagagaactggggactcttgcggctattgcaattatttcggcaattgttctaactccaataatacttggttcggttgcaaccggcattgtaattggttatactttaaaagatggaagtggtcgtgaatgtatgaatataaatttaaatttaaaaataataaataaaatgataattaaaatattaattaataatttaaaaaatcaaaaaatttgttcagataaggagtacctcaaactttttttccccatcaaattttcgtttggcgaccgcgaaatttcaattgatttggaaaactttaacaattaatttttgtttcgaaaaattggtgaaatgtggtccatgccaaatttggatgagatttgtttttttggtatgaaagaactgataaaaaaccacataaatcagccttcctttcagatttaaaaggaacaaaaagacgccacactcgatcgggacaaattgaaatatttttattttatctgtcaaaaatggaattgcctgtttcactgaattcttgttgattgctattttttctcgttagcccttgagaaaggcga

SEQ ID NO: 66363 - DNA, 173 bp, Heterodera glycines
  Genomic contig location: Contig_ID=SeqID_37254; Location=615..787; Strand=-
  SCN-specific regions: Sequence locations=1-10,32-82,124-173
gcgatgattgtccatttgcgaagctgtgcaaatagaagagagcagaagcaattaacacatagaaaagatgcattttgctctcttaatataatttaaaatttttaaattttaaatttaaaaaatcattgcacaattttcactaatttagtcatttttagggatataataataaa

SEQ ID NO: 66364 - DNA, 513 bp, Heterodera glycines
  Genomic contig location: Contig_ID=SeqID_37256; Location=349..861; Strand=-
  SCN-specific regions: Sequence locations=1-308,331-513
atggttgagatgggaaccgaaattcaaacatcccgaaatgaacttaaatcttttcaagaagaagtagataaagccaaaaacataacattggagcatgtggaaaagaatgacatgaaagaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgggcattttaaacgtaaggaaattgaaaatagacaagtttcagaagctgaaaaagggccgcaaaaaagagagagattagccaatgaggatgttcaatttaactacgacagtattgatcaaaaatttattgtctatctttcctttgccgtcacccatatagatttgtcaaaacacctcgcatatgttctggggtttaagaatacaaggctatttcacgcggaagaggcgacttatatgccggatttgacgggaggt

SEQ ID NO: 66365 - DNA, 801 bp, Heterodera glycines
  misc_feature (767)..(767): n is a, c, g, or t
  misc_feature (774)..(774): n is a, c, g, or t
  Genomic contig location: Contig_ID=SeqID_37261; Location=135..935; Strand=-
  SCN-specific regions: Sequence locations=1-3,25-499,521-723,746-801
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgaggacctcaaggcgaagagacacgattggctctataaagaaaggcgtacggtaaaggggatacttgaaaatagaccacagaaggtagtgattgagaatcatgtacccggtccgaatgttgcaccatatctaggcctcaacactcaatccaaaccacaggagaccgatgaacaccggaaaataattattcctaggaaaagacttgaagagcaaactcctgatcctgaatcagataatgatacaataaatgagttaactccggagccccaaacaacatccacattaaaacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaaganacccttncaaccactaatatgggcaagactgtag

SEQ ID NO: 66366 - DNA, 1467 bp, Heterodera glycines
  Genomic contig location: Contig_ID=SeqID_7916; Location=130..1596; Strand=+
  SCN-specific regions: Sequence locations=1-135,156-399,425-428,450 -466,489-616,697-802,835-1220,1242-1265,1297-1467
atgtcccccctccgtttcttcgtcgccctttttctgatcactttggcaattttggccgggacccacggcactgttgagaactcagtggatggtgggccaaacatggcatcgccgattatccgtgaacgccgtaagttttattttattttattttaattgttgaattgaattaaaggaaggttgcaagttgacataattcatgaacctccggaaacagaaaaagtgagaccaaatgtgacgagggtcataattaagatcgtgatcgatgaacttaactatcccgaaagcatttattgagataggcaatgaggttgagtaacaagaactgaccactaaactcttgatcgagaccgagactatcgatcatcccaaattgtccaaaaaataaagatgtttttcatttttaaaataaaatataaaatttcggagcatttaaagaagtttaaaaagcgaagcttacttatataaaccagttccaagtcaaaaattcatttgtttgctccctttttagtcaaacatataaatttatgagatgccaatcacataaattttaaaagtgcagctgaactgagcaaaaaagtaaacattgcaaatggaaattgttacaaaaaaagactttaaaaatgattaaagaatttttctatttaaataactattttgaattcaaaatgaaataaattattttgaattaaaattgtaaactttatatgtatgccgttgggttagagttaaatctgtccaaaactgacttcaaccaagttaggcttttcgaaaaatttcagctcaaatttttacgaatttctataaatattaaaaaataataataatttttttgtccctaaaacggtacatggcattcattgactgtgaattgcgcggaaaacgaagagaaattttttcaataaaattcttttaaaaaaactcgggttttaaatttttgtggcattccgtcaggttagcttggcatgtgcttctgctgaagcttttgacctatacactaattgctgcttcttcttctcctgtcactgattgataaatgcactcaatcttgtgtaaatataaaattgtgccgcttttccgcgatgacaaattgaatttaaaaatttaatgcccgcgggggggggcaaagatgtgccatctcgaaagtacaaagtaaagggcgcataaaggatttaaaagaggcataaaaaatacgggatttaagtcataaaaatcactcaaaaagacaaattttaaattgttgacagtgctgaaaggcatccagcaaaatttttttttgaaaaattaaaaaatttaggtttattccgggagcctcagctgcattcgagtgccgaatgtttgtgccgagtcggtgatgacgcgaaaagtgccaaacaaaagggccaacaaatgttgggaagggacggtcaaagcggtgacaattctaagaatggaaatgaaatgtattacttacaattacgattttag

SEQ ID NO: 66367 - DNA, 658 bp, Heterodera glycines
  Genomic contig location: Contig_ID=SeqID_7917; Location=442..1099; Strand=-
  SCN-specific regions: Sequence locations=1-99,121-125,150-542,575-658
cagttggattctgtcgaaagtgtgcacaaatattggccaattaagcatcgaaatttacaacaacaacaacaacaaggaactgcccgagattaatgagttgaaacaaattgtgacagaaatttgcaaagaaaaaagtgatgtgcaaaatgccataaaatcattttatgccaaaaatgacattggcacaattgttgaaaaagcgatgaaaaatgggcaacacattttggaagtgatgaagcaaaaggaggacgagaatgaacttgaatgcaacaaccaactgaatgaatttagccaatttgcaaaaaaatttcaaatggaatttccggaaattttgaaaaattcgacagtaaacgaactgatggacaaagaattgctaaagcccagtgatttgttcgaatttgtgctaaacaaattggaatttgaacattttgctagtgaaaggaattcgactggggcaaatggtggcgctgctaagaaacttagtgccgacgctaagaaagttagtcataggcgccgaaagcgcagcggtgatcccattccgtttcctctgctgatcattgcattttttgtctttgcatattacactcatattttcacttcacccattttgttcattttcatggctttttgcttatttcttgctgccagactttcatga

SEQ ID NO: 66368 - DNA, 810 bp, Heterodera glycines
  Genomic contig location: Contig_ID=SeqID_37262; Location=48..857; Strand=-
  SCN-specific regions: Sequence locations=1-222,247-258,298-403,450-789
atgaacagtgtgttggagggcatttacaatggcgtgccgatgatttgtgtgccattctttggtgatcaattttacaacgccgaatcactggcacgtcagcagatcggcctggttgttgaccgtctacattacaagggcacggtacagcaacagcttactttagcacttgccatcgcactgaaacttaatgagaggtgagacaaaattatttttaaatagggtacatatttttaattaaatgtataagagttatcctggttataaaatttaaaaaaattagaaagtttaaaaaattatgagcctggaccgctagaggcagtttaaaaagcaccactaactgacaatgctaataaaaaaaatttatggtgcgcgtaaattttggtccgaataaaaagaaaatagcattaataaaataatttaaaataaaccaatcattatttatttatttagtaatgtctctgagaataaaatcgaaatggacaaattgacgacaataagcgcagcattacaccaaaaaaatattccaaatattatttccgacgctttccgagtgattgaagacgaaatgtgcacaaatgatagaaaaacaacagtgattggggatttgctgacgagaaacgaagcttcctatgaacctgttggatggccagaattaattatttaatttgttaaaactgcgattttttggagattttttttagtcaaatcgaaaaatttaccaatgacacaatgaaaaagaaattaaccctaacggaaaatgtaaacataacattaatgggatctttgtccatgttttagtagaaaaataaa

SEQ ID NO: 66369 - DNA, 434 bp, Heterodera glycines
  Genomic contig location: Contig_ID=SeqID_37264; Location=30..463; Strand=-
  SCN-specific regions: Sequence locations=1-434
atgacattctatgcttctcttgttggatacacgggaagaaataatagttagtccttttgttgaatttttagaaattctatccgtccaatcggcttttggaattttaatgagtaaatcaggaaccgtaaatgacattctctgcttctcttgttggatacacgggaagaaataattgttagtccttttgttgaatttttagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaattttaatgagtaaatcagtaaccgtaaatgacattctaagttctcttgttggatacacgggaagaaataatagttag

SEQ ID NO: 66370 - DNA, 300 bp, Heterodera glycines
  Genomic contig location: Contig_ID=SeqID_37264; Location=676..975; Strand=-
  SCN-specific regions: Sequence locations=1-57,79-300
atgacattctctgcttctcttgttggatacacgggaagaaataatagttagtccttttgttgaatttttagaaattttatccgtcaaatcggcttttggaattttaatgagtaaatcagtaaccgtaaatgaaattctctgcttctcttgttggatacacggaaagaaataatagttagtccttttgttgaatttttagaaattctatccgtccaatcggcttttggaattttaatgagtaaatcaggaaccgtaaatgacattctatgcttctcttgttggatacacgggaagaaataa

SEQ ID NO: 66371 - DNA, 127 bp, Heterodera glycines
  Genomic contig location: Contig_ID=SeqID_37265; Location=516..642; Strand=-
  SCN-specific regions: Sequence locations=1-42,64-127
atggccaacaaatttttaattgctgcttttattttgacaattgccatttttgtcaatggacaaagtgaggcgccgaacaattcgtcggaaatggcatcggaggagagcaattcggaagagtcgggca

SEQ ID NO: 66372 - DNA, 509 bp, Heterodera glycines
  Genomic contig location: Contig_ID=SeqID_37266; Location=185..693; Strand=-
  SCN-specific regions: Sequence locations=1-509
atgggacggtcaaagtcaatgccgtcgctgagagggccgacgaacattcagcagttggtggacaaaatgtgggagaaggacacagaacgagtgaacgagtcgatggtgagagtcgactggcagcagcacatccccagcagaagggtcatcgacgtgtccgatagtccgtgagtcgttttggcattcgtttggcattctctcccatttctctccttttttggtccgtttccttttgttcgttttgtttctcttttcccaatcatttcggattgtttcacttggccatcgtccctttctcagttttctcgccgtctctgatgagtctttcctccaacggcccattttcgccgccctcgtcgacatttacaacgagcaattgttccacccgcccgtttgtcagggagaagcgccgatgaatgagcagagacgggcgaaattcgacacactttgggcactgatcactcgcagtgaaatttatcggatggcttacgattatttggacagattgg

SEQ ID NO: 66373 - DNA, 534 bp, Heterodera glycines
  Genomic contig location: Contig_ID=SeqID_37268; Location=8..541; Strand=-
  SCN-specific regions: Sequence locations=1-534
atgctcggccaattcatttcttcgcctcctcgtacattaattatggcttttttattggccataataatgccaatatttgttgttggtcccaaaataggttccatcggcaaccaataccaaattcatcctcctgagaaatacaaaattatagtcgttttctatgctcctggtaagtaaaaaataaaaataaacaatttcaaatggtttttcatttccgacttcaaagccgagtttcaaacaaatgctcaaggagagatcaaattttcatttgacgatcgagtgttcaaaaacccattcgtcaatcaggagttgcaggactcaaatacagtcaaagtggctgtttatgtgtacggcggtcaaaacaatgagctacgacttttgcatcccttcaaaatgtttgaatataatcatgctaatgagcgtaaattggtgcgaaaagttaattataccgatttcgagaaggaccgaaaacgcaatgattatcgactgcacgaagtgtttcatgtcgcatttaaagatcttccattggtggag

SEQ ID NO: 66374 - DNA, 53 bp, Heterodera glycines
  Genomic contig location: Contig_ID=SeqID_7918; Location=120..172; Strand=-
  SCN-specific regions: Sequence locations=1-53
atgcgaatttttattcttgggttaccaaatttaccgccattctacaaagaatg

SEQ ID NO: 66375 - DNA, 90 bp, Heterodera glycines
  Genomic contig location: Contig_ID=SeqID_7918; Location=511..600; Strand=-
  SCN-specific regions: Sequence locations=1-90
accgtatatgctctaattatagcccagtctctattaatcccgcagtctccaattatcccccagtctacgaggtgttttgaaaaataatcc

SEQ ID NO: 66376 - DNA, 66 bp, Heterodera glycines
  Genomic contig location: Contig_ID=SeqID_7918; Location=1917..1982; Strand=-
  SCN-specific regions: Sequence locations=1-66
cgatccacaaaaaaactcagtgtgggcgatccacaaaaaatctcagtgtgggcgatccacaaaaaa

SEQ ID NO: 66377 - DNA, 65 bp, Heterodera glycines
  Genomic contig location: Contig_ID=SeqID_7918; Location=2979..3043; Strand=+
  SCN-specific regions: Sequence locations=1-65
ctatagaccacgaatcgaccaactgaagttcaagctgttcagcagcagcatccatcgacgactgt

SEQ ID NO: 66378 - DNA, 1491 bp, Heterodera glycines
  Genomic contig location: Contig_ID=SeqID_7919; Location=2047..3537; Strand=+
  SCN-specific regions: Sequence locations=1-440,478-604,648-730,752 -851,891-1172,1211-1347,1390-1491
  Gene Ontology: Mol. function=signal transducer activity; Cellular component=intracellular; Biological process=digestion
atggcggcgttcggcgccaaaatggccagaaaagttcaatttgttgaggtttttggccgaacttttttgtctctgttaaattttttaaaattttgcaggttaatagggagtcaagtgctttaaagcatatcaagcttctttaatttgggagacaaatagaaaggttatagcgtttgcgcaaaaaagggctggcgcgaaaagttggcggttccccaaaacgtcaccacccaaaatgccaccagatcagcagggcttggatttatatgtgtccactatttttggcatataataatgtaagagattatcagagaaattgtgaatatgaaaagtgcaatttattttgtttcaaaaaaatgctctctcaactccccaaatggctatatatataattagaaatcattaatcagtaaaatgccaatgaatttataaaagccgttaaattcctttttaatttttcccctatctactcccctatcttgtgatgtacagtatgcttttctcactaatctcacaaaaatttaatgcattatttatattattttattgcctttttaatttgttatttttcatgtcccaattaaaatgcaatgcgtatgtaaatggcaataaattaaattataatttatttagaattaatttttaaaaatggaaaatgtccttgacgttgttggcgaagaaattttggagcgcattcaaaacaatgagtttgaaagagatgtaccgtgaattgcaaaaaatgataatttgaaatttaatattttattccttcattaggttgaggggttcatcccggtgtcgggtgagacaccgtccccatcattcgcactgctccgagaccattggcttcaggcaataaaaattgataaaattataaaataaataattattttgctaatattatagagagatggtctttttgaagacccggagtttccagtggagacaattccaatgtacttcactgaagggccagtgccgatccgttggctgaggcctggcgaaattgctgatcacccgcagttcatcaaccagggcccaattgctggggatgttcggcaaggaagcattgggaattgttgggcgctggctgcggcgtcggtgttggcgcagtatgggcccctgttttacagggtggtgccgcctgaccagggattcggccaaaattacgccggtaaatttataaaatcaatatatatttaaattaaatattctacaaacaattcttttttaatgacatataatttggtagggatcaactgcgtcttgggtcaacttcatctgacaatgagccaattttgtctcggccaactccgtcttcgtatataatgggtcaactccgtctctgacaaaaattcaaaattaaatttatttgttttttttattataaaacgccattttttggcaatattattttaaaattaagtgataattttatacaactaccataaaaatgttcaattttccattggaatactgtagtttttgggacta

SEQ ID NO: 66379 - DNA, 370 bp, Heterodera glycines
  Genomic contig location: Contig_ID=SeqID_37274; Location=985..1354; Strand=+
  SCN-specific regions: Sequence locations=1-370
atgcacgcgttttgcgctcgagctattcatcatcgggcttgtcaatctaaagcgaaacaacaaagatggtgttttgaacgaataaagggcataggttattttgaagaagtgtcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaa

SEQ ID NO: 66380 - DNA, 45 bp, Heterodera glycines
  Genomic contig location: Contig_ID=SeqID_37276; Location=574..618; Strand=+
  SCN-specific regions: Sequence locations=1-45
atgaaaattaaaattgcactgcccccagaaaatcttttagaagtg

SEQ ID NO: 66381 - DNA, 186 bp, Heterodera glycines
  Genomic contig location: Contig_ID=SeqID_37278; Location=86..271; Strand=-
  SCN-specific regions: Sequence locations=1-186
atggccataaaatatggaccaaaaatcgcaaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcg

SEQ ID NO: 66382 - DNA, 144 bp, Heterodera glycines
  Genomic contig location: Contig_ID=SeqID_37278; Location=1..144; Strand=+
  SCN-specific regions: Sequence locations=1-144
taattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 66383 - DNA, 461 bp, Heterodera glycines
  Genomic contig location: Contig_ID=SeqID_37280; Location=1..461; Strand=-
  SCN-specific regions: Sequence locations=1-245,268-461
aatcaaacgctaacagacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaattttttctccatcttcctttttgatactaaagcatcagagtgctaaaattgacttgtaaataaaatttggtgcgctttagagcactttctgaaaaaatatttatgaaataaaaaaatcgatttattcaagtgtccgtttggggtactcaaacaattatgaggagcaaaaatccaacgcagaattaaagtacagactatag

SEQ ID NO: 66384 - DNA, 762 bp, Heterodera glycines
  Genomic contig location: Contig_ID=SeqID_37281; Location=93..854; Strand=-
  SCN-specific regions: Sequence locations=1-174,196-588,610-762
tacgaggaaagatatgcttggtcacaataaaataaaaaatggctagtatgtaaaaatttgcggtcataaataaaaaaaaatggctaatatgtaaaattggcgtcttgaaatttttagactaatccgaagcaaagcacgaatgaattaaagaggcgaaagaattcacagtatcgtttctaatagggaaatattgacaggatatacgactaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactc

SEQ ID NO: 66385 - DNA, 972 bp, Heterodera glycines
  Genomic contig location: Contig_ID=SeqID_7920; Location=1360..2331; Strand=+
  SCN-specific regions: Sequence locations=1-168,193-245,270-599,622 -649,706-972
atgcctgttcagttggaaatggtaaatgccaatcagaaaagcagtggtgccattttgatttggtcgccagggagagaatggacgaaaaagcaaactttggcacagaacggattgagaaaagtgttgaagagagtgctgacaatgccaataatagggccaatgttcccagaagagaatttgggccaagaaattaatttgctaaatgcgcaagtcatccgctggaaaatgcaagaaggtttttaaagcaaaaataatttaaatgtatttttctgggttatttaattttccgttttttactaattgcagcgataattcacctttggcacgggaatgatttgtcggcattaaatgaattgaacaaaccaacagaattcattgagacggtgtcttatacatttgtggcattgttttaaatataattttgcatttagtactccgattttattgcaattaaatgcgtcggctccgaattttttattggaaaattctgtgattttgttggcaaacgaattgggcacaaatttttaaattattctgaagcatttttggaggattcggtcgaacttttgcatttatatcccaaaattttgaaccttcagcctcaaattaaacaacaaaatattcaacagagcccaaaaaggttggaatcatttaattaatgtataacttttaatttaaaaaattttaaattttcaattaattaaagccaattttaaagtaatggccaatttgaaatgctgtggattgtcggaattcattttaaagctaatttaaaatacaaaaagatgaaagaaattaaggaaaaattgggggaaaatttgaaaacaaactttgatgttgaaactgtcaatgactttcaacaattcgcctttttcaatgtcaaattgcactcaacaattctcgagagaaatgaactcaaaaaactattgaattaatttccattttcgttctctatgtttagaaaatgtatga

SEQ ID NO: 66386 - DNA, 730 bp, Heterodera glycines
  Genomic contig location: Contig_ID=SeqID_7921; Location=10..739; Strand=-
  SCN-specific regions: Sequence locations=1-27,50-220,242-462,497 -569,592-704,726-730
atgcgcaaaaacttcaacaactctatagctgctgcagctggtggtggtgaattgtgccaacaggcaccggcattttcgaacaaagtgtgccaaacgaaaattaaaattctttaattaacagtttaatgactctttacatagcaaggtttttataagatttgtttttattttttaaatccatttaatttccgtatttcaaatttcaatgccattttgccaatgctttgttttttgtttctctccgattttcagctccgttcgctggtgttcattttcaccaccactgtttggaccgctctttcgctgctgcccttccgacttttgatgctttattggatgtatttggtggacattgatcatttctgtgtcgaaaagtgccaatggttgcaatggatttacaacttcgcctgggcattcctttgcctgctcaaattgaatccggcaagaaaacgcatcggatagatatttaatttaaattagtattttaaaataatttgcaattatttttttcaatttctgatcgtaaatccgttcatcaccgccatcatttaccacccctatcgctgtacgttgcgcagaaaattctcaatgccaagaggacgaatgagagggtcaacgacaatgagcagaagctaaagggcattccacacgagaaaaactgtccataaaaagagacggtacttgtacagtttacaccccatagaaatgtttttatatttttagtaataaa

SEQ ID NO: 66387 - DNA, 700 bp, Heterodera glycines
  Genomic contig location: Contig_ID=SeqID_7922; Location=70..769; Strand=-
  SCN-specific regions: Sequence locations=1-677,699-700
atgagtgttcataatgatagccatggcgaagattgcaatgcaacctcaaattgtcatgcttctcgttggctcgaagattcatcacaaaatttggttagtaaaactttgaaaaaatttcaaatatggtggggttttgaaaaattaatggattatttttccctaattgttagtttgacaactcgttaattggcctgtcactgatttcgattgtcgccaacattttggtgatcatttgcgctcgccgactttttgtgtataattgcgacacaattcacatttacattgccagcatgacctttggcgatttggttgtaggtgtgtttttatgtttagggacttcaatttttttttgaataataaaagttgcttatttaatttagtgttttgccaaatttttgagtctttcgaaagtcggcgtccctttcttggcgttgtgccgtgcatttgcgtctatcttttgagatgtctgggcatcgcggtgtccgcccttgtcgctggtgttgctgaacggagacaaactgcttttttttactttcccatttattatcgcgtgatcaaatcagtgcgaagggcacttcgaatgtgtgcagtgatttggacagtttcattggggagagaaaatttcctcatttttgtagagctgcggaaggcgtctataattttgaaattaaagcggaaattgatcaaaagtttaacttaa

SEQ ID NO: 66388 - DNA, 526 bp, Heterodera glycines
  Genomic contig location: Contig_ID=SeqID_7922; Location=1258..1783; Strand=-
  SCN-specific regions: Sequence locations=1-151,173-305,327-329,351-526
atgttaaataactttctgttcagattggacccaatttgttgtgagtcgccgcaggtaattgttgatcagttgagctgtgccacggaacgactaaatttggcactgatgccatttgaacacacaatcgtaacagacgacttcatttacaggcaaaaaaaattaatttaattaacaatatacttttgttaaaggggcattcattgttggcaccaatacaatcaaagcggcacaccggtcgattttgtgtggaaaatggaaatttgccaattccgtgtcaatggcatcgccacaacgggattggcagcttcatcatcctctccttcatcatgtaataattaattaaaattaaactaattcattttatccatcataatccccccctcagatcggagctgtcccccctgcgtgtgccattgcggcatcagtgtttgcggcaacggatttgagccggtccgagtcacacacaaaattatgggcccaaaatgcgcgtgtaattgttcttgtcgatacgaatgtgtataataaa

SEQ ID NO: 66389 - DNA, 245 bp, Heterodera glycines
  Genomic contig location: Contig_ID=SeqID_7923; Location=115..359; Strand=-
  SCN-specific regions: Sequence locations=1-189,211-245
tgtgcaatcacggctaccgtatctcttccattcgccgtgtgaattccgcccatcaacgaaaaggaatcgttttgggatcatttgccattgagtgccaaccgattgtttcctcgggaaaaacaaatttaaaagtaggaaatggggaaaacaaagaagagagaaatggaagaaaaagaaacaatacacccaaatgtcaaataatttacataaaaaccctcgcatggagcgacggatttgacttttag

SEQ ID NO: 66390 - DNA, 325 bp, Heterodera glycines
  Genomic contig location: Contig_ID=SeqID_37282; Location=1..325; Strand=-
  SCN-specific regions: Sequence locations=1-234,269-325
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaagaaaaattttttaaaaaattttttctccatcttcctcctagtggggaaagcatcagagtgctaaaattaagtttaaataaa

SEQ ID NO: 66391 - DNA, 518 bp, Heterodera glycines
  Genomic contig location: Contig_ID=SeqID_37284; Location=127..644; Strand=-
  SCN-specific regions: Sequence locations=1-151,173-262,284-518
atgttccccggcgacgatgggtacgaatcggaagatgacgaaattcacttgccgcctccgccgatcccgccgcaaattgaccaccctccaccaaatgtgctggtaattttggtcttgctttttgtcagtttttttcaaaatcccgagtgtattttttaggaaattcgtgtgggaccaattcatgatgggcaacaaccaatgccgctgagagttttgccgcaaattgtacatcggccactaaattttccggtaatttgggctcgcttttggttgttttttctcaatttcccgagtccttttttcaggccgttcgtgtccaaccagttcaacaaccgataccactgagagacgtgccgctatttgtcaacccaccaccaaatgtgccggtaattttggctcgcttttgttacttttttttcaagattccgaatgtattttttcaggtaattcgtgtccaaccgatgcctcaaccgttgccgctgagagacatgccgcaaattcaccatccaccgcgaaat

SEQ ID NO: 66392 - DNA, 481 bp, Heterodera glycines
  Genomic contig location: Contig_ID=SeqID_37285; Location=593..1073; Strand=-
  SCN-specific regions: Sequence locations=1-168,190-321,348-430,473-481
tcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 66393 - DNA, 65 bp, Heterodera glycines; identical to SEQ ID NO: 54797
  Genomic contig location: Contig_ID=SeqID_37286; Location=451..515; Strand=+
  SCN-specific regions: Sequence locations=1-65

SEQ ID NO: 66394 - DNA, 438 bp, Heterodera glycines
  Genomic contig location: Contig_ID=SeqID_37288; Location=717..1154; Strand=-
  SCN-specific regions: Sequence locations=1-313,336-438
atgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatatacccccccccccccccccccccctaatatttcaggtgacttacagtgtcatcgctgacaacgcgcacatccccctcggcaataccgtcgcttccgcctaaatttataaagattgtgatcgaataaa

SEQ ID NO: 66395 - DNA, 109 bp, Heterodera glycines
  Genomic contig location: Contig_ID=SeqID_37289; Location=515..623; Strand=-
  SCN-specific regions: Sequence locations=1-109
gcccgcactgctcgccgaactgatggccaacgaatgaggagggatgagaaggaagtgtgcgcaatccaagcggaagatgaaaatattgtggatgaaataaatattcatt

SEQ ID NO: 66396 - DNA, 184 bp, Heterodera glycines
  misc_feature (129)..(129): n is a, c, g, or t
  misc_feature (161)..(161): n is a, c, g, or t
  Genomic contig location: Contig_ID=SeqID_37291; Location=1191..1374; Strand=+
  SCN-specific regions: Sequence locations=1-184
atggcttctcaaccgccaaatttggttgaagagacagaaaaacccattattgatgtaaccaaggcaaaggaatggaggagtgctgaagacggtgttgaaacagggcgaagacccgaaaattcatccggncaagggcgattgttgctacgtccattacgtgngcaccatcaaagaaagcgaaaaa

SEQ ID NO: 66397 - DNA, 1966 bp, Heterodera glycines
  Genomic contig location: Contig_ID=SeqID_7924; Location=55..2020; Strand=+
  SCN-specific regions: Sequence locations=1-87,109-187,220-281,303 -344,435-549,592-881,911-981,1011-1966
atggacgtgtgggatttcggggcattggcacttttccacaaaattggcaccaaaaatgttgtgcttacacacaatttcccgatcatgtcacacatgtacaaatacatggaagaagcaggatggcaaactgagaatagcgaattatttaactaccaaaaacaaatattgggcaagggagtgccaggtgaaaaaattaattattacttattttaaaataaacataccgtatttcctgaaataaagcccccaagggctttatttttcaaccttcaaaagagggcttttttctggggtggggcactattcggggagggaggggactgtattatcggaaatacggtaagtaaattataaattaattaatgaaatataattaaaaattataaataaacaaataaaactattttacattttactaataaactatatttttacagaactgttctcagcagtcattaacgacaaaaatgttggaaaagctggtgcatacaaggaaaagcataacgaaagttcggatattttctcaaaagtttatgaaattgctgtaagtttattttaatcaaaattaatataatttatttttctttttaaggatcaaaaattcaaggaccttttcacggacaatgcatttcctactctggaacaattgttcagagatgcaaaagctttgttcgtcaacacaaggcctttattggattatgacattggcagtttgccaaaacgcgtcaaattcattggtggcattgatctgatgcagcccgatcacaaggatgtaatactatacagtagtaaaacagtatacacagattaagaaaatcccatatgaaacatttgaaaaatttaaatccgagtctattccttatttctcttaaattaaaagcaaataatttttaagaaattgaaaacagtatcataataaaaatgatttgaaatttcgaaaattttcagcaaatcacgcgatgccgaaaactcagaaaaacgatattataattgtaatatttaaataatttccctaaaaattaaggctttaccgcaagtttttgggcaacaaaaaccggtgatcgtgttcagcatgagttctttactagaaccatccaaaatgccattggacaaatttgaggcggttattcaaggacttggaatgtgtaaagaaaaggaagtgatttggaaatatgcgaaacaggaggataatggtcggaagtcattcttgcaaatgcatgctcctaatgtgcatcttgtggagcattacgatcaagccacagttattggtctgtaaattttatgtccatcaaaaaaatgccatggcatggttaggctaatctaggctaatccaccacggccggcgcaaaattcaaaaatttggaatttaaatttaccatttttattggcaaatttaatgaaaaatttcaaaaaattttccgatgggcttgggtcaaccgattctttacgttttttcaatttttagcccccccccccccgtaaaatacagtatggctggcctctgtctacggtatcatattgtaaaagtgtgccaccattttcaggcaatgaaaagacggaattggtgatcagcgaatgcgatattcgtatcgtaatggatgcgttaagcagtggaaaagcattgctttgtctgccgatgtttgccgaacagttttatgtgtcggaaaagctgcgacgcatgggcgctgcggttgtgcttgatccgcgcagtgacagtttcaccccggaggggattttcaaaagtatcggcgaagcattgacaaagcggtaatgtgcgcgcaaaatccttataatgatactttataggagagttgctcgagttttcggctctaaagtcgaggaatttctcggctttttagggtcgagagtcgcgactctcggggtcaatgactctcgggctcaatcccaagtcttggaaaattacgactcctcactctcgagcagtcctaataatttgttgtattag

SEQ ID NO: 66398 - DNA, 979 bp, Heterodera glycines
  Genomic contig location: Contig_ID=SeqID_7926; Location=766..1744; Strand=+
  SCN-specific regions: Sequence locations=1-87,110-703,725-900,929 -952,974-979
atggccaattttgatgatgttttggcactgtgcagtcaccataaggtggtgccaattgttcgcgcaaatgcgatgggtgcaagcagcaaatttggctcacagcaacagcgcggtttctaccacacactgttgcgcgaaatggccaacaaatatggcaaatcggcaacacaggtggcaacaggcactcactgattgccaattaagaaacaattaaaattttcttttagtataaatattttcataaaatgctatgaaataatgggtgaattttttgagtatcaattttcataaatttgaaattgaccggaaaatgctgtatggcaaatgagcaaaaaaaaggtcaaaaccaggaaagtgtgccgactccctcaaaaaatttcggcaatcggaaattgtgacgactgaaaaaatttcggccggaattccgagtcccaaaatgtcgtaaatcagcattccggcaaatctcgagttattttctggcaacagggcctagtctaattaatcatttcgtcagcaggtgttatgccgatggttgcaccaacatggcatggcggtagtgtgcagttgtggcccaacaactcaaattggccaacaaacgaacattttcgattttggcataagcaacgaagacatgcgacgcttgaatagcttgtacaacagaaatgtcattgcgcggccatatcagtaaattaaattcaaaaataattacttaatttcattttaaatcacaaattaatggaagaattattggtaaaatttttcgatttaaaatttcattaatttgcatccaatagcaaccgatcttttttgtggcctttaatgaatgaataatgctttaagaattttgagtgtattataagtcaacaatgaacacaatgcttaagcccatttatttatgagtattttacaaaaaaaaaaatttaaatatgtcaaaagaagccgaaaacaaattttgtattatttcatgggcattgaggta

SEQ ID NO: 66399 - DNA, 247 bp, Heterodera glycines; identical to SEQ ID NO: 62022
  Genomic contig location: Contig_ID=SeqID_37292; Location=925..1171; Strand=+
  SCN-specific regions: Sequence locations=1-217,239-247

SEQ ID NO: 66400 - DNA, 76 bp, Heterodera glycines; identical to SEQ ID NO: 51235
  Genomic contig location: Contig_ID=SeqID_37292; Location=569..644; Strand=+
  SCN-specific regions: Sequence locations=1-76

SEQ ID NO: 66401 - DNA, 193 bp, Heterodera glycines; identical to SEQ ID NO: 61360
  Genomic contig location: Contig_ID=SeqID_37293; Location=413..605; Strand=-
  SCN-specific regions: Sequence locations=1-193

SEQ ID NO: 66402 - DNA, 163 bp, Heterodera glycines
  Genomic contig location: Contig_ID=SeqID_37294; Location=535..697; Strand=-
  SCN-specific regions: Sequence locations=1-40,64-163
ccaaaatttttcaaaatttataaaaacaaaatgagtctaatttaggatttttagggttttcggggtcgctgaatacgaatataccatttatattaccccttgcctaaccttaggcccatctgaataataaaaaactcaaattcgagacttggacatttcgtgg

SEQ ID NO: 66403 - DNA, 1069 bp, Heterodera glycines
  Genomic contig location: Contig_ID=SeqID_37301; Location=141..1209; Strand=+
  SCN-specific regions: Sequence locations=1-170,206-361,401-475,497 -585,607-625,647-742,766-907,930-1069
cgattcacgtcaaaaagctgctcattcgacggccaacaacaatttggtcagaatttataaaatattcaattagcgtatccaaaattttcgtctatgtaaaaaaacaggtataaaattagttttttataatcctagaggtcataatcagcattaaatagtgattgtaattcataatttgaattttttttttaatgattaattattagagcccggaattttgaaagtaccgggacttttcgcaccataaaataattttttgaaaatttgaattttcgaatttttgttagaatacggatccggggttcgaatttagtcgaaatggatgtcagattcgtgatcagcgaccccgaaaacccccttgaaatttttttataagatttataaatattttattttttatggtctgtaaaatgcgtaagtgccgcgatttgttaacagatttatcaaaaaattaccaaattttgccagaaataacttttttctttaccaataaaatccaacatagttggtatcattcgaaagcttaaagtgtttagaagcttttcctaagctattgcttcgcgattagacaattactaaaaaaactaaacattaaaattgcaaaaagtcgaaatttttaagttttttcataactacagttcctctggttcccaaacccattatcacttgatggggcacttggcttgatgccgtcaacttttactctcacaatttcgaagccattaaagaagtgaatgaattgatttaagtaattaattttaaaaattcgcaggtcgtcgattcatttgaccctgaggaggcccagtgtattgccaaatctcagaaatgcttttcgatggcaacagtgctccttgacattgcctacattgaagcaaattttggatgtctccccggggcaatcactcgtttggagaagaaagggtttacaatacacgaatctgccaacaatctgtgtgaagtccgtgaagatgtcttttcgtttacgggagaaattggagcgaaaatccgtcggaaattcgatagcgttatcgcaaaaaacccgggatttgatacaatttgtgatatttga

SEQ ID NO: 66404 - DNA, 742 bp, Heterodera glycines
  Genomic contig location: Contig_ID=SeqID_7927; Location=2964..3705; Strand=-
  SCN-specific regions: Sequence locations=1-299,342-521,543-742
attcttccgggcattgttctcactaaaatgtcacaggaagtcacacacttagaaaaaccgggcttttttagtccgacacccgaaaagtttgtcaattcggcacttcgtacagtaggacatgccgacgaaactaccggatgctttgcccatcaaattcaggcaattttattttgtcggttatttttagggaatcaaacataatttttaacttggttttgaagcttctaggacgtatttctaaatatatattttgcaatttgatctctaatttgtaaggccaaaaaatggatattttctcgaaatattaatagaaatttaacttattaaatttgaaaatttatgccaaaaataattcaaaaaatggaaaaattcaatttttttattcaaaactacgaattacgtttttctaaatgcttttcatacaaatttagctagttgaatttaaccaatttgaaaaattttagaaaatttttgcttaatttgtaaaaaattatttgcatatttttcactttgtggtggtgttgaaaagcatcagcagagcacacaaatcggctgatgatttacgttcagcaatttattaaaatgttcagactgagatggccatgatgatgccaaattggatgttcgaaattgcatcaaagctgcaaatcaaaagcattgaaaagaaaaatagaggaaattcctgagaaaacatttccataaaaacattatttttttatggctgtcgcatgtgctgaataaa

SEQ ID NO: 66405 - DNA, 108 bp, Heterodera glycines
  Genomic contig location: Contig_ID=SeqID_7927; Location=1362..1469; Strand=-
  SCN-specific regions: Sequence locations=1-108
ataaaagtcaacgtagaagcctcaaaccaagtggaaaatgtgttatttatgcttaatatgtcgaaactagtgcgcagaaaaaaaggcatatgcctcaaaagtcggtct

SEQ ID NO: 66406 - DNA, 901 bp, Heterodera glycines
  Genomic contig location: Contig_ID=SeqID_37302; Location=519..1419; Strand=+
  SCN-specific regions: Sequence locations=1-52,104-137,369-401,445 -549,571-871,894-901
atgaaatcatttagttggaaccagacgaattggacggtacgaccgtggaagactttttttcttttatcctttctctctatattccttatccttttctctttctcatccatctctctccgctctccatatcactttgttctttctctctctctatctatctcttctctctatccctctttcgctttctctatctatcattttgtctttttctctctattcctctctttcttccctcatttttgtttttttctttccttttttctcttcaacgctcttcctttctctctcgctctctctcgccttctctctccctctctctattttcttttttcctttttctctctccctccttctctttatttctcttttaggaaggaatcaacttataaaaacttgatctgaatttttttttcattgttaaaaacatttttaaaaataaaatttggcattcactgtcgtaatattgataattttttatatcatattttatggatcattttcagatgtttttcctcatccgtgcaacgaaattttcaattcaacaccgaaatttggtcctccttttcatgacaacaatggctcaacagcagaaagcgcatttcacgacttttatggaaagcgtagttttgggaataatatgtgcaaatgacagtgtcaaaacggcggagacacagagatgaaatatttttgtgtttaatttttttttctattttttttgacctaaatttatatatcgtggaatttgccataaatttcactaattttttttttgtgacacaatatgtttaaaaggaagaatacggagtttctgatagttggatttaaaaaacggcattttggacacccgaaggaaaactggacaccatattcctaaaataagccaggaattagggttgaaaaa

SEQ ID NO: 66407 - DNA, 917 bp, Heterodera glycines; identical to SEQ ID NO: 37304
  misc_feature (867)..(867): n is a, c, g, or t
  Genomic contig location: Contig_ID=SeqID_37304; Location=1..917; Strand=+
  SCN-specific regions: Sequence locations=1-10,69-237,259-430,452 -708,730-844,867-917

SEQ ID NO: 66408 - DNA, 631 bp, Heterodera glycines
  Genomic contig location: Contig_ID=SeqID_37307; Location=88..718; Strand=-
  SCN-specific regions: Sequence locations=1-127,164-213,242-580,603-631
  Gene Ontology: Biological process=N-linked glycosylation
atgcaaaatcccttttccacgagaaagccgaaatttcagattcgtaaacaacttttgtctttgatcgatgccgcttatgagctgaacaaaatatccattttcttttttgattcaaaattcagtgaagaaaataaatataaattgaaaaatttattcaaaaattcaaatggaccggagctgctaaatgaggaggaattgaactataaaataaatgaggaggagaaagaggaggaggaggaggtgaaagaatcgaaggaaaaaatggaagcaaaaagtgccaaaaaaccggaggaacgaattaaaggacaaagtgccatagaattggaccagagaatcaaagaaaaaagtgccaaaaaccaggagcagagaatgaagggacaaagtgccaaagaatcgaaggaaaaaatgaaagaacaaagtgccaaaaaaccagaggagagattgaaaggaaaaaatgccaaaaacccggaggagagaagcaaagaacaaagtgccaaaatatttcccgataaaattacaaaaaaagttaaaagaaaaacgaatgaaaaaattggcaaaaaagttgaaaaaaaatcaacggaagagaaaaaggacgacaacaaagcaaaagaacgaatcaacaaaaaaggag

SEQ ID NO: 66409 - DNA, 353 bp, Heterodera glycines
  Genomic contig location: Contig_ID=SeqID_7929; Location=136..488; Strand=+
  SCN-specific regions: Sequence locations=1-264,286-353
atgccacaaaagccaaccgcagcgaccaaagagccgttggacaaaaaggtaaagttggcatcgaaacctaaaggaatgtgccgaagaaccaaagccatgggcaattttgaaacacctgtcaaacgcagcgtaacaaagagaccaagcgcagcgaggacgagcacttcggagagcaaatgggacaatttacggcccaaccatttgaatttgaggtcggcaaaggcaatggccaagttcatcgtgtatttgaacatgcccatccaaatcatattcaggaaaatgttgcccgacatcttctcgatgttgtagacaagggcataagtgatcagagtgaccacgaaaagactgaatga

SEQ ID NO: 66410 - DNA, 1381 bp, Heterodera glycines
  Genomic contig location: Contig_ID=SeqID_7929; Location=1..1381; Strand=-
  SCN-specific regions: Sequence locations=1-25,47-633,655-795,817 -862,885-961,983-1304,1326-1381
  Gene Ontology: Mol. function=organic cation porter activity; Cellular component=integral to plasma membrane; Biological process=organic cation transport
cagcaaaaggacagaattgaagttgagtcagtccctgcagttggtcggcattatccccggctctttcgtcttcggttggctcagcgatttgtacggccgtcgtctgaccatgctcagcgcgttggtcctttgggtgttcgccatgttggccacgtccttttccgcttcgctggtcattttcactgtgctccgtttcgtcgtctgttttttcaacgcgggcattgccgtcactttgatcgttttcacctccgaattgtacccaaaaaagcatcggttctgcctcatgaatttgatcacttgggtacgttttgcatttgtcttttcttttcgacaaaatgttgtctttccccccacccccaccaaatgtgccatttcgatttcactttttttaccgtttgttttccccacaggcgcccaattacattctcttcggcattttggccagcttcatccccaattggcaacaccttcaacgcgtgttggcactcttcgcattgccttgcatgggtctcattcttttcctcagcgaatcgccccgttttttgatcagtgcacgtaaaatgaaagaggcgaaagaggccatcattcgaatgcataaattcgacggcaagaaaattatttgtttatacaaatttcaatttttaaattttcagggcgtccgtatgacgaaaaggcgttggacgcactgcttgaaaaggagctacaacaaatgttggaactttccgtcactaaaaagaagtacaattatgtgagttatccgacaaatcatactaaaagacaataacatttttcaatttccatccccaaatggccacttttccgtcattggcactttgtccctttagctgcacctcttctacaacaccaaattcaccatgtacactttgtcagtgtcattcagtcttttcgtggtcactctgatcacttatgcccttgtctacaacatcgagaagatgtcgggcaacattttcctgaatatgatttggatgggcatgttcaaatacacgatgaacttggccattgcctttgccgacctcaaattcaaatggttgggccgtaaattgtcccatttgctctccgaagtgctcgtcctcgctgcgcttggtctctttgttacgctgcgtttgacaggtgtttcaaaattgcccatggctttggttcttcggcacattcctttaggtttcgatgccaactttacctttttgtccaacggctctttggtcgctgcggttggcttttgtggcattttgttcaactcggacaaattggccggcagcgaactgttccccaccggagtgcgcaatttgtcctgctcctttggccaaatttgcagccgaattggcgtcgtcggcgccccaatgcttttctttttggtccgctt

SEQ ID NO: 66411 - DNA, 312 bp, Heterodera glycines
  Genomic contig location: Contig_ID=SeqID_7930; Location=126..437; Strand=-
  SCN-specific regions: Sequence locations=1-312
atgagtaataatttggccgacaaaattagcggcgacgagaggccaaaagaggcgacggaaacaaagccgcttctgtcggatggcattgccggggaaggcattcacggacagtcccaaagggatgggacagcaaaagcggacttagtgaacgacgcggaaaggacggaggaggacgagcggaaggaagacgacctgaagctggacgactgcttccgcatgggctggtacatgctcatcgtctgcactctctctcaattgctcctttttgttgaggtcggccagcaaaagccaattcctccaatttgccaatga

SEQ ID NO: 66412 - DNA, 2292 bp, Heterodera glycines
  Genomic contig location: Contig_ID=SeqID_7930; Location=1873..4164; Strand=-
  SCN-specific regions: Sequence locations=1-1306,1328-1380,1476 -1568,1619-1807,1847-2048,2070-2102,2191-2292
  Gene Ontology: Mol. function=zinc ion transporter activity; Cellular component=integral to plasma membrane; Biological process=zinc ion transport
tcggcggaaaagcaccgcatggactctgacgcttctttcgtgcttcgcgggcggagtgttcatgggcacttgcttccttgacattttcccgcatataaagtcattttggcattggcatttggttgaaatggcaaatgtttgcaaatttagtgaacactacgaacatttccgtgataagtcccaatgggaaattgaattccctctgccccaatttttcatttgctgcggctttttcctcgtttatttgttggaagaactcattttgaaggtgttcgcctccaggttttattatttggtcagaaaaatgcatatttccacccgttcagtgagcaacgcaaacagaagcaagccttggccaaatttggtgccaatttggccaatgttgagcagctccgttccgccgccctttccgcctgctctaagccggactgtgccatcggcgcaaactccgccaacgaatcggtgaacaactcgctgaagccatgcccttcctgcttggacatgctcacccacgagtgcgtgacaattggctatatttggggtgatcccctgctttcaggacagtgatcaacaaatatctgaacagttcggaaaagtcggaaaaggttggtgatcagcaactggggagagcattaatccccacttttgtgctccaggtggacttgttgaagtcgttcacctttgcttttgccatttcgttccactccgtgctcgaggggttggccatgggttttcaggtgggttcggatggttttcgggtcattgactgtttttaggaaactcccaccggaattacgactttgttcttttcgctgatcatccacaaggccatcgaagcattcagtgtcggccttcaattgagtaagtcgcgcagcaacagtttggtgtgctgtttgatcagcgcctacgctctaatgactcccctgggggcgatatttggcgacttcattacggtgagtttaattgaactgattaaatattcatgaattaagcattgaaattaagactctgaacatggacgagatcaaaaaggaagccatcataatcattctcgagtctttggctggtggcacttttatttatgtgacttttttggaagtgctcgcgcatgaaagggccaaagaacactcgcatttggttaatcagttgcaatttgcaaccaactgaatggcactttccctctgatcagatccaactcggcgccattttcctcggtttcctcgtaattaatgcgctgcaactttacgagcagctgaccaattcggggtataaacaatttgtgaatcccttaataaaagttaattagccatcatcaccatcaccactgaatgaatgaattgaatcgtccaattccaaggagcgaatttatcaaaagcgggcaatatatttattattttaattgtttttataataaatttaaaatgaatatatttgtacaaacttttttatttttttaagaaataaagaaaaatattgcaagtgatttttgctattgttttcaaatttttcaataaaaaaagaataaataaaaatacgcactaaatattttttaaaattgaatgtgaatattttccaattgattcttttagtctctcttttttattaatgataaatatttgtgaatgtgctgtattaaaagttatttattctattttcttaataattgatcaaattcgcattcgctataaaattacttacaattaatttatcattttttggtttacaatttttttttctctccttctgctgatcaattagttccaccttttgactaacattaatgcctgcactttaactaatgatgacgaatcagttaattaattagtgaatgaatcaattaattaatgaacccgtggctgtgccgcgtcatcggctgaacttcggaagtaattttattgtgcaaataaaaagcacgaggcaaaagtgagtgaatcgatgagcgatgaatgtcacggcttacgattagcgacgcattgggcgctggtcacagaattaatcggtgtccccccacgtgaagcgaaagaacgaacgaacaattgttggcgggaaaagattaatattaataataaaatccatcccttcgagaacagacgaaaagggaggacaaaaacggataaagagacacagggagggataaagggaggataaagcggaggaagggacagagagagggataaagggagagacagaatgaatggccattggcacagcaaaagcgaaaggaaaagcgatgagtcatccgtccgaagaatgcctttgcatcccaacactttccctaagcagcagatggca

SEQ ID NO: 66413 - DNA, 101 bp, Heterodera glycines
  Genomic contig location: Contig_ID=SeqID_37315; Location=1312..1412; Strand=-
  SCN-specific regions: Sequence locations=1-101
ggattcggtctccccataaatctgggcgcatcggttcggggggactgccccgaaaacaaaaaaatcgattttttcaagtgtccgtttggggtactcaaaca

SEQ ID NO: 66414 - DNA, 544 bp, Heterodera glycines
  Genomic contig location: Contig_ID=SeqID_37316; Location=149..692; Strand=+
  SCN-specific regions: Sequence locations=1-544
  Gene Ontology: Cellular component=exocyst; Biological process =synaptic vesicle docking
tatgcatgaaatcttcgcccgtcttcagtccattccatcggcgagaattaaactaaaggaactgagcaaagcgaacagtcagcacagccaatacgcaatagcaatggacaatatcaaacacatttgcaatttggctgacactatcgaaaaaacgcacgagtcggtcatttgttactaaatgaaacaaggatttaaaagtgattttcagctttatactcgacgggaaacttttacttgctcataaaaatgtgatggagttggagaatgccagggatgacttaatgtttgaagtgcacaaattgaactctgaacgcagagaatacgacaaaaatgcactgttttttcatctttttcataacaataactcgttttttatgtttagttgctcaaaacctatttttccgatgtggacaaacttatcgaagacttgggcaaacagatttggtacatttgttctcgagctttggaagcagttcagggcaatgacagcgctctgcaacagttggtctccgcgttgcgaataattgagcgtgaagaacggtag

SEQ ID NO: 66415 - DNA, 632 bp, Heterodera glycines
  Genomic contig location: Contig_ID=SeqID_37317; Location=1..632; Strand=+
  SCN-specific regions: Sequence locations=1-632
cattccaatcactgggcactcaacccaccaacatccctataaagtggcactcaacccaccaacatttcaatcactggggactcaacccaccaacatttcaatcactggcactcaacccaccaacatttcaatcactggcactcaacccaccaacatttcaatcactgggactcaacccaccaacatttcaatcactggcactcaacccaccaacatttcaatcactggcactcaacccaccaacatttcaatcactggcactcaacccaccaacatttcaatcactggcactcaacccaccaacatttcaatcactggcactcaacccaccaacatttcaatcactggcactcaacccaccaacatttcaatcactgggactcaacccaccaacatttcaatcactggcactcaacccaccaacatttcaatcactgggactcaacccaccaacatttcaatcactggcactcaacccaccaacatttcaatcactggcactcaacccaccaacatttcaatcactgggactcaacccaccaacatttcaatcactggcactcaactctcctgcatttcaatcactgggactcaacccaccaacatttcaatcactgggactcaacccaaga

SEQ ID NO: 66416 - DNA, 785 bp, Heterodera glycines
  Genomic contig location: Contig_ID=SeqID_37319; Location=249..1033; Strand=+
  SCN-specific regions: Sequence locations=1-785
atgcacccaacggagattccgaggcaaatgcatcaacagccaccaagagaagagcgtggatggcagcaacaaaacagtgttttgtaccgtccagtggcgcgacagcagcaaaattttccggtttacgaaaaccaaatgctgccaccccaaagccaaaatttagcggttttaagtagtctggagtacaatatggtccttgaaaggatcccagacctcaacggaaaggaagggacggacgaagttaagcgttttttcaaaaaattcgacgcttacaccgacagttggccggatgaaaaaagaattaagggaatagaaagcaaagtgtatggccgagctgaaagagcttttgaagcggcgaaagcagtcattccaataaggtatgaactgcttcggggtgaaatgatgcgacagttggaggaaacggactcaaaaaacttgaatgcttttgatgagctgatgttaggagtccgacgaaaacccaacgaatcgattgatgatttggcaggtcgaatttcggggttggtgaagagagcctaccctggtctttctttccaattgtcagacgaattctccatcaaatatttgatccgatcaattggtgacccaactttgtcacttaatttggaactcattcgaattatcaacaattttgagaagtgagttagaaatgataaacttcacgattcaaaccagttttcggtgctctatttaaccgcgataaaaacatccgaatcaattaaatagcttctgagataataaggtttatcataaaatttcatttaaaa

SEQ ID NO: 66417 - DNA, 593 bp, Heterodera glycines
  Genomic contig location: Contig_ID=SeqID_37321; Location=931..1523; Strand=+
  SCN-specific regions: Sequence locations=1-593
  Gene Ontology: Mol. function=pre-mRNA splicing factor activity; Cellular component=nucleus; Biological process=intracellular protein transport
aaatggaccgcaaatgtcggggccgcaaatgtcgggccgcaaaaatcgggccgcaaaagtctggaccgcaaatgtcggggccgcaaatgtcgggccgcaaaagtcgggccgcaaaagtctggaccgcaaatgtctggaccgcaaatgtcggggccgcaaatgtcggggccgcaaatgtcgggccgcaaaagtcgggccgcaaaagtctggaccgcaaatgtcggggccgcaaatgtcgggccgcaaaagtcgggccgcaaaagtctggaccgcaaatgtctggaccgcaaatgtcggggccgcaaaagtctggaccgcaaatgtctggaccgcaaatgtcgggccgcaaaagtctggaccgcaaatgtctggaccgcaaatgtcggggccgcaaatgtcgggccgcaaaagtcgggccgcaaaagtctggaccgcaaatgtcggggccgcaaatgtcggggccgcaaatgtcgggccgcaaaagtcgggccgcaaaagtctggaccgcaaatgtcggggccgcaaatgtcgggccgcaaaagtcgggccgcaaatgtctggaccgcaaatgtcggggccgcaaatgtcggggc

SEQ ID NO: 66418 - DNA, 4399 bp, Heterodera glycines
  Genomic contig location: Contig_ID=SeqID_1029; Location=997..5395; Strand=+
  SCN-specific regions: Sequence locations=1-292,574-629,652-1347,1370 -1400,1423-1788,1810-1878,1900-2599,2621-3210,3232-3352,3376 -3416,3438-3830,3852-4071,4093-4224,4246-4399
atgaagcgaaaagtgcggatgtttggagttgcaattacgggtgccgggcttgctttcccggtgtgggtgccgtatcgggcgtacccccagaataatgcggatgttatcatggaggagattaatgagctggggcagagcggggacggggatgaaaataagaaaatgcttttattatctgaaccgattactatgaaaattacatgcgttacaatgcccagtggagaggggccgaggaatgtccacaaatttgactttggattcaaggaacaccagcggatagggtaagtgttttaataaaataaaattaaaatagaaaaaaaatcaataaataaatttaaaataattatttctaaaaattttaatgaagcaaaaaaaactttttttttaaaaaaaaaaatgaaaaaataataatttaatgaaacaaaaaaaacagaataaaattaaaaataaagaaagtaaaaaataaatttaaaataattattttaaaaaattttaatgaaacaaaaaaaaaataaacttaaaatatttatttttaaataatttaattaggtaaaaaaaaaaaagtaaattttaggattgtgaatactgataaattttgccttttttacgcactggcgtcgtcgatgaattatttaattatggataaatattcgtttattcgttttatgaagaacttagcaagacaaaaggaagcggctgttgaacttttacggaattgtagaattgatggaaacgaaattagttatggtgtggagcaattgccgaatgttcagaaatattgggtgggtttaaaaacggtgaaaaacatagaaatgaccaatttttcaggatgagatttaccccggaaagtaccgggttgttgcgtttgagaagtcagctgatccgcggaaatcgatctgtgttttgtggaaggcccctatgggacgagagaaggtcgtaccgatatttttggagaatggtcactgggatggtctgaagaattacgtctgtttttttaatcgtgggagaaaattttgtattgattgtgagtgcttttttgacaaggatgtcaaacatactttcgagtgccgggcaaggtgttattattgcaatagagtgaggggaatgccatgtgaaaaggagagtggagtgaagattgaatgcccgaagtgtcatcgttacttttacaattgggagtgttataattatcatcagggacatcagacttgcaaattatggaggcgttgcgtgatctgtgacaagacttatcgatttaacccgaagaagggacatgaatgcggagagacttattgccagctttgtagtgtgagccacgaccccaagcggggttgctatattataccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatgttattaattatatttcggtgagagttacgtgtacggaatgctgtgatgacaaaaacaggacgaattgcaaaatttgtggggaggagaggatcaaggattggagcgaggcagagggacatgagccgaccaaggattttgtggagtggattttaactgcttttacgaattacgatacgtacatatttgcacataacgccggacgttttgacggtaatttcaaaatttaatttttaaatcctaaatttttaggtcattttgtttttaattacctctgccgtaccgggaagaacccgttaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccttgttattacaacaagaaagaaaattatggaatacgattggaacatctgccaccgatggaggactattcgccgggatctatgaacaaggataaatttataaaattcgaaaaatggtaggaaaatagaaaaatttttgaataaaattctttttttttcaggtacaatgagaacaaggagacgcccttttatttggatgaagaattgagaaattattgcagaaacgacacggagattttattgttgtcgattattgagtttcgaaggatattgattaacgacattactaagggatttgacccactaccgaggagttgtacgaatgcgggggttgcgatgaatatttttaaggcaatgtttttattgacggagcagttatcgattgtgccggagaagggatatgagcggtgtgatcgcgccagtgtgatggcaataaagtatttggagtggcggagccagcgggatcgaattgagatacggcacgcggggaacggacgagaagttaaaattgggaattacaaattggatggatttattgcgaataacggagctagggacaaatgcatcgaggttatgggatgttacatacatggatgtttgaattgttatgacccggcggcggaactgattggaggaaggacggcccaggaattgaacgatgagactcaggagagattagtggagctacggaagactttggatgtcgaagaagtttgggtatgtttatttgacatttacatttttattgtgaatttttaggggtgtcaaattgagaaggaattgaaaaaggatgaggaaatgaggggcttcttcgacgacagaggaaatgagaaggggccgattgatccgaggatggcatatgcgggagggaggaccggaccgatgaaattgtttgcgaaatcggatgagaagaaaaagattagtgtttacgatattgtgagtctgtatccgtcagtgaattacggtacagcttacccgattggtttgccggagattattataccgaagagcgatgagattaatgtaaattggacgagaccggaggatttgaagtttaatggattgtataaagtgagggtccacccgccgcgagggttgcggattccggttctgcagttgaagtgtgatgagagattattattcccgttgtgttggagatgtgcgtcaacatttaagaaggaaactacgagatgtgattacaattgcccccatgatgaggcacagcggagatacgtggcgacatatactagcgttgaattggtaagaacttatgtgggaaaattttaggaaaattttgacatttttcaggcaaaggcgttggaatgcggttatactgtggacagattttatagagcgtggcactacgaagaggaggcggatgatttattcaagggatacgtgcgattatttttgaagctgaaggaggaggcgagcagttttccgaaaggggttgagacggatgagcaaaagaatatttggagagaagagtataaggaaaaatatggaatcgacattgaattggctaaagttaagaagaatccaggattgcggtacataagcaagttgatgctaaatagcttatgggtaagatttagggttttccgaaagagttttaacttaaaattttagggaaagttttcgatgagaaattgtttgaacaagaatgcggtgattgatagggcgtcggagttttataaaatagcgtgtgaccataaaattgaattatgtgatattgttgaatattcggaagaggcgattagattgatatacagggacaaggaggactttgtgatggagcacaagtcgagcaacatagtcattagcttatggtgagttcaaaaaattataaatttgtatataacctaatttttaggacgacgagtatggcgaggttaaaattattggaatttatgagggaggctgaaagcaacggaggggaaattttgtatacggacactgacagtatttttgttttgcacgatcgggatgtggagccgatcacgacggggaaatatttgggagagatgagcgaggaatacggcggctatgagattgaagaatattgctgtggaggggcgaagcagtacgcactgaagatgagaagcaagcagacgggggagactgaatacgttatgaaaattagaggaattacgttcgacgtggacaacaggaaaacattgcactacgatacattcagggagatggttttgaattatgggaaaggggaggtggacccggcattcttcgtctataagaatgattttgggtgagttttgtaaaaattatttgcttcattaataaatcaatttttaggccgacaagggattcgaaagtggtgacgagggagaagcataaaatgtacaggccggtctgtcagaagggtatcatcgatgaggagcttaatgtgatgccatttggattttgttaattttgtattttattgttgtttttttttgttaa

SEQ ID NO: 66419 - DNA, 813 bp, Heterodera glycines
  Genomic contig location: Contig_ID=SeqID_7931; Location=179..991; Strand=+
  SCN-specific regions: Sequence locations=1-196,232-647,670-813
atgagaaattgtttgaacaagaatgcggtgatagatagggcgtcggagttttataaaatagcgtgtgaccataaaattgagatgtgtgatattgttgaatattcggatgacgcgattagattgatatacagggacaaggaggactttgtgttggaacacaagtcgagcaacataatcatcagtttatggtgagttcaaaaaattataaatttgtatataacataatttttaggacgacgagtatggcgaggttaaaattattggaattcatgagagaagcggagagccatggcggggaaattttgtatacggacacggacagcatttttgttttgcacgatagggaagtggagccgatcacgacggggaaatttttgggacagatgagcgaggagtacggtggctatgagattgaagaatattgttgcggaggagcgaagcagtacgcgttgaagatgaaaaacaagcagacgggggagactgaatacgttatgaaaattcgggggattacattcgacgtggacaacaggaaaacattgcactacgatacattcagggagatggttttgaattatgggaaaggggaggtagacccggcattcttcgtctacaaaaatgattttgggtacgttttaaaaattatttgcttcattaataaaccaatatttaggccaacgcgggattcaaaagtggtgacgagggagaagcacaaaatgtacaagccggtctgccagaaggggataatcgatgaagaacttaatgtgatgccatttggattttgttaatttgtattttattgtttttttttgttaa

SEQ ID NO: 66420 - DNA, 141 bp, Heterodera glycines
  Genomic contig location: Contig_ID=SeqID_7932; Location=1569..1709; Strand=-
  SCN-specific regions: Sequence locations=1-24,46-141
atggacgacggtgaaagaacaatgtcgatcaatatacaaaaatttgtaaacggttggtgcttcttcgtcatcccgatgacctctactctagaggacacccccggttttgaattgattcgaaacggaacgaccagcatcaag

SEQ ID NO: 66421 - DNA, 83 bp, Heterodera glycines; identical to SEQ ID NO: 62531
  Genomic contig location: Contig_ID=SeqID_37322; Location=48..130; Strand=+
  SCN-specific regions: Sequence locations=1-83

SEQ ID NO: 66422 - DNA, 287 bp, Heterodera glycines
  Genomic contig location: Contig_ID=SeqID_37323; Location=1081..1367; Strand=-
  SCN-specific regions: Sequence locations=1-287
caatttttttacaaccacttattgccaatctaatttcttgcagatttaaagccatccattgcctgccggttctcggcacagcaaagcactaatacggtgtttgacacacttcaaaaaataattcattacccaaaagttgtttacaaccacttattgccaatctaatttcttgcagatttaaagctatccattgcctgccggttctcggcacagcaaagcactaatacggtgtttgactcacttcaaaaaataattccatacccaaaagttgtttacaaccacttatt

SEQ ID NO: 66423 - DNA, 305 bp, Heterodera glycines
  Genomic contig location: Contig_ID=SeqID_37326; Location=114..418; Strand=+
  SCN-specific regions: Sequence locations=1-305
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaaagagatagacatttttctgggatagagtataaatttaaaaattccctcaaaaataaaaggtatattgcgcaccgccctccctatcatg

SEQ ID NO: 66424 - DNA, 231 bp, Heterodera glycines
  Genomic contig location: Contig_ID=SeqID_37327; Location=52..282; Strand=+
  SCN-specific regions: Sequence locations=1-196
gatacattcgcatggcacgcaatcgcaacaacaattgcggcatcgcttcccacgcctctttcccattggtctgatcggagtgaatttgttgcccttgcgctgattcagagacatttcatttgattaatcgtgcaaaatgataagataattgataatccatcagtcaatcggtcgatttccattttttatgttcgcaattttattcacatataaataaattacttattttat

SEQ ID NO: 66425 - DNA, 940 bp, Heterodera glycines
  Genomic contig location: Contig_ID=SeqID_37329; Location=315..1254; Strand=+
  SCN-specific regions: Sequence locations=1-192,215-384,406-406,432-940
atgcacattgaaagaatcagctgtgccgctcatgacctcaatttatgtgtaaaggattgcttttcaaaagaaaaagacgaaatggctcaaattttcgaaaaatgtcgaaaaattgttggaactttaaaacattcggcaaaattgatggatgatttaaaagatgttcaaggcgaacttggtctaccgaaagctaaattgcttcaagttgctaattatcaaatactcatttaattttcatttcaaaggacgtaagcacgaggtggaattcgacattacgtatgatcgaacgtatgctggaacaatcggctgctattgatgaatttttggttagaaacaggaaattcgatctgcttctaagtcaagaagaatggtccattctcaagctaattaaggcaatttagtgttcaatattttcttatgttttaaaattttaaggaacttctaaagcccaccgaagaagtctctttacattattgtaaagaaatcctctccgcccgaattccgctcgctcgaactttggtctccactttggaacgagttgatctttcagtgacaattgatggcgaaatcaaaataattaacgaagttgagcaaatgcgtacaaggctgattgaggcggttaaaaagcgttttttacaaaaagaaaataggtatatacttaaaatactattatattataaattgtatgttgagtacttttctcgaccctcgcttcaaggatcgtttttccgacgaaagtgacatattttttgcgcgcgttgcacgttttttgaaggacgaaggaacagaagaaaatgacattttggaaaatttggaggatgaagtgaattcgactcgcattttgccaccagccaagcgcgcttgttccattgtggagataatgcagaacatagccagttgtaccaaaaaaggtggtaccaaaattgcaattttgatttaa

SEQ ID NO: 66426 - DNA, 659 bp, Heterodera glycines
  Genomic contig location: Contig_ID=SeqID_37331; Location=180..838; Strand=+
  SCN-specific regions: Sequence locations=1-217,269-504,528-659
atgaacggtgattgcaccggagcggtaagtttgtctccttttaatcactaatcattgacactacctcaggcgtggcgaagaccaatccctcgctgtaaaactgttaaagagttgaatatggacgtggtcattgagtacagtgggcgagccgctgaattgaagcttattggagaagcaacaagtggatcgggcaaggacataacgaaagcaacggatgtaaaaaaaaataaaaaattgtttttatttatatttttttatagataattatgagcataacaagaagtcttgccatggctggtggacctgaacggccttggttgaactatgaagtctgtttcactttatttttagacttttttcatttttaagattgctaccccgtctgcttctgacttggaatggttcagagctaaagaacgcgaaattcgaatgaatgccgaacgaaggcagagaagcaagtgaccaaacactgggtttgaattttgtttggtatcagtgaatagaaatggaattttcaggaatgcatttgtgctttggcaacagcgttggatgagagcccaatgtgggaaatgaacgaagacgagttgaaaaagtttttcgacgattgggacgcaaaaagcgcacttcttctaccagcagccctcccgggacagaactga

SEQ ID NO: 66427 - DNA, 1326 bp, Heterodera glycines
  Genomic contig location: Contig_ID=SeqID_7934; Location=540..1865; Strand=-
  SCN-specific regions: Sequence locations=1-68,143-200,224-669,851 -1108,1151-1181,1203-1252,1289-1326
  Gene Ontology: Mol. function=DNA-directed RNA polymerase activity; Cellular component=secretory vesicle; Biological process =transcription from Pol II promoter
atgctgcttatggtcgtactttttggcttcatttcaatgggccacggcacttatcaacgaagtaagtctttaaaaatttttttttaaaattaagatattcaagattaattataagttttaaaaaatattttgttatttttttcagagttaccatcggccgaggaaagagcggaagtaaaagcatttaaaatagagctgcacgggaccgggaccggggcggaaaatcccggttttttcaggtcccggtcccggtttttggaaaaattgaaatcccggtcccggttttttcaaaattcccggtcccgtgcagctctaatctaaaaataagaatcttgtaacagattttaacttaaataaaaaaattttgaaaaaagtgggaacaaaaaaaacgggaaatggtcgtttcggcgccagcgcccaatcttttttggccttactttttaattgtcaatcaaatccaacaaaactgtcattcgagagagttctacccatgaaaagttatagtccaaaaaaacttggactggcgccgaaacatgggcgccgaaacgatccggatctaaaaaaaaaccgagaattttttaacataatagcatttctttacacaaactgaagcactaattaattccaaattggattaagattaacagatttttttccgccccctgtccggccgccgacagcgtcgacattattgccaacagcgccagcgccgacacatgtccgtccgcagacagcgccgacaccgtcgccaacagcgacagcgccgacaccgtcgccagcagcgccgacaccgtcgccaacagcgccagcgccgacaccgtcgccaacagcgccagcgccgacaccgtcgccaacagcgccagcgccgacaccgtcgccaacagcgccagcgccgacaccgtcgccaacagcgacagcgccgacaccgtcgccagcagcgccgacaccgtcgccaacagcgccagcgccgacaccgtcgccaacagcgacagcgccgacaccgtcgccaacaacgccagcgccgacaccgttgccaacagcgccagcgccgacaaccacccctgaaacagacccaatgaaaattggtaaagaatgattttgctaatcctttaaattatcaaattttaagaaataataattcaaatttttagccctttccatccttcgcaaattgggcaaagaagatggaaacaaagatggagattatgaaaaacaccaaaatttaaaattatgaattaatggtctgttggagattttaatttaattaagatatttgttttaattttatcccattaaaaattgcattaaacataaagatgtaataaa

SEQ ID NO: 66428 - DNA, 83 bp, Heterodera glycines; identical to SEQ ID NO: 62531
  Genomic contig location: Contig_ID=SeqID_7935; Location=1007..1089; Strand=-
  SCN-specific regions: Sequence locations=1-83

SEQ ID NO: 66429 - DNA, 324 bp, Heterodera glycines
  Genomic contig location: Contig_ID=SeqID_37332; Location=1179..1502; Strand=+
  SCN-specific regions: Sequence locations=1-1,24-160,190-324
aaaatctataaaaaatttaaaaatgagaattcatgcgagattttctggaaataagcttaatatcgcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagcctaaaaaaatccaaa

SEQ ID NO: 66430 - DNA, 1167 bp, Heterodera glycines; identical to SEQ ID NO: 37333
  misc_feature (1138)..(1138): n is a, c, g, or t
  Genomic contig location: Contig_ID=SeqID_37333; Location=1..1167; Strand=+
  SCN-specific regions: Sequence locations=1-68,107-130,152-228,250 -312,401-468,490-491,550-624,646-647,672-744,801-856,879-1004,1045 -1167
  Gene Ontology: Mol. function=sulfinoalanine decarboxylase activity; Biological process=larval locomotory behavior

SEQ ID NO: 66431 - DNA, 340 bp, Heterodera glycines
  Genomic contig location: Contig_ID=SeqID_37335; Location=41..380; Strand=-
  SCN-specific regions: Sequence locations=1-1,24-160,190-340
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaaatccaaacatttaaaaatctat

SEQ ID NO: 66432 - DNA, 368 bp, Heterodera glycines
  Genomic contig location: Contig_ID=SeqID_37335; Location=500..867; Strand=-
  SCN-specific regions: Sequence locations=24-158,188-322,352-368
caattaaaaaattttttaaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcttgttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagat

SEQ ID NO: 66433 - DNA, 396 bp, Heterodera glycines
  Genomic contig location: Contig_ID=SeqID_37335; Location=1047..1442; Strand=-
  SCN-specific regions: Sequence locations=1-83,105-236,263-345,388-396
gaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 66434 - DNA, 522 bp, Heterodera glycines
  Genomic contig location: Contig_ID=SeqID_37337; Location=204..725; Strand=+
  SCN-specific regions: Sequence locations=1-183,205-321,352-522
atgagaaccaaaaatctgccttctaagctttccaattccgaagttttaacaagtgatgctagttcatcgagtgttgagagccctgcggggaccatttatgaatcattcgatgcgttgagcattgatagctcaaaagcagctgcaagccctgaggggtccgctaatgttggggctgaaattgttattgaagggactgaatccaatgaaaaccctgcggggtccgggtatgatgaagtgagaaacgagggtagtaacgtcacatttaaagcgatggaagtggcgcttgaccaagtcgatgcagagggttttgcgaataatggctttgatgatgaggagcctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggccccaggctttcagcgtaaacttgaa

SEQ ID NO: 66435 - DNA, 503 bp, Heterodera glycines
  Genomic contig location: Contig_ID=SeqID_37340; Location=222..724; Strand=+
  SCN-specific regions: Sequence locations=1-31,53-125,154-159,184 -293,315-388,417-503
caaaagttttttacaaccacatattgccaatctaatttcttgcagattgaaagccatccattgcctgccggttctcgcacagcaaagcactaatagggtgtttgactcacttcaaaaaataattcattacccaaaagttttttacaaccacttattgccaatataatttctttcagatttaaagctatccattgcctgccggtctcggcacagcaaagcactaatagggtgtttgactcacttcaaaaaataattccatacccaaaagttttttacaaccacatattgccaatctaatttcttgcagattgaaagccatccattgcctgccggttctcggcacatcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactc

SEQ ID NO: 66436 - DNA, 177 bp, Heterodera glycines
  Genomic contig location: Contig_ID=SeqID_37341; Location=169..345; Strand=+
  SCN-specific regions: Sequence locations=1-36,163-177
atggcgccaggcggtggcaccacctcgacgcagaagggcggcaagcagggagacggcgggggcggaagcggaggcgaagcggcgaacggcggcggtggcattgccatcaccaccggagaaggcggcggaagcggaggagaagcggcgaacggtggcggtggcattgccattacaacg

SEQ ID NO: 66437 - DNA, 907 bp, Heterodera glycines
  Genomic contig location: Contig_ID=SeqID_37341; Location=107..1013; Strand=-
  SCN-specific regions: Sequence locations=1-136,217-627,810-827,905-907
  Gene Ontology: Mol. function=protein binding; Cellular component =nucleus; Biological process=hearing
aatttccccccattgactgtccggtgaggcactcgcgtttaacccccccccccccgcttttccgcttttaacccttccgctgctgtcccacagtttggtcacacctattctttccgctgggccgcttctgttcagtccgccccctcttccgcctccggtgcccgtccctgcgccacctccgccgcctccgatcatgttccagcctctgtctccgccgcaggtttgccaacaattttaaggagtatttgactttcactgatttcaaaaaatggcccgatcaaccgagagcttaatctttcccaaacacacaaatctcgagagtcatttggagactcttgccaaaattttcttgtgtatcttccctaatctcacaactgctgaactctcgacttaagtcttcaaaacccatgggattattcatttttcccaaatccatggttcaattgagtgatcgttcgcctccaatatattctcgaaaaacatatccggcttaatctcgagattatctcctacttagtccttctggggacttaattattggctcgggaatgtcggcttttgggttgctaacccttaatacgaccccttccgccgaaggtgttctgtatcgcacccgcttactgtgctcccccgctaccgccaccgcttccgccgcctccgcctcctaccgttgtaatggcaatgccaccgccaccgttcgccgcttctcctccgcttccgccgccttctccggtggtgatggcaatgccaccgccgccgttcgccgcttcgcctccgcttccgcccccgccgtctccctgcttgccgcccttctgcgtcgaggtggtgccaccgcctggcgccatggtcgccgccgcgggcccaccgctggcaccgtttccgtcgcctccaccgtacccgctgcacc

SEQ ID NO: 66438 - DNA, 2264 bp, Heterodera glycines
  Genomic contig location: Contig_ID=SeqID_7936; Location=1645..3908; Strand=+
  SCN-specific regions: Sequence locations=1-356,378-626,648-852,877 -1306,1329-1662,1684-2264
atggaaattaggtggccgggaaggagtccatcgcaatggaagcattcgcacgggcactcgccaaattgcccacaatcatttgcgacaacgccggactggacagtgccgaaatcatttcgcatgtgcgagccgaacacagcaaagggaatcgccaatttggcattggtaagaaaaaagacccaaacttagaagttattacgtggattagatgttgaaaatggtcgtatggcggatgtttacgagttgggcgtgttggagtcgtacaacgttaaattgggcgtgctttgcagtggcgccgaagcggccgagcaggtccctccggcattgaattattgtcaatagacttttctttgaagcttctccgtgtcgattgcatcatcaaatgcgcgccgcgccctcgcacgaaggaccgtcgtccgtgctgagaaaacgcagctagcgaatgcgaattattgaagacgcgcacaggaaaaggaatacttcattgcttgctttaccgtactttgttattgttttttgacatgttaaaaccttaaaaaccgagccatcactgcgtaattaaatctcgtcgatttttctttcataaatcgaatgctttttccttaaaagttttgtttaatcgaaacattgaaagtgtttattaaatattttccatttgaatttcaactttaaagtgtcatccacctttttcagcttgtccttttgtaattagcctgttcgtaaatccgttctcaatgttcgttcccccccccaattcgaatgcttttgctccttttcagggcctctcttttgtcgcgggtgctttacgtcacttcgatcttcttcgtctttttgtacctcctggtgcctgcactgtttttcttcttccccacttttatgcagcacattttcttccttcattttggtcatttccattcccattgtgcccttttttgtctttttatgattccttttttagtttgctttccattcgtcgattaccacaatttggctcaccacggcgtccgttcccgggggcgtaacttttatttgcgtgagcgcgaccttaaaacggcaaagagtacagaaaatgttgcgaaagatgagccgaccatcggagtatggcacattttacccgcttctctctccgctgagaaggaacgatcgatggatgacgcggagatggagcaatcgctgaatgaagggcccaacgcattgttcatttacctgcacggaaattccttcgatcggaccacgagccaccggtgcgaattgtacaacattttgtccgccatggatttccacgtgcttgccgtggactatcgcggtgagtgggaaagaaacaaaagtaaagtgccattgcggtaagggaaaatggcatttgttaggttatggtgactcgacagggcatccgaatgaggacggcgtgaatgccgatgcgcatgccatttatgactacgccagactaaaagcgccgtcgaaggacatttatgtgtggggccattccatggttagccatgtcaaacaaaccgctttcttttttactaatttacactccattttcaagggtacgggcgtcgccacgcgactcgttgccgaactgagcgacgccggcagagcgccgaaagcgttggtactcgagtcgccgtttaacaatgtttggtttctgctcaatgcatttaaaagagcaatgataaattctcagctgcgcgacgtggtcagaaatcacccgttcagtttgcccttccgctttttgccttggttcaacacgaccattgtccacccgctgattcagtcgggactgagaatgaattcggacgagcgaatccaacggtaagatcgagggagtgtgggttaaatttaaaaaaaatgatttcaaattttttcaaaatatcatcccccttaaaagttttttttaaattttctcccaaactgaccttccatgcggtcttttccagggttgcttgtcctattctcgttttgcatgcggaggatgaccatatcattcccgtcaatttgggcaaaaaattggtcaagtcggcgagggaggcacaccgcgaagtgacctacttggaatttgagagcattttggagtacaaacacaaatacatccatcgtgcgcccgagttgcccgatgtgatcaggtgaaagcatttgaacacttcgcaatgggaaagagaaatgaatggcattttattttgcagagagttcttagagaggggacaccttcagaaacggagcaaaaaccgaattgagcagggaaacgaaggagtgaaggtggaatt

SEQ ID NO: 66439 - DNA, 681 bp, Heterodera glycines
  Genomic contig location: Contig_ID=SeqID_7936; Location=2775..3455; Strand=-
  SCN-specific regions: Sequence locations=1-128,150-483,506-681
gttggattcgctcgtccgaattcattctcagtcccgactgaatcagcgggtggacaatggtcgtgttgaaccaaggcaaaaagcggaagggcaaactgaacgggtgatttctgaccacgtcgcgcagctgagaatttatcattgctcttttaaatgcattgagcagaaaccaaacattgttaaacggcgactcgagtaccaacgctttcggcgctctgccggcgtcgctcagttcggcaacgagtcgcgtggcgacgcccgtacccttgaaaatggagtgtaaattagtaaaaaagaaagcggtttgtttgacatggctaaccatggaatggccccacacataaatgtccttcgacggcgcttttagtctggcgtagtcataaatggcatgcgcatcggcattcacgccgtcctcattcggatgccctgtcgagtcaccataacctaacaaatgccattttcccttaccgcaatggcactttacttttgtttctttcccactcaccgcgatagtccacggcaagcacgtggaaatccatggcggacaaaatgttgtacaattcgcaccggtggctcgtggtccgatcgaaggaatttccgtgcaggtaaatgaacaatgcgttgggcccttcattcagcgattgctccatctccgcgtcatccatcgatcgttccttctca

SEQ ID NO: 66440 - DNA, 538 bp, Heterodera glycines
  Genomic contig location: Contig_ID=SeqID_37344; Location=36..573; Strand=+
  SCN-specific regions: Sequence locations=1-334,356-538
  Gene Ontology: Mol. function=Rab GTPase activator activity; Cellular component=Golgi apparatus; Biological process=synaptic vesicle fusion
atggtgcgtgcaatttgcattcataatcatccgattccgaacaccaacgatgcgccgagctgtcagattattattcctcaaaaacaagtcggccgcagttttggtgagtcctaaaaacaccgttgcttctttcgaaacatttcccttcttattgttagacatttacgtgtcttgcgtttccaattccaaccaagtgactccaaagccgtggttcatcgccactgtttcgaccactgttgaaacggagaaccccgaggctgagatacaaccggcacttcaattgcttggacccatttttgaaaagttgtatcaagaagagttaaaaatgagaaggttttttaggtttgtgacaatatcggatttatacgagccggtggacatgggctatgagtctcaaatcttcatttcgcgttctttcgacgcgaccactcactttgagaccacttgcttggatgtgctggacattttcaagaggggcactacggaggaattcgacttctccaagatcacccatctcagtttggaggacaacgaatga

SEQ ID NO: 66441 - DNA, 67 bp, Heterodera glycines
  Genomic contig location: Contig_ID=SeqID_37344; Location=684..750; Strand=+
  SCN-specific regions: Sequence locations=1-67
cttttctgtgttcattgcatggttttaatacacagatatttgtagaattcatttcctagtgaccaaa

SEQ ID NO: 66442 - DNA, 753 bp, Heterodera glycines; identical to SEQ ID NO: 37345
  Genomic contig location: Contig_ID=SeqID_37345; Location=1..753; Strand=+
  SCN-specific regions: Sequence locations=1-214,236-257,279-461,488-753
  Gene Ontology: Mol. function=DNA binding; Cellular component =transcription factor complex; Biological process=axonogenesis

SEQ ID NO: 66443 - DNA, 1063 bp, Heterodera glycines
  Genomic contig location: Contig_ID=SeqID_37347; Location=46..1108; Strand=-
  SCN-specific regions: Sequence locations=1-296,323-406,428-669,691 -1063
caatccttcaacgaattccgactgcttgcgatggcaatgttttgctacggtttggcattgaaatgggcatgccataaatcggtcaaaggaagtgatggagcggatagcgcgctcctttcactctgtgccgctgagttgacgacactgctcagaacgaatttgcacgcggactctcagttggaggcggaaatgcacgaatgcgacaggaacatggtcgttggtgttgttttctttattgtataataatcgtcaatttcacaaacatttgcaatgccattctccaaacataatactggttttaattaaatttaaaaaatttatacgaatttattattgtacgaactagttttggtactaattgccattgactcataagaatattgttgccagttaattttcagtttctttccgttctttagctcctctccttcctccgctgttattcttcatctgtgccttctaaagactgtgcccaatttggcacatcggtcacttcttttcttcaaattgatactaccgacccaattgctctttcggaattgcgtttcgatgtccttccccttttgctggccaatgcttggcctcttcgacgaaacattcactttcttagacgattggcctttattctcgcttattcttctaatctaaactgtaactctaactttaccattaattactaattctttaatttttccagatcatcttgtgcttgatcctcttttgatgggcttgtccaagtgttcaactcgtgaaaatgtcttcctttgttgttcccctgagaatgtcgcaattaccgacgtcaaggtgttgtatatcttattgcttttatttactttctatttaccctgttctccagattttcctcgttcgactttcttcctacatgaaactgtgcaaactgtatgatgaaggcgttttcgttttcccatggattttccattgtgcgcccaatgttcagcaacaacagttttggagctacattaattctctgttggatgggaaacaggaatcggaaaggtcgcagttttattcgtcgaaatacaagtcaagagatcgaagataa

SEQ ID NO: 66444 - DNA, 185 bp, Heterodera glycines
  misc_feature (132)..(132): n is a, c, g, or t
  Genomic contig location: Contig_ID=SeqID_7940; Location=14..198; Strand=-
  SCN-specific regions: Sequence locations=1-164
atgaacttatttattagtctgactggtaaaaagtatattccagtgcattggcataattgctttctcatccttttttctctcaaaatttaatttttcgttttttaggactccttcaagagtatttgctcccgnaattttgcacctgttgtcccacaattcgaaggcatttatttccatttatttaa

SEQ ID NO: 66445 - DNA, 1241 bp, Heterodera glycines
  Genomic contig location: Contig_ID=SeqID_7940; Location=557..1797; Strand=-
  SCN-specific regions: Sequence locations=1-66,91-255,284-287,309 -373,395-479,501-708,730-1053,1075-1083,1109-1241
atgccattggatgccctcctcaaaaatgcactgccctttttggcctcctcattaaatgattcgagtggtggcggcggcggctcagcgactgattatccagcaaaggcaccggaccaaattttgtcggtgagtttcaaatttttcaaaaatttttgatcgcaaacagagcccggctgaagagggcacagaattcattcaaaaattttactaaattcaattatgtgtaataacgtggattttgctcgattttttgtccctttttaaacaaaatatttctgatggaccgacctggatccaggcctggatttttcccaatgttcagtttccaacaacctgggtttttcatgaacctgtgttttcctggatttttgaaccaggaaatccaggtcaaaatatgaaaaaaaatccagatccaaattagacacgaaaaaccaagattttttggacaaaatttttttcaaatgaccattttcatatcaaccctttttccccaagaaattggtccatgaaagtgcttccctggcgtcaaccgctcgtctcgacccgtccaattcgacactttccgaatttctccaccggtgtgccgcactgctcacccatccggcaacccgacctcttttgaggtccaaaattctactgcttctttccaatttttgtgggtgggggcacataattttttttttgtttgtttctgtcccatggatgtaaccgatttttaacaattttttggactcccaattttttttttggacctcacatttctgaaatccaaaattttctgccagttacacatccatggtcatttatgagaatttttccacaccctttttcggttctctattccgttttcagttctctacaatgttttattgcgaaaaagtgctgcaaattcggcccaaatttgcctggcaatttgccactgtttgagggccgcattggacgaacatttgggcccccaaaatctcatcgacgtacttcgtgtcatccaggtgattttagaatgggaattcaactttttttaaattgaataatttgaaggggtacatttaggccttctcttccctttctccgttttttcaacccaaaaaattaaaaaaatttttttaatcaaccacctgaacactttgtccccttttagatgctcacttatgaacgcgtcaattttggcgattggaccaacgaattgttgccttttttgacgcggcaaatgtatgaaaattatggggaggactcaaaataaa

SEQ ID NO: 66446 - DNA, 285 bp, Heterodera glycines
  Genomic contig location: Contig_ID=SeqID_7941; Location=27..311; Strand=+
  SCN-specific regions: Sequence locations=1-18,40-112,135-157,190-285
aaatttttaaaagttttccagcaaataatgcaaatttttttcgaattcccccccccaaacgaaaattaaaaagtttaattggcaaatttcgtaacaagtagcactcaaatttccaaaattttttcccggcggcgcctatcggcaccgccggacctacattttccactatttttacaagttttttgccttaaaacggccaaaatttggtcatttttagtgaaaaagtgcagttgttacccagcagtggaaaaaaagttattggttaaatagcaaaaaaaagaaaaa

SEQ ID NO: 66447 - DNA, 788 bp, Heterodera glycines
  Genomic contig location: Contig_ID=SeqID_7942; Location=208..995; Strand=-
  SCN-specific regions: Sequence locations=1-676,698-728,776-788
  Gene Ontology: Mol. function=DNA-(apurinic or apyrimidinic site) lyase activity; Cellular component=cytosolic ribosome (sensu Eukarya); Biological process=protein biosynthesis
gtttttgacaatggggctgtttactcgcccgatgtgcttgatgtgacgacggctgatctgcttgcacgtttccaacaaggtgtgctcaatgtggccgcactttcacttggcatcggctacccgaccaaggcatcggcgcctcatctgattgccaatgctttcaagaacttgttggccgttgctgccgaaacggacgtgacgttcaaagaggctgaaaaggtttggggaaatggatggatgtgcttattttagttagatgaacgaaaaactggttcgccacaaaagtcgacatttctttttttatttggaaatcgtgaaatatgttcccagggggtttcgggtttgaactgatcaataatttggctggctttaatatttcccaatttctaacctataagcctaatttcgaaaaaaaatcgagaatcccaaaactaattctttaactttgtgttaggattaagtattgggatttggtcgaaatgaatgcagtattcatgaatcagttcgatcccgaaaatccccaagaattgccttttcggtttaagtcaacaatagcacatatttaattcgacaactttaaagcgatgcaaccagaattgctgttgcttattccaactgtttaggtcaaagagtatttggctgatccgtccaaatttgtttccgccgttgccgccgctgctccggcagccggtggtgcccccgatgcaaaggaggaggccgccccggcaaagaaagaggaggagaaggaggaatccgacgatgacatgggctttggactgtttgattaa

SEQ ID NO: 66448 - DNA, 155 bp, Heterodera glycines
  Genomic contig location: Contig_ID=SeqID_37355; Location=844..998; Strand=-
  SCN-specific regions: Sequence locations=1-155
gcggccgattcagtccgcgttgaggctcgtccaaaaagtgcagctcacggtcaccggcaccgacaaagtaacgtgcaagccacggcagaacaggtcgtgtcaactgagttttaggtggatggttgcatcccacaaaaatttgccaaaaaatgcca

SEQ ID NO: 66449 - DNA, 556 bp, Heterodera glycines
  Genomic contig location: Contig_ID=SeqID_37356; Location=879..1434; Strand=-
  SCN-specific regions: Sequence locations=1-11,33-556
aatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatgggcagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggtactgccccgaaatccaaaaaaaaaatttttt

SEQ ID NO: 66450 - DNA, 641 bp, Heterodera glycines
  Genomic contig location: Contig_ID=SeqID_37361; Location=168..808; Strand=+
  SCN-specific regions: Sequence locations=1-195,421-641
atgggacaaaatcgtcgaattgatggactcggtggacaaattgggctcggcggaagagctgtgggcagcagtgaagcagaagacgccgatgctggccgatctgctggagaacgatttgtggaagggaagcaaagagcgatggacaaagttcgagggcaatttgggcgacgaggcgaagcagtacaaggaaaatgtgagagagagaatgggagacgataaagcaatgagagagataaggaagagagagtagataaagagacagaaaaaagacgtagagaagagaaatttgagaggtagagaagtgaagagaacctgagagagacaagagacgatgtgagagagagagagagagagaggagagagagaagagataggtagagaagagcaaagagagatatcgggtgagggagaagagagagaagggcaacaaatggggagtggaatgccagaattcatcaattaaatctggcgagatataactccaaagaatcaggcccggggtataattaggcaccaattgggacatgattttgggtactcaatcggttggctaactctcaactcgttcgcaaaaagtatttaatctcgcactttttcgatttttagctactagaccaattgtttccttgggtgtactatag

SEQ ID NO: 66451 - DNA, 1695 bp, Heterodera glycines
  misc_feature (1251)..(1251): n is a, c, g, or t
  Genomic contig location: Contig_ID=SeqID_7943; Location=1594..3288; Strand=-
  SCN-specific regions: Sequence locations=1-200,223-249,281-1695
atggccaacaaccatttctggacttacccctacccgtattgggctcgtcaccggggatatctgtgagtgtttggcactttcgctgctgccatttcaagtcactattcagcttcgactatgcaaatccgtcgttttactcgaaggaattcgatttgcattactacgaacattgattgaccggcggaaaaacaatggcggagcatactgtagcatactgtagagaaacgcatttatagaacaagcaacgcgaaataataataataaaaatgtttaaaattatgttttgggttttcgcccatcaccgtactttttgttttgtgttcctccctttttactactgtataccgtagcgatgagtgcgtttgccatcggcccattcgccgatcagccgataattcgtcaaaatgcggtgcaattgcgagctcgcactttggtatttgcctatttatgtccaatttgttgaaatgccattgccactaaaaaggccgacttgagccgatcctttgctgtcggcgacagttccccctctccgaatacggcactctcctacaaaatgcgttcttggtcttggcgcaccttccgacagtcgcgtttggtaccgtaacaaattgcttggttaattttattactctggtagagaagtgactaagaccggccttttcaggacgatgtgtcctacgcggacgattggttccatttcggcacttcctaccgtacttttccggtcttggaaaaattcgaccgtcggttggtcaacttatgccacaatcaatgctttagcataatgctccattgttttatcaattttttttcagtgattacgccgccataccgtacacttattggtcacgggcgtattgcaccgaactgtaaccatttgctgctctaccatatcgctaattacctgtctttttcaaaggtatccgtccgaccgtactgaaatataccggcgcatttacgagccgtacagagacgaatactcctacaaattgtggaacgcatcacgcagagcactgctcagcagagataatcgactcatgtgaagagaaagaaatattcttgcttttgattgactgtgaacattttggcgattgattaaacatttccattcaattcgtactgtggggggagggggggtacggtatggagaggaaaggcaacacaaagaaccacggcatttttgaaacattttttcatttgtgattttatttttttgacagttttaacaatgacagataaatattggctggngcctttcagaattaccaacgacagagacaaacgacaaacgatatatttgtcgttagtatacgccgtttgtcgtttttcatcaatcagaattaaaaattttgccgtttgtcgtatgtctcccgaaatttgtcgtttgtcgtctaaaattaggcgtttgtcttctattattctgattttatttcagacgacaaacgccaaatatttggggggcgctcaacaccacccctcaaatttgtcgtctgagaaatgtcccaaaaagaccaccacataattttcatccaaaaaattgtatttcatgttaaaattatgttcctagggataaattagtcgctgatcatgaatccgatctcagattttcattatctatgtttttatcaatgatttttgataaagttatcaaagtctattgaattcgtgttcatgattggaatttgaagaaataaa

SEQ ID NO: 66452 - DNA, 206 bp, Heterodera glycines
  Genomic contig location: Contig_ID=SeqID_7943; Location=1223..1428; Strand=-
  SCN-specific regions: Sequence locations=1-54,77-206
agccaattccctaccgccgattccctactaaggcatttgggccatttccataccaaaagtattgaatattgataaacattgagattaaaacatacaagaaaatttattcactgctttttagactaagctcgtcaagagctttcggaagataccaaattatcagaattcgatcgttttaaagtaagttagaagtgtcaaatctctga

SEQ ID NO: 66453 - DNA, 278 bp, Heterodera glycines
  Genomic contig location: Contig_ID=SeqID_7944; Location=1..278; Strand=-
  SCN-specific regions: Sequence locations=1-278
atttgtcgcagaatgtcccaagtgcgtccaaattcttacgtaagactctgtttctctgcactctctcccaaccaaaggttctctcgttcagctttcgcttgagggctttcccgaagggcaagggtactgtgcccgtacgcggacggtgcccgacatgacaggccatgtgcgaatgtccgaccgttataagccccactggggcaaataccgagacgtatgtcccaagagcaaaaggaaagcgtcgttaccccccggggcgacgtttccttcccaaaacg

SEQ ID NO: 66454 - DNA, 157 bp, Heterodera glycines
  Genomic contig location: Contig_ID=SeqID_37365; Location=34..190; Strand=+
  SCN-specific regions: Sequence locations=1-157
gattgtacgtacctaattgccgaaaaaattcaagaccaatttccgaatgttgaccgactaattgcaaaacgaaatccgtctttgtcaaagcgccttaccgagtcaaaaaatttggaaatgtatctcatatgcaatttcaaccaataaatttgatgaa

SEQ ID NO: 66455 - DNA, 383 bp, Heterodera glycines
  Genomic contig location: Contig_ID=SeqID_37367; Location=134..516; Strand=+
  SCN-specific regions: Sequence locations=1-20,42-275,297-383
atgccaaaacaaaaagaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccctttgcttctcccagttttaagtcttggatttgtcaa

SEQ ID NO: 66456 - DNA, 369 bp, Heterodera glycines
  misc_feature (324)..(324): n is a, c, g, or t
  Genomic contig location: Contig_ID=SeqID_37367; Location=666..1034; Strand=+
  SCN-specific regions: Sequence locations=1-20,42-275,297-369
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctcccatgtgggccaanattttaggcccccagccacaggccctttgcttctcccagttttaa

SEQ ID NO: 66457 - DNA, 377 bp, Heterodera glycines
  Genomic contig location: Contig_ID=SeqID_37368; Location=297..673; Strand=+
  SCN-specific regions: Sequence locations=1-31,53-227,250-321,344-377
atgaatattgaaatttttattgttggcgttcatgaaccagtttttcaaaacagcaaccgggccaatttagaactcgcactacccagcaatattgacttcaaacatattttaaaactgataaatcacacgtatcagtgcgctgtatttttaagattgtcaaaagtactaattgcgtttctcttattgctttcgtgtgagatttttcttgatgaaattagggaatagaatggtcagcaatcaatttcagacgctttttgcaggtttaacgtataaataatgcttttccagcgattgaatataatcacaagcaatttcaattattgccaatgaagctttgcaagaaaaatgatgttgacttctatgcgagggtttattaa

SEQ ID NO: 66458 - DNA, 46 bp, Heterodera glycines
  Genomic contig location: Contig_ID=SeqID_37369; Location=194..239; Strand=-
  SCN-specific regions: Sequence locations=1-46
atgaaattctctgcttctcttgttggatacacgggaagaaataata

SEQ ID NO: 66459 - DNA, 300 bp, Heterodera glycines
  Genomic contig location: Contig_ID=SeqID_37369; Location=324..623; Strand=-
  SCN-specific regions: Sequence locations=1-300
atgaaattctctgcttctcttgttggatacacgggaagaaataatagttagtccttttgttgaatttttagaaattctatccgtcaaatcgtcttttggaattttaatgagtaaatcaggaaccgtaaatgaaattctctgcttctcttgttggatacacgggaagaaataatagttagtccttttgttgaatttttagaaattctatccgtcatatcgtcttttggaattttaatgagtaaatcagtaaccgtaaatgaaattctctgcttctcttgttggatacacgggaagaaataa

SEQ ID NO: 66460 - DNA, 646 bp, Heterodera glycines
  Genomic contig location: Contig_ID=SeqID_37371; Location=91..736; Strand=+
  SCN-specific regions: Sequence locations=1-61,103-117,139-242,264 -334,356-369,401-521,645-646
atgcacccgagcagcagttcatcgccaaaaataacatcaattggacagcaaggtaatgtggaaatgaatccagtttaaaaattggccttaaaaatttaaattgttgatattccctacagaaagaaatgtctgacaaatcaatgaaaattgctaattgttgctttaccactaaagcttttgaaaattgccgagtttttagcaaaactgccaactttataacaaaaagaaatcgtagcttttcataaaattaaccaaattaattattcattagcattcgatatgtagcttaaggttccaccaattgttcagatttaagtgaattttgagttaaattctgaatttaaggaaaacaaaagttaggaattctccaattatttattagtattattaaaaaaattttgagagccaaaaacaccaaaacatgaggctaaaaatgcagcgacaactgtcgacggttgtgacggaggaacgacggcgacaacgccgaagagtacggcgaattcgcaacagcaacaatctgcagaaaaagagaacaatcggagcagtagcaggacgagaagcagcagagagaggaagaagcagaatagcagtggagaggaagagggcgacagagaagacgagaaagggaaagacagggagaaaaacg

SEQ ID NO: 66461 - DNA, 1047 bp, Heterodera glycines
  misc_feature (1033)..(1033): n is a, c, g, or t
  Genomic contig location: Contig_ID=SeqID_7945; Location=47..1093; Strand=-
  SCN-specific regions: Sequence locations=1-71,95-227,265-293,572-1047
  Gene Ontology: Mol. function=cytoskeletal protein binding; Cellular component=cell-cell adherens junction; Biological process =intercellular junction assembly and/or maintenance
atgattgccgaagtggaacggctgttgacacgaaaaaggtccgcaccggtgcatgaaagttttgggaacattgacgacgacgatgaggaggagggcgagattcttgacgtctcgtttgttgaggaggaagaagacaatacgggcgaagcgcccttaaacccactttcatatttgaccaagcaatcagcggctcaacaagaaacgttgcggcatgaaaaatgggcacaagaagagagaaagcgaagggaagaggagcagagaaagcagcgagaaaatgaacgtagacggcgagaagaagaggagaggcgtcgtaagacagaagaagatagaaggaagactgcagaaaaagcagccaaggaaaagaaggcaaaggaagagaaagaggcaagtgaaaagaaggcaagggaggaaaaactggcacgggaaaagaaggaagagcagagaatagcaaaagaaaagaaaggcgataaagagaccaaggataaaaaggctgaggaggagagagtagcaaaggaaagaaaggcagaggatgagagagtggcaaaagaaagaaaggcagaggaagagagagtggcaaaagcggaagcggagagagtggcaatggtaacaaaggcagaagaggaaagagcggcaaaggcggaagcggagagagtggcaatggtaacaaacgcagaagaggaaagagcggcaaaggcggaagcggtgagagcggaaaacgagaccaagaaaaagcaagcggaggaaaagcagttggaagagcttaaacgacagcaacaggccataagaaagcaaaaagagttggagctgctcaaagagttcagaccttggcgaggtgggtacatgaggctggttcacggcaaagacccaaccccagacgtacactatctgcacgaaacggatgattaccactttgtgaatgctgtacacaagtaccgtgtctggcactcagagctcccttgggaggcgcccgagtttaacccatccgcgcacatccaacagaatattggggagttccgtgagctgtttgagcaangaggtgtacgatga

SEQ ID NO: 66462 - DNA, 738 bp, Heterodera glycines
  Genomic contig location: Contig_ID=SeqID_7945; Location=1362..2099; Strand=-
  SCN-specific regions: Sequence locations=1-34,56-322,345-482,504 -551,580-738
atggatgagtcgaaacgggaaaatttttcccctcaaaatgatgatgacgtcatcacaattggagacaacaacactcaaacactgcttgacctgcaaccggggccctcaaaaagcggacgcaagcctcgcttggacaaaatccatgaggaaattgcttccgcaatgaagaaagtaaaagccatggaagctgaaggtttggctttttctgcaaatttctttaaattagccaaattttagtggatgaatcgcccaaaaaacaaccgaccaatgtgtttgagtacccgaccatattttggaaattggcccgcccaaaggttttggctaatatttaatttgaaaaaataggaaaatttcttaagtacggagtgttcacgttcatgtgcaaagagtgtcgtgatgacaatttccggcaggggaacagccgattcaaactcatcaatcagaatggcgagcagcaacgccttgagttcacccaatcgttttgccaagactgtgcaaagctgaactttgattgcaccgatctgatcatgaagcacctaaagaaggatgaaccggcaacgacgacgacgacgatgacaaagagtttccgctggatcaaagatgggggaaagtgaaccgagatggcacaccacgatataaggacgatctcattttgaagaatttatacttgttgatcaaatgacaaactctttctttgtaattttgccgagcaatacgccaggctttgttggaaataaa

SEQ ID NO: 66463 - DNA, 547 bp, Heterodera glycines
  Genomic contig location: Contig_ID=SeqID_7945; Location=2446..2992; Strand=+
  SCN-specific regions: Sequence locations=1-547
atggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattcagtttcggtctaacacacatgcgttcagaggttaaagtccaccagtatttctacataaagcaccggatccgcctactgtacccacagctgaagtgcattgttgagtaccacaacaagggccactgcaaatactatcccttgggtataaaattttgtccggaaaaaaatcaataatcattttcagagttgttggccgttgaggagggcagtgagagtgaacccgtcgaaagacctgccgctgaaaccgactacctggactacttgaactttcgcagtgggtggcaatcaacactctactga

SEQ ID NO: 66464 - DNA, 199 bp, Heterodera glycines
  Genomic contig location: Contig_ID=SeqID_7946; Location=65..263; Strand=-
  SCN-specific regions: Sequence locations=1-34,56-58,80-199
atggatgagtcgaaacgggaaaatttttcccctcaaaatgatgatgacgtcatcacaattggagacaacaacaacaacactcaaacactgcttgacctgcaaccggggccctcaaaaaggggacgcaagcctcgcttggacaaaatccatgaggaaattgcttccgcaatgaagaaagcaaaagccatggaagctgaag

SEQ ID NO: 66465 - DNA, 1035 bp, Heterodera glycines
  Genomic contig location: Contig_ID=SeqID_7946; Location=621..1655; Strand=+
  SCN-specific regions: Sequence locations=1-915,937-1035
atggtactccctctgactgctgccctatccaaactgctaaactgtaaacccgaaaatttagcagaatatttgaacaaccccgaggcggtgaacaaagcgaacgcttacctggccggcaaaaaactcaaaacaacctaccagggtcgtgattccaagaccaaagaggtcaagttcggcacattttcggtgaaagccgctgcggaaacctacgcctttgagggatttcttggcaagtttccaaaaattctgtttcggtctaacacatatgcgttcagaggttaaagtccaccagtatttctacataaagcaccggatccgcctactgtaccctcagctgaagtgcattgttgagtaccacaacaagggccactgcaaatactatcccttgggtatacaattttgtccggaaaaaatcaataatcattttcagagttgttggccgttgaggaaggcggggagagtcaacccgtcgaaagacctgccgctgaaacggactacctggactacttgaactttcgcagtgggtggcaatcaacactctactgatcaatgaagcgtgtgcggcaatcggaaaagttgggcgaattcccggagattgagttcgccgtcaacacaatgggcgtcacggtgtactgcccgcggcacctgcaaacgcctcggtttgtgccatgggaccagcccgggcggtgctcgagctgtagaagcggaactgttgagctggactacatcatccagcccgagggggtgcccatcttttcgaatcggctaaagacagacggcgagaactttgtgccgtttgatgcaattggtaagctgcaggtgtatgtcagagtttgataagtggactttgccgatcgtgcgaaattccgcattagggcccggaacaaggtgttcacgctaccgctgcgacacccggaggtgcacgccgccggcccaagcttggaagacggcgtaaaagaacaaaaggaaatgactcagatggcataaacacttgtccatttttctattgttgatattctgatggactacccaaga

SEQ ID NO: 66466 - DNA, 840 bp, Heterodera glycines
  Genomic contig location: Contig_ID=SeqID_37373; Location=174..1013; Strand=-
  SCN-specific regions: Sequence locations=1-527,549-680,707-789,832-840
gggggactgcccccggaaacaaaaaaaatcgattttttcaagtgttccgtttggggtactcaaacaattatggggagtaaaaatccaacgcagaattaaagtacaggctatagggaagctattccggaaggattcgatctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 66467 - DNA, 642 bp, Heterodera glycines
  Genomic contig location: Contig_ID=SeqID_37374; Location=13..654; Strand=-
  SCN-specific regions: Sequence locations=1-49,71-174,196-299,321 -424,446-549,571-642
atgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaatcagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcatgtgagtgttgagcagaaaaagagatagacgttttttcaaaattttcagagccaaactcgcccagaaagaaaatccagaaaaattagggtcgtcgctactattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcat

SEQ ID NO: 66468 - DNA, 500 bp, Heterodera glycines
  misc_feature (51)..(51): n is a, c, g, or t
  misc_feature (58)..(58): n is a, c, g, or t
  Genomic contig location: Contig_ID=SeqID_37376; Location=430..929; Strand=-
  SCN-specific regions: Sequence locations=1-68,121-260,351-456,478-500
atgatgactgcttcgaatgtgttcgaatcgatgttccgttttgatgacaanaaaccanagactgaaagtaaaaatttagaaaagtttaaatgtttttcaaatattttaaattaatttttagctccttccgctaaaacggatagttcggtagaaattcctgacattagtgcgaatgctttcaaagtgatgctcagtttcatttatgctgaagatttgagtggattgaacggagaaaatgccatggcagtgctttacgcgggtaaaaatatttttgaaatttttaattttaaaatattttagcaaataaatacattttgaataataattatttttaattttaaaatattttagcaaataaatacaatgtctcttcgctggtcaaagcttgtttggaattcccaattaatgaattgccaaatgtgttctttgcctatttccaggctcttcttctcaacgaaaatgtaaaatttgggttttaaaacatttacacaaaaaataaa

SEQ ID NO: 66469 - DNA, 684 bp, Heterodera glycines
  Genomic contig location: Contig_ID=SeqID_37378; Location=10..693; Strand=-
  SCN-specific regions: Sequence locations=1-684
atgtgcgccgcgcaccatgaatggctgacaaagcaaaagggaccaaagctaggcaagaagatgaatgccctgcgaattggtggcctcatggtgaacatcctaaatggatcaacacgactgatggaagtcacgatctgggtgaatgacaatccgatcaaatttgtgcttgactcgggtgccgatttgactgtgctggacgaagtcgcacatatggctattggaaagcctcggctgacccactgcaatgagcaagccgtgtaccatgacggtacaagctgtaagcttttgggaaaaggcacagcacgtttttcatttggaggaaaaacaattaatgggcaatattatgtgacgaagaaaggatcactcaatcttttgggaattgatatgttggatgcctttggcctattggacgctttcagaagggaagttgaaaaggccatgaatgtcaatttggtgaagaaggaagcgaaaaagtcgccgattcttcaacaggagaccactttggctgcgcttcaaacaaaatttccgcttgtttttgtggagggacttggacactgcacgaaagcaaaggctcatttggaattgaggcctgaggctgtgcccgtctattgtcgtccccggccagtgccttacaacacacgtttggttgtagaggaagaactggaccgattgttggagcagaag

SEQ ID NO: 66470 - DNA, 342 bp, Heterodera glycines
  Genomic contig location: Contig_ID=SeqID_37379; Location=256..597; Strand=-
  SCN-specific regions: Sequence locations=1-342
atgtttggcctcactgaatttgcgtccaattcgtccgcgtttgacggcggcgaaattcgttgtgtgctgaagcggttgtacagcgatttcattgtcatcgaaattccgtccgatggccacgtgttgaggccgaacagtgcggcggcgccagcggcccaaaacggtgccgccggcacggaatgtgaaaagtgccaagaagatgcaacaacgactacgactgtgcctccgtcggacgatggcaaaggggagaagccgacacggctcactgatcagcaatttgatcagatgcaacgggtggccgctgggacagacgaagaggggaaaatggacatcgatttgaag

SEQ ID NO: 66471 - DNA, 392 bp, Heterodera glycines
  Genomic contig location: Contig_ID=SeqID_37381; Location=1002..1393; Strand=+
  SCN-specific regions: Sequence locations=1-392
atgaaagaggaagtgaaaaagatcaccgaaaatttggacactctgcaaagccgtgtacaaattttggagtttgaaatggacggtgaaatacagaggaccgagtggatagatgatggtcattcggtggaacatgaccaattaccacttcacagtgcaaatggaaaggaaccgaatggcggtgaaggacagaatgaaatgcacgtggacgattgtgaaataatgataatggatccgtttttgggtggaatcactcctttggaagggtacgacggaaacccgggaatttcattttcccgttgggtcgcccgatttgaggacatgttggcattatcccaatatacggagacccaaaaattaagcagactccgaattttgttaaaggggcaagcaag

SEQ ID NO: 66472 - DNA, 902 bp, Heterodera glycines
  Genomic contig location: Contig_ID=SeqID_7947; Location=47..948; Strand=-
  SCN-specific regions: Sequence locations=1-162,184-441,463-754,779 -808,832-873,896-902
atgttcgtcaatgggttggcggagtgcggcaccaaaaactgtgtggcggaactggcaaaacggatcaagagcaaagtgggtacttgaacaattggccatgacaaaaataagcgaaaagcaccccccgtttcagcaagtgtcccaagcaaacgctgtgaaggcactgctcgcactcactcagctgccggcaccgtcggacaacattctcgaggagatggagcagttgtgcagctccgaaccggtggaaagtcagccgaccaccaaacagtcgtgttggctgacattcggcgcattggtcaacgaagtgtgccaacataagacggaaaagaatgcggaagaatgtgccggagaaacggcgaactgtgcgcagtccggcttctccaagaaaggccaatgcccaatggacaaaaagcagaagtacaaggaggtgggcacaatgaaatttgttgggtaattaattaattatttgttaattccaggcaatgctggcagtgtaccaaaacagcggatgcatttacgacaaaatagtcgcactgagcgcacttggcaacgcgggcatggacaactcactgaaggagctggagaacatcatcaaggacccgcgcgaaccacgcgtggtccgcgtgatggccattcacgcgacacgccgtctccaagtgaccgagccgtgggaagtgcagagcgtactgctgccagtctttctgaacacgcgtgaacagccacacgtgcgcatcgccgcgttcgccaatctgatgaacgaaaacgggcagccggagccgcacgtggtggaccagctgatgtacaccatcgcgaacgagccgaacaaggaagtgcaggcgtacgcctacaggatgatgaaagcgatggccaagtcccagaagcccaacgaaaagcaaatgtaa

SEQ ID NO: 66473 - DNA, 1497 bp, Heterodera glycines
  Genomic contig location: Contig_ID=SeqID_7948; Location=290..1786; Strand=-
  SCN-specific regions: Sequence locations=1-400,422-444,466-876,898 -1434,1456-1497
atgcgcacattcgcgcttttggccctcgtcgccgccattctctgtttgagtgccggccgacgcaccttcccgaacacttcgccaagagtcggcttcctcaattttggcacccgcaacagtccgaactcagcgataaagccattccagcagaagaacaccgagtacacattcatctacaatgcccagatcgcctcggggttacagtcagaagaaaatgctgcgaacccacagcaaaaggcggtgacgcgcatccaatgcctggccaagattcaattcgcttctgagcgacacggacagttgcaattggaagagtgtcaggcgggacagcaaaatgagcaaatgtcggaagcgcaggaggtgcagccgatggaattgtttgagcaggtgattggccaagtgtgtggggtcggttggcatgtcagtaaatgctttagacgccgataccaagccagacaaagctgcagctgcacaaaccgtgccaattcaccagcgcagacggagtcatcgaacgcgtgcagtgccaagaagacgaaaccgaatggaccaagaatttcaagaagtcggtgctgaatataatccaggtgagtgacccattcattctctgtttgttcgctttgaactgccttcccttgtgttaagctgaacctgaagcgcaacaacgcgcagggattgagcagaaacgacgaacgacagcaaaacacggcggagaaagagtcgtggcagacgaagcagggcaaatcattcaccattcaggaggttcgaaactgatcaaccgcaaaacaaaacacaatgaatgccccgatcagatcacattggaaggcgcatgtcaaacgacgtacaccatcaacagagcatggagcggacagcagttcaacgtcacaaagaccatcaacttcaagaagtgccagaagatcgcggacgtagcgaacggcttccaaacggacccaccgcaggcgcaatgtgcacaatgccaacagtaaaaagcaaatgaaaaagtgaatggaacaaagccgaacttaaggtattgggctcaacagcagagtggccaaaatctccagcaaagcgactcggaaacggacaacgcacaaaacggagaacagaacccatgtgccaagtgcgacccgaaggaagtgaaagagcacgaggtgagcttacaacaaaaaaagcaaactgaacaactcttttcgcgtttagttggaccgttccacggtcattcgctgtcaaatccaaggcgagcccaccaagcagtacacactgcacagctgcgagatgcgctcccaatatttgtaccgtaactcgaagagtgccgtgggaaactacggtgccgccatgcaaacgatcgttgccgccacattgcatgcgatggactccaaacacacataccagcaaatcccggcgatgagtgcgagcacggaagagacgctgatgtactccaacagcaaggaagtggatgagaaacgcttttacagggtcagaatccgttggcaaccgaataaa

SEQ ID NO: 66474 - DNA, 400 bp, Heterodera glycines
  Genomic contig location: Contig_ID=SeqID_37382; Location=495..894; Strand=+
  SCN-specific regions: Sequence locations=1-57,79-93,115-129,151 -165,187-347,370-400
atggggaccggtaaattggacaccggaaaattggacactgtcggaattttggacaccaaaggaaaattggacactgtcggaattttggacaccaaaggaaaattggacactgtcggaattttggacaccaaaggaaaattggacactgtcggaattttggacaccaaaggaaaattggacactgtcggaattttggacactggaaaactggacactaaattcctcttttaaaatataaacccaggaatttaaatactcaatatgcacaatgattgatcaaatgtggcaaaaaagtgtacaaaattagacgatgattgatcaagatgccaaaaaatatacaaaattgcgtgatgattgttcaatgtaccaaaaaatgcgcaaaaatgggaactccataaaa

SEQ ID NO: 66475 - DNA, 84 bp, Heterodera glycines
  Genomic contig location: Contig_ID=SeqID_37390; Location=404..487; Strand=+
  SCN-specific regions: Sequence locations=1-12,52-84
atgcccccacgtccaccaccaccaccaccaccaccaccaccaccaccaccatgtccttcaccgctgatgctgctagtgctggag

SEQ ID NO: 66476 - DNA, 1329 bp, Heterodera glycines
  Genomic contig location: Contig_ID=SeqID_7952; Location=1226..2554; Strand=-
  SCN-specific regions: Sequence locations=1-480,502-685,709-978,1002 -1078,1104-1329
  Gene Ontology: Mol. function=myo-inositol-1(or 4)-monophosphatase activity; Biological process=signal transduction
gtcgcggcaggaatactttacgaattgactgatgcgccgacatggattattggcaagtgttattagacattgatgattcaattcattcactttaactgtttaaatagatccaattgatggtacgacgaattttgtacatcggtaatttacaattaaaataatcacatggaattaccaatttattcccaaagcatcccattcatcggaatttgtgttggtcttgctatcaacaaatctctctgtgctgggatcgttttcaatccaatcactgatgagctatacaccgcaattgaagggaaaggcgccttgaaaaatggctttccaatttcagtttcatccgcgaaaggtaattttggtttcaacaataattgcttatatgagcgcagctgttatgcatttctaaccacttttcatcattgatcgtttcgtttagcacttgatcaatctgttatttgtcaaacttttggtcagcataacatcaaagaaaagggagaaaaatggttggacaatgcattcggcaatttgcgctccgcagttctttcgggcacccacgggtacgttagttcatttttgagtcatcaatttcacgatcactgaagttgtgcatgtttagggggtctgcgattacttacgcttaatgtgtacatttcgttgttgcaaaaaaaccaattttccccacactaacaataaataataaaaaatagttccaaatctttcgttgtttctctattattcccgatttaccacccatcagattttgagcaagctttgctcgtttctcagatcggctctgatcgatcgtctgcccaaatgaattcattcgtttccaatttccgcactttgctgggtgaacgaaatgtgcacgggtcggttataaatgaggaccttaaagttcacgaacttcaatttaaaagatttttaggcatcgctcttttggttccgctgccatcaacatggtctgactcatcctatcatcggctcccctttagctttaaatttaagatgttcttggctcagggttcgcttgacgcttacgtggagtacggcatccattcttggttcgtttagttgtgtttgctataattttaaaatattaattttttcgtttttccccttcagggatatggctgcggcagttgtaatagtgaaagaagcaggagggactgtcaccgacccgacgggttttactctttttttaagtgatatatggtcttcattttaggagctgaattcgatctaatgagccgcaaggttctctgcgccagcacgtcgcaattggcacagcaaataagcaaagtgctaacgcacgtcgattttgagaaagaggcc

SEQ ID NO: 66477 - DNA, 712 bp, Heterodera glycines
  misc_feature (611)..(611): n is a, c, g, or t
  misc_feature (690)..(690): n is a, c, g, or t
  misc_feature (706)..(706): n is a, c, g, or t
  Genomic contig location: Contig_ID=SeqID_37393; Location=172..883; Strand=+
  SCN-specific regions: Sequence locations=1-89,123-496,518-533,555-712
atggagcgtaaacagtgatttcttcctaataaaacccaatcatttgaaagctgtgtatcgcgcaagaaagaatggtagcaacaataaagattaaaattaacttttttaaataaatttaaattcagccaatcaaaatttgtatgccaaattcgtgctcttcccgcatttggccattgtctattatgaaaccaaaatcataaagaataacagaaacatcaggtaagtattgatgttcgatttttaaagatatgcaaaggctggttgaggttgaccacatcctatggattggggcttttcagtgtttgctttgttccagaggaaatgaaaattttattaaaattccgaggaaaattgaattttttataaatttactttcattctaaaaaattcctttctaatatgtagagaggagagtaggaatctaagaaattgtggacaaatttaaaaagctgaaagtcggcctttggtattggaagccgatgctgatttgaatttgatatcattaggcatttacagtaccatttcgattggaatttggacaaaatccgacgacaccttttacaaatattcaaacaatggcttcattttcggacacagtgccactggcttgngcggatatccatcttttgcagagggcgacacaatcggatgcggcgccaatttaacatcgatggaaatcatttacaccanaaatggacaaaaattngagtga

SEQ ID NO: 66478 - DNA, 243 bp, Heterodera glycines
  Genomic contig location: Contig_ID=SeqID_37398; Location=335..577; Strand=+
  SCN-specific regions: Sequence locations=1-243
cagcaaaagcaaattgagacgaatgagcaaattgaaaatgaagcacaaaaaacggtggaaaaaacgcaccaatgccccgaaaagcgaacaaaaggcaaaaatgggaggacggcgaaacaatcggcagaaaaaatgggtcagaaaaagggcgctcccggacaatccgacagtgagaacaatccgacaaaagagcttccctatagcctgtactttaattctgcgttggatttttgctccccataa

SEQ ID NO: 66479 - DNA, 372 bp, Heterodera glycines
  Genomic contig location: Contig_ID=SeqID_37399; Location=14..385; Strand=+
  SCN-specific regions: Sequence locations=1-15,40-372
atgatttttaaaattttctcaaaaaggatttttgctcttttcaaggtccgtcaacaagatgatcaggaagcgggcgctgcaggacgtgttgcggtgatgaaggagccgcgttcacgtgccgacacgctgccaccccagcatccaatttgcacactgtcactcacgctgcctgactacattggaccgttgccttgcatcagtgcgcaggctgacatgcaacgtggtgacaaacagcagccaccggacggcggtgcaccacgcgtgccgtcagtgagcgaacgttacgcagaggcgctgcatgcaaacctggccgaggcatacccaaacgtgccgcttgaactggtggctaaacgaatcggcggagactggtaa

SEQ ID NO: 66480 - DNA, 544 bp, Heterodera glycines
  Genomic contig location: Contig_ID=SeqID_37400; Location=294..837; Strand=+
  SCN-specific regions: Sequence locations=1-120,188-193,219-354,411 -507,538-544
ggccatgacgacgcattttcagtgatcacattggacagagttgttgaacagttcttccgctggcgcttaatgcttccacgcgttaaggtaaagaaaaatgaatggatttgatttgatttgattattaattttcactaaataaaataaattattttatttataataaacaacatttattttttttttacattaagcctttctacgccgtcaaatgcaacaatgatccaattttattacaacttttggctaatttgggatgcggtagaaattaaatttgcactcaatttaaaaaaaacaatacattttttgacaggttttgactgtgcaagtcgtggtgaaattgaatcggtaatcaaaaaaatctatatatttttttaaattatttttgtttataataataataataatttgagattgtcaaaaatggtttgtgctccggggacaacattgtgtacgcaaatccgtgcaagacacggtcatacattcgtcacgctgaacaaatgggtgaataaaatttaaaaaatatatttttaaattcataaaa

SEQ ID NO: 66481 - DNA, 181 bp, Heterodera glycines
  Genomic contig location: Contig_ID=SeqID_37401; Location=336..516; Strand=+
  SCN-specific regions: Sequence locations=1-45,138-181
atgccgacggcacattttatgcgctatgtgctgataacaggtaggatttaaaaattaaatataatttttaaataatttataggaatttattgaagaatataaaaaaaaatttttttttaaaaaaataattaattttaggcgcaacagatggaatcggaaagcaggcaagcaaatgataaaa

SEQ ID NO: 66482 - DNA, 370 bp, Heterodera glycines
  Genomic contig location: Contig_ID=SeqID_7956; Location=380..749; Strand=+
  SCN-specific regions: Sequence locations=1-8,42-103,148-370
atgaacgttatgaagactggagaagaacatgacatcaccaatttcaaacttgggaaaactcaaaaggtatgcatttgtctttggtctgaaggtagaaacttggtaaaaaataagaaacattttaatctaataatttttttataatttcctctttgattcatttgcattttagtacctctttgccatgatacccgaccttttccgactttatttttgaagtcagcagaagcaccgatagacaaatggacgcagcgagatcagctcgaaatttcgtgcacaacatgcgagttttggggatcaaacatacaatgatgatgaaaaaattcgtaagctaatgacggctcttagtctccagttcgtgggaaacgca

SEQ ID NO: 66483 - DNA, 3573 bp, Heterodera glycines
  Genomic contig location: Contig_ID=SeqID_7956; Location=891..4463; Strand=-
  SCN-specific regions: Sequence locations=1-834,857-1084,1106 -1251,1273-1761,1784-1806,1828-2149,2172-2634,2657-2723,2745 -2883,2905-3233,3255-3317,3341-3368,3390-3414,3457-3473,3495-3573
atgcttcatgagacgtcgacccaggacactcgcgcggtactggaggaggaccggagagaacattcggtcgttcttatgggcgttcccgaatcggacagtggcctttcctccacacggcgcgcaattgctgaccaacagcaggtgttggacattctggacgtttgtgaaatcgaggcaatgccgaccaaggtttaccggatgggccaaagaaaggaaggaagacccagacttctcaaagtggaaatgccaacccgaaagatgacacaatcatttctccgcaataaaaaccgacttaaaaactccaaatttcaagctgtatctgtccgtccgtctctctctcctgaacaactcaaggagcggcataatttgatcaattgttgcaagacagcccgcgaccaatttccgaatcacaatttcattgtttatgctggacatgtcattccccgaaacgatgtctctgtttttcgcgatgaccctggtaattatgcctgtttttgccataaatcaaattcataaagtcttgcggggaccacccataatggaatttcaaaaaattttacaaacgtaaattcaggtaccgcaagatttttcaaaagtcctcataaggttaataaatgtatacaaggtgctttagttaatataaggtctatctataacaaatgcgaacaaatagaaacaatttttgaatccttaaatttagactttatttgttttacagaaacctggggtaaaaatgaaaaccaatttccttttcattcaaattttcttcaaaatcatacaatttcttacgctaacagattgaataagcgtggaggcggcatagctttcagttttttgtaaagttttctgaaacaaaatttgggtgtgaaatattagttttacagtttcaaaagtacaattcacttaatttgattcttatttatcgccctccatctactaatttaaaaaataccaaaaatcttttcaaatttcttgacctttacatttcagaaaactgctgtatacttggggattttaaccttggaactaaagatttaactataaaaaataaaaaacctttccctttaagtaattttggtaatttattttgtgatttctttaataaatataatttgacatcctgcattaatgaaccaactagggagcaatccttcctagatttaatcctttcaacaaaaactgacttaataaatgcggtagaagtaaaaggtggacttttagatacagatcatctaacaattctttttgatttttgtgttttaaagcaaaatgcaaccaagaaacaaattattcttaggaattttactaaatctaatacctttctattcgatgcatatttatcctcatttcttcctcaactactacaaaaattttatacagttgaggataaatatgctattttctttagttctgttcgaagaaatcttgaaattaatattcctgaaactattttatctattaagtccgccaaaaacttttacccaccgcatttattggcttcaattagggaaaaagcacgtctatataagctaatgaaagaaaatagaggaaaatatgaacctttatataaaagtatctccttacatattaagactcaaataagaaatattcaatcccgtaaagaaaataaaatactatccggtgataagaatagattattttcgtatcttagaaaatactttaagccagtagaggatccaccagttattcagtataatactttgtttgtttcagactcaacttctaaagcggaaatttttgcaaaaattttttctgaaaactttactgtaaataattattctcttgattttgatacttctttttcttctccaacaataaacgacgttgaatttaatattatttctgttggtaaagttcttaaaactttacctaacagaaataacacatcaccggacggtattacctttagactgttaaaaaattgttctctttcgtttactccttttgttactgaaattttcagactctcccttgatacaggaaaacttcccactatatggaaacaatcgattattatccccttgcataaacaaggggaaaaaagtaaccctatgaactataggcctattgccttaacttgttctttatgcaaaattatggaaaaatttattgtttgggctatttccgattttcttttaaagaacaatttattctctgaacatcaatttggatttataaagggcagatcaaccacaacacaactaatttcaacccttgaaaattggtatgatggtatttataataataagaatatcgattgtgtctatatagattttaggaaagcatttgatgttatcccccataatttacttttatataaggttcatagaatcggtattaggggtaaaatcttaaactggatatctgactttctttcgaaccgtacctttagggttcgggttgataatactctctcttctgagtataaaatgagctctggcgttccccagggttctgttcttgggcctcttttgtttctgatatatattaatgatttacctgaattaattcctaaacaaatttctataaaattatatgcggatgatgtcaaattatattccgtacataaaacaaaaaatgatagaattgctatgcaccatgctttaaatattctctctgattggtctaagaaatggtatattaaaatttctattaataaaacttttatcatttacttcggaaagaataaccccagggaacaatataaaattaatgataatgcaatttgtgaagttgaaactattcgtgacttagggattcttattgacaataaatttactttttccgaacatataagcaaaattacccgtaacgcctactaccgtatgcgtttacttttccgtgttattaaatcaaagaaaatttcagtttggaaaaatatttatgttagttatatccgtccacttctggaatattcccctgaatcttggaatccgcaacttaaatcgcatattatcaaaattgaaaaatgtcaaaaatattttactcgaatcgctttcagaaaatgttgtcttccatatattccctatgaccaacagctccaattttttaaattagctactcttgaaaaacgaagaaaaatttttgacctcctaactacttacaaaattttacatggttttacacatttggacccaaattctctgtttaaaagaactaacttaaatactcgaaacaagtcatttttccggttaaatgttaaattacaatctaaaaaatcttccaaatcttttgttaacagatcagtcaaggcctggaatgcccttgataaaacgttaatgtctagctcattaaacacctttaaaaaattattagaattgactcttgattctgaaagcgccaatgtataaagaaattattaacttttgaggcattttattgactttgacctcgattttattttcatataaattttttgttattgtttatttttaacctgtgatctcacttgatatttattcacttactctgtgactattttactgtgatcagtcatcagagtaagtggttcccgcccttctgatggcaattttttctttatcgataaataaa

SEQ ID NO: 66484 - DNA, 964 bp, Heterodera glycines
  Genomic contig location: Contig_ID=SeqID_37404; Location=361..1324; Strand=+
  SCN-specific regions: Sequence locations=1-43,68-80,416-964
atgagcagaggacaaatggacaagaacaaaggagcacaatcgaacaacaaagtgatcagcagcagggacagtgatcaaatggaagaaaagggaaagtgatcaaatggaagaaaagggacagtgatcaaatggaagaaaagggaaagtgatcaaatggaagaaaagggaaagtgatcaaatggaagaaaagggaaagggatcaaatggaagaaaagggaaagtgatcaaatggaagaaaaagacgagaaaaggaaagtgatcaaatgaaaaagaaaaagacgagaaaaggaaagtgatcaaatgaaaaagaaaaagttgtcaaatggaagaaaaagatgagaaaaggaaaagtgatcaaatgggagaaaaagagacactgatcaaatggaacaaagatagagaaagagagtaggaagagaagttgcagggacacatccctttcacctttctctttacttcatattcaaattgtaaattatttaatgattctgtgacaagactctgaaacatttttgctatttagggcataatgatcaattaattgttaattgagcacagttgaatggttcctccttctctgatcagtgagtggtcgcgcacctttagcttacgccagggctatcatagcataaataatgaaagataaacaaacaaaacggaatggagaaaaggggataattgtggtggtgattaattatacgacttttcctaattagaatcgttaattgtcagaaatggaaagcgaatttagcaaaatgaaattcaattttcccacacagaaatatttagctcgactctttcgactgttatttaacttaattactttaacccatttttctgaaaatgatttccgatttgtcccctaattcaaaagtagcaaatatatataacaaattcattaattactaatgttaaatgaatatttcaatttaaattgtattgataatttatgccctcggaaaaa

SEQ ID NO: 66485 - DNA, 670 bp, Heterodera glycines
  Genomic contig location: Contig_ID=SeqID_37405; Location=135..804; Strand=-
  SCN-specific regions: Sequence locations=1-193,215-284,306-427,451-670
atggagagggagaatctcgactcttccggctcggattttcgagggtgagcacgtggttcgggttctagattgtattcgactctaacaggatgccttttaatgcttcttctcagatcactccttcatgttgatcagttatatgggagaatttaggaaaaaatcctaggcgttaaaaaatttttgcgcaattttagtaagcccattggaaagagtacaaaattgctacaatacccaaaagaccgcaagtccctacgactaatacccgaaggtatgggcatttcaaattttgtatgtgcaaaaagtactgtatcaaaagttagttatgaagaattttttcagatttattggcccaaaaatattgagttgaagtaaaataaacaaattttccatagaccacctaaaatgggcgctataccaattcacaactaaatactttaatataaaacttatttatgcagaaaagtgcgtggcctaaaattatgcaggattgcgcagaggacgcgttaggcaacgcaccgattgaagagagcgcggccaactatcaagctgcttctgtacgggttaaaaaggctattgacctaagaggtccagcaaagtatgttccctcatttcggcaatttttgaagaattgttgtgtcgtttatcaacaacaacaaatataatcaataaa

SEQ ID NO: 66486 - DNA, 49 bp, Heterodera glycines; identical to SEQ ID NO: 51181
  Genomic contig location: Contig_ID=SeqID_37406; Location=362..410; Strand=-
  SCN-specific regions: Sequence locations=1-49

SEQ ID NO: 66487 - DNA, 764 bp, Heterodera glycines
  Genomic contig location: Contig_ID=SeqID_37407; Location=188..951; Strand=-
  SCN-specific regions: Sequence locations=1-635,668-764
atgtttgccccaaaatttttgcttgctttactggtctgtgttgcttttgccattggaacaaagcatggaaaaacggcacgcaaaatggcaaagaacaatgtggcaaaggacgagctcgaacaggtcattcattcattgggaggaaaacagaagagatttaggaccagaaatattggttaaaggttttttttggaagaaaaatggacacccaaattgagcatcaaaatttccctaaaataaaacataaaaattagggctaaattatttatttactttttgaattcagcataaaatttacacaaatccatggaaaggagttaacaaaaaactaataccgatttcctaaaaaagagcccccgggggctctatttttcaacccccctcaaaaggggaactctaatttagggggcggggggggggggggttatttctcgaccccactcaaaaggggggctttctttctcaaccccatcaaaagggaggctttattttagggggaggctctaattaagggggcgggggctttatttctcaattctcaacccccctcaaaagggggggggctttatttctcaaccctcttcaagggggggggggctaatttaaggggggggggctatatttctcaaccctcttcaagggaggggggctttattttagggaggggggctctaatttaggggaggggggggggagactaaaatgaatgaaccaccaatgaagatatttgaaaaatcgacgtattaggattgctttggaataaa

SEQ ID NO: 66488 - DNA, 536 bp, Heterodera glycines
  Genomic contig location: Contig_ID=SeqID_37408; Location=759..1294; Strand=-
  SCN-specific regions: Sequence locations=1-181,203-318,343-358,382-506
atgcttttttgggcttctctcgccataactaagccacagaaagctccggtggcaccagcaatacaaaccccacagacaaatgttccgactcttgccaaagaaaatggaccagaaccgaaggaggccagtgaagacacttcaaaatcatcgcaggttgacaaaacaatcacagaaaacgaaaatccaaatccactctcaaatattgacaaatttctcctccaactggaatcatttcgaaaacaattcccccagtgcttcgataaatagttctgcagacctccaacaaatcgaaaaaaaaaatatctctacacaatttcctaaaaatttacccaaaaattttttctcaatttcctataaaaaccaatttccctttgcttaaaatttcaacaataatgtcacaactacccattgacctcatttcattaccaaatgtaaattgtcttctttcacttctacccatttgacctctcgtatttccacctcaagtgtaagcggcagcaatgcccttcttttggttatttttatttttgaataaa

SEQ ID NO: 66489 - DNA, 323 bp, Heterodera glycines
  Genomic contig location: Contig_ID=SeqID_37409; Location=364..686; Strand=-
  SCN-specific regions: Sequence locations=1-149,171-181,203-205,231 -254,286-323
atgagcaaagcgatgaagtgtttattgatgaaatcagagaggaccttcagtcaactttcacaaatatatagtgcaaaaagaacaagtctttcggccgatcattcaaaaaagtaattcccctccaagtagttgtttttcttctaatttttcaaaattattcatttttcagtgggaattcaatcataattttaacaattaaattcgtaaaatattttaattttttggactaaatcagttaacaaattgcacttaaattttaatgaatttttgttttgtgcgtttttgaaatgataaatattgtgccaaattgaatcaaaattaaa

SEQ ID NO: 66490 - DNA, 347 bp, Heterodera glycines
  Genomic contig location: Contig_ID=SeqID_37410; Location=407..753; Strand=+
  SCN-specific regions: Sequence locations=1-179,203-258,280-347
atgtttagcgaatttgaggtcaattatttgcgcaatttggccaatcaaattgcccaaaacgcatatgtggcaaagccgctgacagtgcaaacaaacattcataatctgacaataacattggcaatttttcgaaaaatcattgccgagcttgaaactaatcccaatgtgttcatattagacagcctgaaaagtgacaaagaaattgcaacaaattttttgcatctttgcgtttcgctgttggacgccaaatttgaacactttcagaaccaagtgttggcacgtttaaacgaatttgaccggatccgaaagggcattttggacggctaagggcaaagctcaaaatccaa

SEQ ID NO: 66491 - DNA, 1484 bp, Heterodera glycines
  Genomic contig location: Contig_ID=SeqID_7957; Location=3..1486; Strand=-
  SCN-specific regions: Sequence locations=1-260,291-429,463-882,904 -993,1015-1252,1293-1295,1317-1484
  Gene Ontology: Mol. function=calcium-dependent phospholipid binding; Cellular component=integral to synaptic vesicle membrane; Biological process=larval locomotory behavior
atggacgaagaaaagaggaagcagcgccagaaaaggagaagaagaaatttctgggcacactcagctacaaattggaatatgactttgacaaaagcaatgtgaggagaaaatggggaattggaaattggttggaaaatgaaatggttaacggaaattgagtcgagttcagctgacggtgggcattgtaagtgccgaaagtctgccggcgatggatttgggcggcaccagcgacccttacgtcaaattgtttttgttaccggtaaaataaatttaaaaaatattatattttaccgtaattacccaaattcaggacaagaaaaagaagttccaaacaagggtaagacaacatttaaaagtgtatgtatattaaattaaaggtgcaaaggaagtcgctgaaccccgtgttcaacgagtcctttcaattcaaagtaattaattaacgaattaattggttaattagttttaaatggcatttttgtctttgttcaggtgcccttcaacgaaataaacagtcagactttggtgctcaatgtgttcgacttcggtctgaccagcaaaaagtcacaaaaacaattcgcttatgcattttcctcagatcggttcggcaaacatgaccaaatcggccaaatttcgattcccctcggcaaaatcgacttggccacgaccatagaaaagacggcaccaatcgaagcaccgccggtcggattaaaaataaagaaacggaaaatgaaagaaagacaataaagggacggccattcattagggagatttaattgaaacctaattagttaattaataatttggctaccgtatcaaattcatttgtggaaattctatttcaggaaaatcggctcggcgatgtttgtttggcattgcgttacgtgccaaacaaaaacaaactgacggtggttgtgatggagtgcaaaaacttgaaaaaaatggtaaaattggagggcgggtgactcattaaaagcaaacatttccaaatgattcaatcaattaattaactaattaccactttaggatgtgctcggcctttccggtccgtccctttttccgattttttgccattcttttcaaaatttcctttgtccccaaaagatccgtacgtcaaaatttatttgatggcacagaacaaacggttggagaagaagaaaacgaccatcaaaatgaagacattgaacccgtattacaacgaatcgttttcattcgaagtcagccccgaaaaaatgcaagtgagcgaaaaaaacgaaagaaattggcaaaaaggaaaagccatgccaacagcgaaaaagtgcccccctttccattgcagcgggtccatttgcatgtgattgtgtccgactacgacagagtgggctccaacgaaaggataggacacgtaaggaagggaagggaaggccacgatggtcgagacttctgaatttactcgagacagagatttgaccctcgagaaatcgaatctgtgactttttttgagtgag

SEQ ID NO: 66492 - DNA, 863 bp, Heterodera glycines
  Genomic contig location: Contig_ID=SeqID_37412; Location=60..922; Strand=+
  SCN-specific regions: Sequence locations=1-54,78-407,429-452,474 -724,749-759,781-863
atgtttttatcaaatttattagctttttattcgtctgtattcccatttttacgaatgttttacatgttcaatattttgccagatgatttttggcgagacgcccttctatgccgagagtttggtggacacgtacggcaaaatcatgaaccacgaggagatgttcgagttcccggaggacatcgacatcagcgacgaggcaaaggacctgatctcgcggctgatttgtgcccgcgagacacggctcggcaaaaatgggctggccgacttccgggaccatccgttcttcgccgacatcgactgggagaacatccgaagcggtcggtaaaaacacagagaaaccaaaaaaaaaaaagcgtaattttctcgaacatataccggaccaataataactggaaaaaattgtaggggaaatttcaagtttttttttctggcgcttgcccccccccccaaagtttttaatattttaaaaaattgtgttcaaccggcgcaggtcgtccccccccccccctcccgccatttcgcttgtgaaatattgcaaattaagaatatttgcaaaaaaaaaattgttaggaatatttttccgtaagaaaatttcaagaaaaaaaatttgaaaaatttttcagcgattagtggaggcgcctttgcttttcctcaccccttaaattggcgtaaatttttaggcccaaaaagagtaatttttgaatacctatttttggaccaaagcaatttttttttaaaataattttaagaatctacaggaaatataattgtaatttttaaatttctcaagaaaaagggtatattttataacaaatcgttttttattctttttaaagagcaccttttctatttttttctaaaaa

SEQ ID NO: 66493 - DNA, 706 bp, Heterodera glycines
  Genomic contig location: Contig_ID=SeqID_37413; Location=556..1261; Strand=+
  SCN-specific regions: Sequence locations=1-114,152-190,214-706
atggtagtgacctcagcattggatgatctgcagaggaaagcgcgtcttttggaaaatgaaatcgatgctcaacttatttctctgaacaagttcaatccttcagacggtggactcattatatatatttttaatttaatttcaattttataaactggaccgatttcatttaaaatttgtccttttgtttttgttgaattaaatgttttccttttcagctctttcgtcttactcttacaactcaaatcagacaaagggtcaaggcaaacgggcggtgttcgattcgttaacaactgacattgaaaataaactctcaaaattgagcgaaataaacgatgcggttcgttttgcagaaattatggtgaattttagactttcatttgcacttccctcttcagatgcgcgattgctttgagaatgatatggccgagttcagcaaaacttccgtccaacacattgtgcgacgacaccgcgacattctcagggattacagcacggaattcactcggacaacttcgaacatcggaaaccaactgcacaggttaaaatgcgattattcacttttttggattataaaattcagagaagaattaatggccatcgaatcggagtcatcggtgaataatcggtgcaaaccgacggactatttactaaaggaacacgaaagcataagcaggcattaattaacacattttgtattaacggatca

SEQ ID NO: 66494 - DNA, 47 bp, Heterodera glycines
  Genomic contig location: Contig_ID=SeqID_37414; Location=144..190; Strand=+
  SCN-specific regions: Sequence locations=1-47
atgagaattcatgcgagattttctggaaataagcttaatatggccta

SEQ ID NO: 66495 - DNA, 429 bp, Heterodera glycines
  misc_feature (233)..(233): n is a, c, g, or t
  misc_feature (235)..(235): n is a, c, g, or t
  misc_feature (239)..(239): n is a, c, g, or t
  misc_feature (246)..(246): n is a, c, g, or t
  misc_feature (256)..(256): n is a, c, g, or t
  misc_feature (274)..(274): n is a, c, g, or t
  misc_feature (280)..(280): n is a, c, g, or t
  misc_feature (282)..(283): n is a, c, g, or t
  misc_feature (287)..(287): n is a, c, g, or t
  misc_feature (295)..(298): n is a, c, g, or t
  misc_feature (307)..(307): n is a, c, g, or t
  misc_feature (340)..(340): n is a, c, g, or t
  misc_feature (362)..(362): n is a, c, g, or t
  misc_feature (364)..(364): n is a, c, g, or t
  misc_feature (370)..(371): n is a, c, g, or t
  misc_feature (399)..(399): n is a, c, g, or t
  misc_feature (404)..(404): n is a, c, g, or t
  misc_feature (406)..(406): n is a, c, g, or t
  misc_feature (408)..(408): n is a, c, g, or t
  misc_feature (420)..(420): n is a, c, g, or t
  Genomic contig location: Contig_ID=SeqID_37416; Location=464..892; Strand=+
  SCN-specific regions: Sequence locations=1-58,86-371,393-429
atgacgtttatttttagccataacgtgttttacgtgacattttacgcgaaaaagtgagaaattaaaaaatttaaaaaaataattaggtgccataaaggcaaaaaatttcgtaaaatctcataaaaaaacatcatttatggttttttagttgtttccttacatttaagccgattttgaaccaaaaaaacgaaactagaaaaaaaatttgaagtttcgactttttgttcgaattngngttnaaggttntaattgggtngaaatggatgtaagaatnggattntnngagngtgaaaannnntaaaatgantttaatttaagaaaaaaaatttgaaattttttngaaaggggggtggagtaataanantgttanntttttaaatttttgatgttatattttanttaantnantggaaaaaagtnatggttaaa

SEQ ID NO: 66496 - DNA, 222 bp, Heterodera glycines
  Genomic contig location: Contig_ID=SeqID_37416; Location=1..222; Strand=+
  SCN-specific regions: Sequence locations=1-105,130-187,209-222
tttacaaaaggttgaaatacggctcctaaaaatgcatgagggagaagaatgaacacacttttccgatttcaatttcacttttaacttttgttgtcaaatgtcaccaattaattttaattaaaattatttggtggtattaatctataattggcactttcatcgtcgtgtgagcattaacagatataatttcttattttttgccggttttctgtttttgtacgc

SEQ ID NO: 66497 - DNA, 1157 bp, Heterodera glycines
  Genomic contig location: Contig_ID=SeqID_37418; Location=162..1318; Strand=+
  SCN-specific regions: Sequence locations=1-23,45-109,147-192,241 -241,263-277,371-773,813-932,955-972,996-1157
  Gene Ontology: Mol. function=protein serine/threonine kinase activity; Biological process=protein kinase cascade
tttttaagccgtgataaacggcatttgaaataaaaatttgtttaaggatccctcggggattttcgatctgattgaggtggtcggcaacggcacttatgggcaagtttataaggcaaggaaaagggggaaaagcgaagaaaaaaggcacaaaattattaagggaaggcatttgaaaacgcaggcattagcagcaataaaaataatgaacataaacgaagacgaggaggaggagatcaaagcggaaataaacatgctcaaaaaggttgggagggaatcaaaaagaagggcccaaaaaagaggggaaatggctaaaaaaggaggaaaataaccaaaaaagaaaggaaaaatggcaaaaaaaagaggaaataaatggccaaataaagggggattaaatggcagagaaaagggggccaataattggcacattaagtgggctaatgggacggatgaacgtgcaactttttagtattcacatcacccaaacatcgccacttactacggcgccttcatcaagaagttgccctcctcaactggcaaacatgaccaactttggctcggttttctcgccccctccggcatttcagtctttccgttaagtgatggaattttgcggcagcggatcggtgaccgatctgatcaaatcgttcaaaggcggttatttgaaggaggaatggatcgcttacatttgcaaggaaatcctttcggtaggcccaattcttctctgaaggacatttccccctttaggggctaagccatctccacaaaaacaatgtgaggggggggggaagagagaaggggacgaggcgggagagatcggacaatgccattgcaggtgatccatcgggacataaaaggacagaacgttttgctgacggacactgccgaggtgaaattggtcgactttggagtcagcgcacagcttgacaggacagtgggcaaacggaacactttcatcggcacgccttattggatggtggggagggaggggaaagggatcgcatttctgggaaggatggcatgggatttggaggatggccactcgcaatgggttttaggcccccgaagtgatcgcttgtgacgagaatcccgagtccacctacgactcgcgcagtgacttaagggttgagacttcccatttgcaattggcaatctttcat

SEQ ID NO: 66498 - DNA, 631 bp, Heterodera glycines
  Genomic contig location: Contig_ID=SeqID_37420; Location=139..769; Strand=+
  SCN-specific regions: Sequence locations=1-349,372-496,519-631
atggccacactttgcgcaaaagaaccaaattggttggatgagactcaccagtgccgacgcagactctctattctcgttagtgacggagaaatgaaagcaagtgaaatgacggaatgtcgagccaagaaagccgggagcacaaatgcggaggacttggcggataatgaagaaaaaccaacacatacggagctgatacctctttatagttctgaacaacagaataacagcggaaaaatggacagcggtgggaatgtatttttttgaaaaaaggaccatccgtgttcaggtatttttgaatggaccgggagcgatggagaaaacggcggggcaacaactgcggatcgggaagaaaacaacgaaaaagaggacaccgacagtaactgtgagaaccatgccgacgacagtacgacgcgtagtcgcaaaaggtgtgagttctattacttacttattaactcgtttgaccttgtcatttaagtgcaattgaaaataagttgccgaactgcacagagaaagaagggagcacttttatacccaaaattgtcacgaacgatgaaatggattcaggcctagtagcagatatgtccccagctgcagaaaaacaccaacattttcagttgccgccatcacctga

SEQ ID NO: 66499 - DNA, 372 bp, Heterodera glycines
  Genomic contig location: Contig_ID=SeqID_1032; Location=1076..1447; Strand=-
  SCN-specific regions: Sequence locations=1-70,92-372
atgcctaaagcagccaaatcaaacgctgttttaaatcgtcactggatttcaaagttcccggaaggaacttattcaactgatggaaaaattaatccgggactttacaaattgattgatatcgccaaaattttgattggaggtcgggcgaaaattgataaagactgatattaaatatgatttttttttgcgtaaatacacttggtttttccaatttttagcacatatttttgcattttttaacacatatttaggccttttttttttggtttttagcacatattttgggtttttttatcacatattttattacatatttcaggatttttagcacataaaaatcccagccctatttattaacaaaaattcaataaa

SEQ ID NO: 66500 - DNA, 1294 bp, Heterodera glycines
  Genomic contig location: Contig_ID=SeqID_1032; Location=5026..6319; Strand=-
  SCN-specific regions: Sequence locations=1-22,45-135,157-207,349 -411,436-445,467-506,531-565,587-662,732-775,808-861,993-1294
atgttgatgaaggtattaatccatctcacagtcagaacaagaaatttaaaattggattacattaacacaaatttttaataatgtttacccattcatagataattaataggatacaattttcaggatgcgattgaaatagttttctctaaaactttttattatttcaatttattaccttttattatagaatagccaactatgcaaaacataatattatttattcataattatataatataaaattttttattcatttatttttaaaattttttaatattttaatatatattaattgttaacgtaaaagtttatatttaaaatataatatttattgtttttcaataaatactgagctgattatgcatttctaataaaacaaagaattgttccatataaaattttaccaaatttacaatttataaattggtgttagtagggaccgtttctttttatggttttgatgttcattttgtctaaacattattaatgtatttgtttccttcttcataaaaaaattataaattttaattcttcaatttaaatccttgtccaagttaccgcttaattttccccatttatttgccccaattatgaattgtttttttttaccaataaaaatctgataaggtttgttttattttatttgtggcatcactgctgggtaaattataatatttatgattttgtattcttaaaattatatttttgttttatttcataaattatttattccttttctatttgctttaacatataaatagcattagtgccattgttataatataaataatttaaattaattattatgtgtgtttcggccctaaaccgtatacacacaaagccacagcaatcaagcaaagcaaataaattttattaagcaaaataaatataatttatttatattggtttatttatttaagttaaaattttttaaactaattttatttgaatatgtttaatcagttttataatttgttaaatgttatttaattccctaaaaacctttaaaactgctaaaaccgtattatccactctcatcggagctgccggaggggcctcccaacgggacaacacggcacggcattccctctgtcattgccctgccaaatcccacgttcataaaatctgttttcaggatgcaaacgggaagcagaaagaaatccacaaagacgaagaaaaccttccccttatcctgctatattgcttagccaatggaaaacgtttagacttgtacgtgtgtaactaatttacacagaataatgcaaatgttggagccttgcaagctcaaaataaa
